United States Patent 11,098,302 (IDENTIFICATION OF POLYNUCLEOTIDES ASSOCIATED WITH A SAMPLE) - sequence listing, part 72

SEQ ID NO: 247105 - DNA, 918 bp, Homo sapiens
  misc_feature: GYAE6OF02ISCBB.9.70.G04.1.454.CMB.1.raw
tcagtgatacgtctcacgaccggtgctcgatttagtgtagtgtgaagggaaagggccgtggtgaaggcttcactagtcctggacctcctgtgcaagaacatgaaacatctgtggttcatcctcctcctggtggcagctcccagatgggtcctggtcccaggtcgcggctgcaggagtcgggcccaggactagtgaagccttcacaggccctgtccctcacctgcactgtcctctggtgacctccaatcagtaggtggtcttcctactggacctggactccggcagtccgcgcaagggctgggatatagtggaacaatcgtaatcgacctaaggtcgggacctccgaatcctaacaacccgttcctacgaaagcgtcgaatcgacgcaatcgtacagtcaacgtccgtaccgtacgaaacctaacgttacctacccgtacgtaaccgtaacgttacgtaacggttaacttaagttacgtaaccggtacccggtaacgtaaccggtaaccgaaccgggtacccggttaacggttaaccggttttaaaccgttacggggtttaacggtaacccgggttaaagggtaaaccggggtaaaccggggtacccgggtttttaaaaccgggtttttttaaacccggggttaaaccccgggtttaaaacccggggggttttaaacccgttttaaaaaacccgggggttttttaaaaaaaaaaacccccggtttacccccggggtttttaaaaaaaccccggttttaaaaccccggggggtttttaaaccccgggttttaaacccgggggttttaaaccccggggttttaaccccgggggtttaaacccggggggggttttaacccccggggttaaaaccccggggggggggttaaaacccccgggttttaaaaaacccccggggggg

SEQ ID NO: 247106 - DNA, 571 bp, Homo sapiens
  misc_feature: GYAE6OF02FHJUS.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtccgttcctactggacctggactccggcagtccgcggcaaggctggatatagttggacaatctagtcgccaggtcgggaccgcatcctaccaaccccgtcctacaagacgtcgagtcagctatgtcagtcgacacgtccagaacctagttcctccctgactacgtgagttatagtcgacccgcgacagacgacggcgtagtacttacgtgtcgacgagagtacggtaccgtttagtttacgactagtacgttaacgttaaaccgtcctaacgtaccgttacgtacggtaccgtcggtcgggaccggtagggtaccgtaacgg

SEQ ID NO: 247107 - DNA, 707 bp, Homo sapiens
  misc_feature: GYAE6OF02JX4DO.9.70.G04.1.454.CMB.1.raw
  modified_base (233)..(233): a, c, t, g, unknown or other
  misc_feature (233)..(233): n is a, c, g, or t
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactcatcagaggtcggtccgttcctactggacctggactccggcagtcccgccggacgaagggactgggagtactagtacggaacgtatcgtatcgaccgagggttcgggacccnccaatccgtaaacctaccccgtcctacgaagtacggtacgtacgtcagtctatcgtacagtaccgactaccgtaccacgtaaccgtcgttcctacctaggacctagttacgtaagttacgtacgtacggacccgtaccgaccgaacgtaccggtaccgggtaccgttaggttaacgttaccggtacgtcggtaacggaacggtacgggtaacgggttaccgtttaacggttttaccggaccgtaggtttaccgtaaacggtttaaaccgtacccggttaaccggttaccggttacgtacgggtttaacccgggttcgggtacggggtacccggttaacggggtaacccggttaaccggg

SEQ ID NO: 247108 - DNA, 729 bp, Homo sapiens
  misc_feature: GYAE6OF02INEOS.9.70.G04.1.454.CMB.1.raw
  modified_base (241)..(241): a, c, t, g, unknown or other
  misc_feature (241)..(241): n is a, c, g, or t
tcagtgatacgtctcacgaccggtgctcgatttagtgtagtgtgaagggaaagggcctgtgaaggcttcactagtcctggacctcctgtgcaagaaccatgaaacatctgtggttcatcctcctcctggtggcagctcccagattgggtcctgtcccaggtcgcggctgcaggagtcgggccaggactagtgacgccttcacacggccctgtccctcactgcactgtctcgtggtcactcntcgagaggtcgtccgttctactcgacgtggacgtccgacgacgtccggcgacgggtaacgtacggtaggtactagttgtacggaataccgtatgaccgacgtagggcccggaccacttaccgtacctaaacccgaccccgtccgtaaacgacgtacgtacgtacgtacgaccacgtagtccgtacggccgtaaccgaccgtaccccgtaccgtaaccgtaacccgttacgttaccccgtaccgtacgaacgtacggttacgttagttaactacggtaccgaccccggtaccgacgtaacgtaacccggtaccggtccgttagttaaccgttagtacggtacggacggtaacgtacggtaccggttacggtttaacggttaccggtacgtacgttacgttaaaaaccttccgttaacgtaaccggttaccgtcgggtaccgttaccggttacggggtacccgtaacgggggtaccctaacgggtacccg

SEQ ID NO: 247109 - DNA, 692 bp, Homo sapiens
  misc_feature: GYAE6OF02GHRJV.9.70.G04.1.454.CMB.1.raw
  modified_base (276)..(276): a, c, t, g, unknown or other
  misc_feature (276)..(276): n is a, c, g, or t
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggnacgtccgcggacgaagggctggagtatagttggacgaatctatgaccagtcgggaccncatcctaccaacccgtccctacgaagagtcgagtcagcagttcgtacagtcccgaacgacccgtacccgaacgaaacccttacgttccctaccccgtacgtaacgaaggttagtaacgtttaacgttacgttacggaacccgccgtaccgaacgaccgtaaccgggtcccggttagttaacgtttacgtacgttcggaccgtagggaacggtaacgggttacccgttttaaggttttaaccgggtaaccgtacggttaccgtttaacgtttaaaaaccgttccgttaaaccgttaccggttacgttacggttaccggttccggtacggggtacccggtacggggaaccgttaaccggg

SEQ ID NO: 247110 - DNA, 895 bp, Homo sapiens
  misc_feature: GYAE6OF02JUQWK.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctcgtggtcgacctccatcgaggtagggttcggttccgttcctaacgttcgggtacctgggtacttcccgggactaccggtcccggccgggacgtaaaacggggtccgtagggtaacgtaagttacgttcggaaacgtaaacttccgtaagtcggtccggtaacgggtaccggggtaccccgtaccgtacttaccgtaaaccccgtaacccccgtttaccccgtaaccaaaacggtaccgggttaccggaacggtttacccggaagaccgtaacgttcgtaccgtacggtacccggtaaccgaccccggttaccccgaaaccgtaaaccccggtaccgttttaccccgtaccccgttacggtaaccgttaacggttacggttaacggttttacgtaaacgttccggtaaacccgtcccggtaacgtaacgaacccggtaaccgggtaccggttaacggtttaacgttaccgttcgggtaacggtaccgggtaacggtacggtaccgggtttaaccgggttttaacggttaacccggtaaccgttaacggtaccgtttaaaaccggttaaaacccttacccggttaacccgtaaccgggttccgtaacggggttaccggttacccgggtcgggggtaaccccggtaacgggggtaacccgttaaaccggg

SEQ ID NO: 247111 - DNA, 569 bp, Homo sapiens
  misc_feature: GYAE6OF02GNIWC.9.70.G04.1.454.CMB.1.raw
  modified_base (328)..(328): a, c, t, g, unknown or other
  misc_feature (328)..(328): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctgggagtatattggacgaatctatgcagtgggaccncatctacacccgtcctacaagagtcgagtcagcatgtcagtcgacaccgtcccaagaaccacgttcctccctgactagtgagttatactcgaccgccgacacgaccgacggccgttgtaacttacgtgtcgcgagacgacggtccgtttagtttacggacctagtcgttaacgttaaaacctccgttaaccgttacggtcgtacggaccgttcgtacggggccgacggggacctaaccggg

SEQ ID NO: 247112 - DNA, 827 bp, Homo sapiens
  misc_feature: GYAE6OF02H5VVL.9.70.G04.1.454.CMB.1.raw
  modified_base (162)..(162): a, c, t, g, unknown or other
  misc_feature (162)..(162): n is a, c, g, or t
  modified_base (164)..(164): a, c, t, g, unknown or other
  misc_feature (164)..(164): n is a, c, g, or t
  modified_base (185)..(185): a, c, t, g, unknown or other
  misc_feature (185)..(185): n is a, c, g, or t
  modified_base (209)..(209): a, c, t, g, unknown or other
  misc_feature (209)..(209): n is a, c, g, or t
  modified_base (753)..(753): a, c, t, g, unknown or other
  misc_feature (753)..(753): n is a, c, g, or t
tcagtgatacgtctcacgaccggtgctcgatttagtgtagtgtgaagggaaagggcctgtgaaggcttcactagtcctggacctctgtgcaagaacatgaaacatctgtggttcatcctcctcctggtggcagtcctccagtgtcggtctcgctagtgcgtngngaggcgccgacgagtactagngactctacagccgtctctcctacncgtcgactctcgtctggtggacacctctatggaaggtggttcgttcccttacctaggtccgtacgtggtaccgtccggacgtccggtcccggacgacggaacggtcgtaggtaattagttacggtaacggaacttactctaggcgtacggtagggcccggaacctctaacgtacccgtaaacccgtaccccgtaccgaagaacggtcggtaacgtacgtacgacgtacttgttaccgacgtacggaccgaaccctaaccggaccctaaagtaccctttcgttccccacggtagtaacgtagggttacttaaagtttacgaccggtaccgaccccggtacaaaccggtaacgggtaccccggtaccgggttacgtttttaaggtaaccttttacgggtaccggggaacggttaacgggtaacgggttaaccggggttaccgggtttttaaaaccgttttttaagggaccccggaacgtttaaaccgttttaacggtttaaaaaacccggtttaacccccttcgggttaaacgggtttaccccggnggggttaacccgggttaccggttaacccggggggaccgggggtaaccggtaacccgggtaaacgttccccgggg

SEQ ID NO: 247113 - DNA, 634 bp, Homo sapiens
  misc_feature: GYAE6OF02FFTB3.9.70.G04.1.454.CMB.1.raw
  modified_base (233)..(233): a, c, t, g, unknown or other
  misc_feature (233)..(233): n is a, c, g, or t
  modified_base (338)..(338): a, c, t, g, unknown or other
  misc_feature (338)..(338): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctcccagatgggtcctgtcccaggtgcggctgcaggagtccgggcccaggactagtgaagccttcacaggccctgtccctcacctgcactgtctctggtnactccatcagaggtgtccgttcctactggacctggactccggcagtcccgccggcaagggctggatatagttggaacgaatcctaatcgccgaggtcgggacccnccgattcctaacccgaaccccgttccctagaagacgttccgagtcagccagttcggcacggtcgaaccaccgtacccaggaaccctcgttcctcccgtagaactaggttagaacgttatactcggacccgcgaccaggaccaccgggtccgttagttaacttaccgtggtacgacggaagtacggtacggtccgttttaagttttaccggacctagtacgttaaaccgttaaactcccgttaacgtaccggtacgtacgggtaccgtcggtcggggccgtacggggacctaacggg

SEQ ID NO: 247114 - DNA, 641 bp, Homo sapiens
  misc_feature: GYAE6OF02IMT89.9.70.G04.1.454.CMB.1.raw
  modified_base (235)..(235): a, c, t, g, unknown or other
  misc_feature (235)..(235): n is a, c, g, or t
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgaggccctgtcccctcacctgcactgtctctggtnactccatcagtaggtgtcgttccactggacctggactccggcagtcccggccggacaagggctggatatagttggacgaatctancggccaggtcggaccgcagttccaccaacccgtccctanaagagtcgatcagcattgtacagtccgactaccgtaccgaacgtaaaccctacgttacctccctacgtaccgtagtacgtaagttattaacgtacgacccgacccgacgaacgtaaccgaccgggtccgttacgttacgtttacgtcgttcggacggaagtaaggtacggttacggtttacgttttaacggaccgtagtaccgttaacgttaaaaacctccgttaaacgtacgttacgtacggtacgtccggtacggggacccgtacgggtaaccgtaacgg

SEQ ID NO: 247115 - DNA, 682 bp, Homo sapiens
  misc_feature: GYAE6OF02GRM26.9.70.G04.1.454.CMB.1.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagtgatacgtctcacgaccggtgctcgatttagtgtagtgtgaagggaaagggccgtgtgaaggcttcactagtcctggacctcctgtgcaagaacatgaaacatctgtggttcatcctctcctggtgcagctccagatgggtcctgtcccaggtgcggctgcaggagtcgggcccaggactagtgaagccttcacaggccctcgtcctcacctgcactgtcntgtnactccatcagnggtgtcgttcagtgacctgactcggcaggtccgcgcaagggactgggatactagttcggaagtatctagtcgccgtacgggtgggaaccctcctaatacctaacccgaaccccgttaccctgaaaacggtggtacccgtaagtccaaggcctatccgtaacncggtaccgaaacncccgtacccgaacgtaaacccgtacgttcccgtacccgttacgtaacgtacggttagtaacggttaagtttaacgccggtacccgacccggacctaccggaacggtacccggtacggttacgtaacgtttaccgtagtccggtagggtaacgaaaccggtcggtaaccgttttacggtttaaccggacttacggtacttaaacgttaaacctccgttaacgtacgttacgacgtcggttaccgaccgggacggtacgggacctacgg

SEQ ID NO: 247116 - DNA, 546 bp, Homo sapiens
  misc_feature: GYAE6OF02FZRZD.9.70.G04.1.454.CMB.1.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (395)..(395): a, c, t, g, unknown or other
  misc_feature (395)..(395): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctgggagtatattggacgaatctatgccagtgggaccncatctacaacccgtcctnaagagtcgagtcagcatgtcagtcacacgtccagaccagttcctcctnacagtgagttatatcgaccgccgcacgaccgaccggccgtagtacttactgtgcgagagacggtccgtttagttttacggaccagtacttaagttaaaacctccgtaacttacggtcgtacggacgttcgtgggccgacggggactaacgg

SEQ ID NO: 247117 - DNA, 620 bp, Homo sapiens
  misc_feature: GYAE6OF02JHU8O.9.70.G04.1.454.CMB.1.raw
  modified_base (170)..(170): a, c, t, g, unknown or other
  misc_feature (170)..(170): n is a, c, g, or t
  modified_base (349)..(349): a, c, t, g, unknown or other
  misc_feature (349)..(349): n is a, c, g, or t
  modified_base (398)..(398): a, c, t, g, unknown or other
  misc_feature (398)..(398): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctcccagatgggtcctgtcccaggtgcggctgcaggngtcgggccaggactagtgaagccttcacacggccctgtccctacacctgcacctgtctctggtcgactccaatccagaggttggtcctttccgtaacgttggaaccttgggactccggcagtcccgccggcaagggtcttaggatatagttggacgtaattcgatcgccaggtcggacncctaatcgtaccaaccggtcctcgaagtagtccgagtcaagctatgacngtaccgaccacgaccagacctgttcncctagacagtcgtatnacgtcgacccgtcgactacggactaccggacgttagttacgttacctggtacggacggaacggtacgtacggttaccgtttaagtttaacgggcctaaggttcctaaacgttaagggtacctaacggttaccgtacgttcggtacggtcgtacggggaccgttaagggacccgttaaggg

SEQ ID NO: 247118 - DNA, 574 bp, Homo sapiens
  misc_feature: GYAE6OF02F7G9Q.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccgacagtccgccggcaagggactggagtatattggacgaatctatgccagtgggaccgccatctaccaacccggtccctacgaagacgtcgagtcagctatgtcagtcgacacgtacccagaaccctagttcctcccgtcgacacgtgtagttatagttcgaccgtccgcacgacgaccggccgtgtacttacgtgtgcgagaggacggtacgttagtttacggactagtacgtacgttaaactaccgttacgttacgtacgtacggtacgttacggtgggtaccggtacgggacctaacggg

SEQ ID NO: 247119 - DNA, 623 bp, Homo sapiens
  misc_feature: GYAE6OF02GA65H.9.70.G04.1.454.CMB.1.raw
  modified_base (335)..(335): a, c, t, g, unknown or other
  misc_feature (335)..(335): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgctcatcagaggtgtcgttcctacgtggacctggactccggcagtcccgcggacaagggctggagtatagttgggactaatctatgaccgaggtcgggacccnctatcctaaccaacccgtcctacgaagcgtacgagtcagcagtcgtacgacggtaccgacgtaccgtcccaacgaacctacgttcctccctagactagtagtagttatagtacgaccgtccgacacgaccgacggtaccgtgtacgttacgtggtacgacggaacgtaacggacggttacgtttaagtttacggaccgtagtacgttaacgttaaaaccttccgttaaccgttacggttcgttacggtacggttaccggtacggggaccggtacgggacgtaaccggg

SEQ ID NO: 247120 - DNA, 644 bp, Homo sapiens
  misc_feature: GYAE6OF02FMI45.9.70.G04.1.454.CMB.1.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (339)..(339): a, c, t, g, unknown or other
  misc_feature (339)..(339): n is a, c, g, or t
  modified_base (498)..(498): a, c, t, g, unknown or other
  misc_feature (498)..(498): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagnggtcgtcgttccactggacctggactccggctacgtcccgccggacgaagggctggagtatagtggacgtaatctatcgcctaggtcgggacccnctacgtacctaacccgaacccgtccctagaacgtacgtcggaatccgaagacagttcgtaccgagtaccgaacctaccggtacccgaacgtaaaccctcgtttacccctccccgttagaacctaggttacgtaagttacttacggtaccgacccggccnccgtaacgaccgtaccgggtccgttagttaacgtttctacgggagtacgacggtaggaccgtacgttttagttacgactacgtacgtttaacgtaaacctctaacgtaggtcgttggaccgtggtcgggacggacgggtactacgg

SEQ ID NO: 247121 - DNA, 661 bp, Homo sapiens
  misc_feature: GYAE6OF02G3JVP.9.70.G04.1.454.CMB.1.raw
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggttggtccgttcctacgtcggacctggactccggcacgtccgccggnaagggctggatatagttggacgatctatgaccaggtcggaccnctactcctaaccaaccccgtcctacgaacgtacgtcgaagtcaggtcagtcgtacctaggtccgaacgtaccgtacccaacgtacctacgttcctacccgtacgacgtacggtagtagttactacgtacgacccggtccgacgaacgaccgacccggtccgttacgttaactttaccgtggtcgacgaggaacggtacggtacgtttaagtttaccggacctagtaccgttaacgtttaaaacccttccgttaaccgttaccggttcgtacgggtaccggtttaccggacgggggtacccggtaacggggtaacccgtaaccggg

SEQ ID NO: 247122 - DNA, 691 bp, Homo sapiens
  misc_feature: GYAE6OF02FOIAG.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcgaggtaggttcggtccgttcctacgtcggaccgtggactccggcacgtcccggccggacgaacgggctgggagtatagttcggacgtaatcgtatcggccgtaggtcgggaccaccgtactcctaaccgaccccgtccacgaacgtacgtcgacgtcgagctagtcgacgacgtccgaaccgaccgtaccccgaaaggtaccctacgtttccctacccgtaagtaccgtaggttacggtaacttatacggttacgaccccggtcgacgtacgaccggtccgggtaccgttaagttacttcggtggtacgacgaagggtacggtaccggttacgttttaagttaccggacgtacgtaccgtttaaacggttaaaccctttcccgtaacgtttaccggtggtaacggtcggttaccgggacggggtaacccgacgggtaaccgtaaccggg

SEQ ID NO: 247123 - DNA, 579 bp, Homo sapiens
  misc_feature: GYAE6OF02HBMGV.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcacggtcccgccggcgaagggctgggatatagtggaacgatctatcgccaggtcggaccgccatcctaaccaaccccgttcctacgaagtacgtcgagtcagcatgcagtcgacacgtccagaaccagttcctccctagactgtagtagttatagtacgaccgccgacacgaccaccggtcgttagtacttacgtgtcgacgagacggtacggtaccgtttagtttacggaccgagtacgttaagttaaaccttctaaccgtacggtacgtcggacgtcgtcggggaccgtaggggacctaacgg

SEQ ID NO: 247124 - DNA, 631 bp, Homo sapiens
  misc_feature: GYAE6OF02FL9IY.9.70.G04.1.454.CMB.1.raw
  modified_base (331)..(331): a, c, t, g, unknown or other
  misc_feature (331)..(331): n is a, c, g, or t
  modified_base (427)..(427): a, c, t, g, unknown or other
  misc_feature (427)..(427): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcagtcccgccggcgaagggactggagtatattggacgaatctatgccagtgggaccnccatcctacaaccccgtccctacaaacgtcgtcgtagtcgaagcacgtgtcagtcgaaccaccgtacccagtaacccgagttcctaccctagaccnggtacgtagttaatacgtcgaccgtccggcacgaacacgggccgttagtagttacgtgtagcgagacggtaggtccgttttaagtttaccggaccgtacgtacgtttaacgttaaaacccgttccgttaacccgttaacgggttccgttgggtaaccgttccgggttaccgggggaccggtacgggggtaacccgtaacccggg

SEQ ID NO: 247125 - DNA, 722 bp, Homo sapiens
  misc_feature: GYAE6OF02HTIHX.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgccactgtcctcgtggtcacctccatcaggtaggttggttccgttcctacgtcggacctggactccggcgtacgtcccggccggacgaaggggtacctgggtaacgttagttacgttgggaaccgtaattctaagtcgccgtagggtcgggacccacctaacttaccgtaacccgtaacccccgttcccgtaacgaaacggtcggttaccggacgttaccgaagtcctaagttcggtaccgacggtaccgaaccgtaacccgtacccgaacgtaaccctacgtttccctacccgtaggaaccgtacggtaggtaagtttaacgtacgtacggacccgccgacgaacggaccgaccgggtccgttagttacttacgtgtacgacgagtaacggtacggttaccgtttagttaccggaccgtagtaacgttaacgttaaacctccgttaacgttacggtcgtacggtaccggttccggtacggggaccgacgggtaccgtaacgg

SEQ ID NO: 247126 - DNA, 592 bp, Homo sapiens
  misc_feature: GYAE6OF02JF2UF.9.70.G04.1.454.CMB.1.raw
  modified_base (334)..(334): a, c, t, g, unknown or other
  misc_feature (334)..(334): n is a, c, g, or t
  modified_base (390)..(390): a, c, t, g, unknown or other
  misc_feature (390)..(390): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcttcctactggacctggactccggcaggtcccgccggcaagggctggaagtatagttggacgaatctatgccaggtcgggaccnccatcctaaccaacccgtccctagaagtcgtcgagtcagcagtcgtcagtccgacnccgtacccacgaaccctacgttcctccctacgactaggttacgtagttatacgtcgacccgccgacgagaccgaccggcgttagtattacgtgtcgacgagaggacggtacgtttagtttacgaccgtagtactaacgttaaacctccgtaacgtacggtctcggtacgtccggtacgggaccggtacgggaccgtaacggg

SEQ ID NO: 247127 - DNA, 770 bp, Homo sapiens
  misc_feature: GYAE6OF02IS4V0.9.70.G04.1.454.CMB.1.raw
  modified_base (233)..(233): a, c, t, g, unknown or other
  misc_feature (233)..(233): n is a, c, g, or t
  modified_base (577)..(577): a, c, t, g, unknown or other
  misc_feature (577)..(577): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctacgtcggacctggactccggcacggtcccggccggacgaagggactgggacttagtagttgggaactaatctaagtgcccgaggttcggggacccgtcctaagtcctaacccgaacccccggttccctacgaaacggcgtacgaagttccgaacgtctaatcggtaccgaacggtccgacctaccgtaccccgaacgtaaaccgtacgtttacccgtccctaggtaaccgaggttacgtaacgttttaacgtacgtacggtaccccgaccgtccgaaacggacccgtaccggggtacctttacggttaactttttaccgnggttaccggacgggaagtaacggggtaccggtttaaccggttttaacgtttttaaccgggaccgtaaggttacccgtttaaaacggtttaaaaaccccttccgttaaaacccggtttccgggttaaccttacggggtaaccggttccgggtaacgggggtaccccggtaacgggggtaacccgttaaccgggg

SEQ ID NO: 247128 - DNA, 653 bp, Homo sapiens
  misc_feature: GYAE6OF02GY74P.9.70.G04.1.454.CMB.1.raw
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagtaggtggtccttcctactggacctggactccggcaggtcccgccggcaagggctgggagttatagttggaacgtaatctaatgaccaggtcggaccncacgtctaccgaaccccgtccacgaagngtcgagtcacggctagtgacctagtaccgacaccgtacccaacgtaaccctacggttcctacccgttagaacgacgttaggtaacgttacttacgtcggacccgccggactacgacgtaccgggtccgtagttaacgttacgttacgtcgacggacggtacggtacggttccgtttaagttttaccggaccttaaggtccgtttaacggttaaaaccttccgttaaccgttacggttcgtacgggtacggttccggtacgggccggacggggtaccgtaacggg

SEQ ID NO: 247129 - DNA, 632 bp, Homo sapiens
  misc_feature: GYAE6OF02H4W3S.9.70.G04.1.454.CMB.1.raw
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
  modified_base (337)..(337): a, c, t, g, unknown or other
  misc_feature (337)..(337): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactcatcagaggtgtcttcctagtggacctggactccggcacggtccgccggnaaagggtctgggattatagttggaacgtaatctatcgccaggtcgggaccncctatacctaccgaccccgtcctacgaaggacgtcgtagtcgaagtctaagttcgtaccaggtccgaaccgtaaccgtcccaaacggtaacccttagtttcccctacccgtaggaactaggttacgtaagtttaacgtacgtcggtacccgccgtacaacgaccgaccgggtccgttagtactttacgtagtcgacgagacggacggttacgtttagttacgacctagtacttaacgttaaacctctaacgttacgtcgtacggtacgtacggcgggacgtacgggactaaccgg

SEQ ID NO: 247130 - DNA, 681 bp, Homo sapiens
  misc_feature: GYAE6OF02H5ZLD.9.70.G04.1.454.CMB.1.raw
  modified_base (170)..(170): a, c, t, g, unknown or other
  misc_feature (170)..(170): n is a, c, g, or t
  modified_base (234)..(234): a, c, t, g, unknown or other
  misc_feature (234)..(234): n is a, c, g, or t
  modified_base (366)..(366): a, c, t, g, unknown or other
  misc_feature (366)..(366): n is a, c, g, or t
tcagtgatacgtctcacgaccggtgctcgatttagtgtagtgtgaagggaaagggcctgtgaaggcttcactagtcctggacctctgtgcaagaacatgaaacatctgtggttcatcctcctcctggtggcagctcccagatgggtcctgtcccaggtgcggctgcaggngtcgggcccaggactagtgaagccttcacaggccctgtccctcacctgcactgtctctagggtnacctcatcagaggttgtcttcctagtcggcctggactccggcacggtccggccggacgaaaaggggcctaagggattaaagttagttacgggaacgtaaattcgtagtcggaccctaagggtcggggacccncctaatccctaaacctaccccgttcccagaaaggcgtcgtaagtccaaggctatggccgagtcgtaaccgtaccgtccgaacgaaacctacgttcctcccgtagaacctaggtagaacgtttacaagttccgacccgccggaccgtaacgaacgaccgggtaccgttagttaacttacgtgtcgacggaagacgggaacggttaccggtttagtttaacggacgtaggtaccgttaaagttaaaaccttcgtaaacgtttaccggtacgttacgggtacgtccggtacggggaccgtacgggtaaccgtaaccgg

SEQ ID NO: 247131 - DNA, 702 bp, Homo sapiens
  misc_feature: GYAE6OF02IIE6W.9.70.G04.1.454.CMB.1.raw
  modified_base (233)..(233): a, c, t, g, unknown or other
  misc_feature (233)..(233): n is a, c, g, or t
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctatggacctggactccggcagtcccgcggacaaggggtctggatagtagtggaacgatctagtcgcagtcgggaccnccatctacacccgtcctanaagcgtcgagtcagcagtcgtacncggtaccgacctaccgtacccgaacgtaaacccgtacgtttaccctacccgtaggtaaccgtacggttaggtaacgttttaactacgttaccggaccccggtacccgaccgaacggtaaccgtacccgggtaccggttacggttaactttaccgtggttacggaccggtaaggtacgggtaacggttaccggtttttaagtttaaccgggaccgttaacggtaccgttaaacggtttaaaaaccttcccgttaacggttaccggttaccgttacgggtaccggttccggttaccggggtacccgtaccgggggtaaccctaaccggg

SEQ ID NO: 247132 - DNA, 938 bp, Homo sapiens
  misc_feature: GYAE6OF02GI7YU.9.70.G04.1.454.CMB.1.raw
  modified_base (217)..(217): a, c, t, g, unknown or other
  misc_feature (217)..(217): n is a, c, g, or t
tcagtgatacgtctcacgaccggtgctcgatttagtgtagtgtgaagggaagggcctgtgaaggcttcactagtcctggacctcctgtcgcaagaacatgaaacatctgtgttcatcctctcctggtggcagctcccagatgggtcctgtcccaggtgacggtctgcgtagggagtcgggcccaggactagtgacgccttcacaggccctgtccctnacctgcactgtctcgtggtcgacttccatcgagtacggtggtccgttccgtacgtcggtaccctaggaccgttccggaccgtacggttcccccggacccgggtaccgtaaaacggggggtaccttacgggggtaaccggtttaagttaacgggtttccggggaaacccgtaaacggttaccgttaaacgtcccgggtaccccggtaaccggggttaccgggggaaccccctaccggtaaaccgtttacccggtaaaccccgtaaacccccgggtttcccctaaccggtaaacgggttaacgggttaaccccgggtaaaggttcccgaaacgggtaccgtaaggttaccgggttacccgaaacgggttacccgtaaccggtaccccggttaaccccgaaaaccggttaaccccgtaacgggttttaccccgtaccccggttacggtaaccgtaacgggttaccgttaaccggttaacttaaacccggttacccggaacccggtacccgtaacgtaaccgggtaacccgtaccgggtaccccgttaggttaaccgttaccgtcgggttaaccgcggtaaacgtacgggtaccggtttacccgtttaaggtttacccggaccgttacgtaccgtttaaacggtaaaccctttcccggtaaccgttaccggtaccgtcgggtacccgtttcgggacgggtaacccgtaggggacccttaaccggg

SEQ ID NO: 247133 - DNA, 730 bp, Homo sapiens
  misc_feature: GYAE6OF02F3CZY.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgtggctgcaggagtcgggcccaggactagtgaagccttcacaggccctgtccctcacctgcacttgtctcgtggtcgactccatcgaggtacggtggttccgttcctacgtcggtaccgtggactccggccacggtccggccggacgaagggactaggagttataggttacggacgtaatcgtatcggaccgtaggtcgggacccgctaacgttccgtaacctaaccccgtccctacgaagtacgttacggacgtcacgactagtcggtacaggtaccgacgtacccgtacccgaacgtaaccctacgttccctcccgtacgtaccgtaagggttagtaacgtttaactacgtaccggtaccccggaccgtaccgaaaccgacccgtaccgggtcccgttagttactttaccgttggacggtacggaaggacggttacggttacggttttacgtttaaccggaccgttacgtaccgtttaaacggtttaaaacccttccggttaaccgtaccggttaccgtacgggtaccgttaccggtacgggacccggtaacgggtacccgtaacccgg

SEQ ID NO: 247134 - DNA, 790 bp, Homo sapiens
  misc_feature: GYAE6OF02IY2HH.9.70.G04.1.454.CMB.1.raw
  modified_base (226)..(226): a, c, t, g, unknown or other
  misc_feature (226)..(226): n is a, c, g, or t
tcagtgatacgtctcacgaccggtgctcgatttagtgtagtgtgaagggaaagggcctgtgaaggcttcactagtcctggaccctcctgtgcaagaacatgaaacatctgtggttcatcctcctcctggtggcagctcccagatgggtcctgtcccaggtgcggctgcgaggagtccgggccaggactagtgagtccttcgacgacggccctgtccctcacctgcnctgtctcgtggtagacctccatcaggacggttcggttccgttaccgttaccgttcggacccgttggtaccgttcccggccgtaccggtcccggccgggacgaacggggtccttagggaattagttaggttacgggaacctaagttccgtaagtcgaccgtacggtcgggacccgtctacttacctaacccgtaccccggttcctacgaaaggtcgtacgacgtaccaacgtactaacgtttcgtacgtacggtccgtaacgtacccgtacccgaaccggtaaccgttacgtttccctacccgtacggttaacgtacggttacggttaagttacgttacggtaccgacccgtaccggtaccgaacggtacccggtaccgggtaccggttaggttaaccgtttcgtaggtcggtacgggaacgtacggtacgggtttaacgtttacgtttaccggaccgtacggtaacgtttaaccggtttaaaacccttccgttaaccggttccggttaccgttacggtacccggttccgggtaccggggtaccggtacgggtacgttaaccggg

SEQ ID NO: 247135 - DNA, 635 bp, Homo sapiens
  misc_feature: GYAE6OF02HMKZA.9.70.G04.1.454.CMB.1.raw
  modified_base (366)..(366): a, c, t, g, unknown or other
  misc_feature (366)..(366): n is a, c, g, or t
  modified_base (509)..(509): a, c, t, g, unknown or other
  misc_feature (509)..(509): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcgagtaggtggtcgttcctactggacctggactccggcagtccgccggacaagggactggagttatagttggaacgaattcgtatcggaccaggtcgggacccgcatcctaccaaccccgtcctanaagcgtcgagtcagcagttcgctagtccgaccaccgtacccaacgtaaccctacgttccctacccgtacgaaccgtagtacgtaagtttataacgttcggaccccgaccgcaacggaccgaccgggtccttaggtacttacgngttacgacgtagaggtacggtaccgttttaagttacggacctagtacttaaacgttaaaaccctccgttaacgttcggtactacgggtacgtccggtcggggaccgtaccggggaacctaaccggg

SEQ ID NO: 247136 - DNA, 606 bp, Homo sapiens
  misc_feature: GYAE6OF02FKTLE.9.70.G04.1.454.CMB.1.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagnggtgtcttccactggacctggactccggnacgtccgcggacgaagggctggagtatagttggacgaatctatcgccaggtcgggaccnctatcctaaccaacccgtcctacgaagcgtcgagtcagactatcgtcagtccgaacgtaccgtcccaacgaaccctacgttcctccctagactaggtataagttatacgtacgacccgccgacgacgacgacggtcgttagtacttacgtgtcgacgagacgtacggtacgtttacgttacggactagtacgttaaacgttaaaccttccgttaaccgttacggttcgtacggtaccggttacggtacggggaccgtacgggtacctaaccggg

SEQ ID NO: 247137 - DNA, 537 bp, Homo sapiens
  misc_feature: GYAE6OF02GR57O.9.70.G04.1.454.CMB.1.raw
  modified_base (233)..(233): a, c, t, g, unknown or other
  misc_feature (233)..(233): n is a, c, g, or t
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (433)..(433): a, c, t, g, unknown or other
  misc_feature (433)..(433): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggatccggcagtccgccggcaaaggggactggagtatattggacgaatctatgccagtggaccncatcctacaacccgtcctnaagngtcgagtcagcatgtcagtcgacacgtcccagaaccagttcctccctgacagtcgtagttatatacgaccgccgcagacnccggccgtgtacttactgtgcgagagaggtccgttagtttagaccagcttaagttaaactctaactacgtacgtcggtacgtcgtgggaccgagggacctacgg

SEQ ID NO: 247138 - DNA, 709 bp, Homo sapiens
  misc_feature: GYAE6OF02GAZ5C.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggtggtcgttcctactggacctggatccggcacgtcccgccggcaagggacctgggagtatagttggacgaatctatgccaggtcgggaccgccaatcctaaccgaaccccgttccctacaaacggacgttccggagttccaagccagttcgtacacggtccgaactacccgtccccgaagtaaccctaacggtttcctacccgtacggaaccgtacgttaggtaacgtttacgttacttacggacccgacccgaccgaacgtaccgaacccgggtcccgttagttaacgttaccgttacggttcggaccggtaacggtaacggacgggttaccgttttaagttttaacgggtacctagtaccgttaacggtttaaaaaccttcccgttaaccgttaccggttaccgttacgggaccggtttaccggtaccgggggaccggtaacggggaacccgttaaccggg

SEQ ID NO: 247139 - DNA, 645 bp, Homo sapiens
  misc_feature: GYAE6OF02FG2GP.9.70.G04.1.454.CMB.1.raw
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgtcctactggacctggactccggcacgtcccgccggcgaacggactggagtatagttggacaatctancgccaggtcgggacccnccgatcctaaccaaccccgtccctacgaagtacggtcgagtcgacgtctaacgtgtaccgaacgttccgaacctaccgtaccccaacgaacccgtcgttccctacccctgacctaaggtagtaagttacttagtacgacccgtccgcaacgaccgaccggtccgtagtacgttactggtcgacggtagacgtacggtccgtttaggtttacgacctacgtacgttaaacgtaaaaccttccgttaaccggttaccggtacgtacgggtccggttaccggtggggacccgtacggggtaccctaaccggg

SEQ ID NO: 247140 - DNA, 888 bp, Homo sapiens
  misc_feature: GYAE6OF02HEQNW.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcacaggccctgtccctcacctgcactgtctctggtcgacctcatcaggaggttcggttcgttcctacgtcggacctggactcccggctacggtcccggccgggacaacggggacctggggtaagttacgttagtttacggggaaaccgtaattacgttacgtcggacccgtaagggttccgggggaacccctacctaacgttaccccgtaaacccgtaaccccccggttaccccgttaacgaaacggtccggttaccggaacgttaccgaacggtacctaacgtttccggtaccgaacgggttacccgaacccgtaaccccggttaccccaaacggttaaaaccccgttccggttttacccccttccccggttaacggtaaccgttaacgggttaccggttaaacgttttaaaccgttaacggttacccggtaaaccccggtcccgtaaccggaacgtaaaccccggtacccggggttaaccgtttaccggtttaaacctttccggttacgggtacggaaccggtaaaggggtaacgggttaacccgggtttaaccgttttaaggtttaacccgggaccttaacggttacccgttaaacgtttaaaacccgttcccgttaaacggttaccgggttaccgtacgggtaccggttcggtaccggggacccggtacggggtacccgtaacggg

SEQ ID NO: 247141 - DNA, 626 bp, Homo sapiens
  misc_feature: GYAE6OF02FLQGL.9.70.G04.1.454.CMB.1.raw
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtcgacctcatcgaggtaggtcgtcgttcctacgtggacctggactccgcacgtccgccgcgaaggctggatatagtggacaatctancgacaggtcggaccncctatcctaaccaccccgtcctacgaagtcgtcgagtcagctagttcgtcaggtccgaccaccgtacccgaagaaccctacgttacctcccgtacgacgtagtaggtaacgttatacgtcgacccgtcgaccgaacgaccgtaccggccgttagtaacttcgtaggtacgcgtagacggtacggttccgtttaacgtttacggacctacgtacgttaacgttaaaccttccgttaccgttacggtcgttacggtacggtccggtacgggacccggacgggtaccgtaacggg

SEQ ID NO: 247142 - DNA, 786 bp, Homo sapiens
  misc_feature: GYAE6OF02JXZTY.9.70.G04.1.454.CMB.1.raw
  modified_base (171)..(171): a, c, t, g, unknown or other
  misc_feature (171)..(171): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggngtccgggcccaggactagtgaagccttcacaggcccttcgtcccctcacctggcactgtctctggtcgactccatcgagtacggtcggtcttacctactcggacctggactccggcagtcccgcgggcaagggactcggatactagttacggacgtaacttcgtatcggacctagggtacggggaccccgtaccattccccgttaaaccgaacccccggttcccctaacgaaaggtaccgttaccggtagtcccgaagtacagttaccgtccgtaacgtacccgtaaccacccgttaccccgaaacgtaacccgaacggttttcccctaccccgttaggtaaccgtaacggttcggttaaacgttttattaaccggttaccgggaaccccgtacggaacccgacggaaccggcccgggtacccttaacgttacttaccggtcgttaggaccggttacggaacggttacgggtaaccgtttaacggtttaccggaccctacggttaccgttaaaaccggtttaaaacccgttccgttaaaccggttaccgggttcttacgggtacccggtttaccgggtaccggggaccggttacgggtaaccccggttaaccggg

SEQ ID NO: 247143 - DNA, 750 bp, Homo sapiens
  misc_feature: GYAE6OF02I3EE3.9.70.G04.1.454.CMB.1.raw
  modified_base (170)..(170): a, c, t, g, unknown or other
  misc_feature (170)..(170): n is a, c, g, or t
  modified_base (278)..(278): a, c, t, g, unknown or other
  misc_feature (278)..(278): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtccaggtgcggctgcaggngtcgggccaggactagtgaagccttcacaggtccctgtccctcacctgcactgtctctggtcactccatcagtaggtgtcgttcctacgtcggacctggaatcccggnagtcccgcggtacaaagggtctagggacttatagttacggaacgtaactctacgtcgtaccgaggtagggtaccctcctatacctaaccgtaacccgtccgtaactaacggcgttacggagtccgaacggtactaacgtgtcctaaggtacctaacgtaacccggtaccgtaacgtaacccgtaacgtttcccgtcccgtaacgtaccgtacggtacgtaacggttaacgttaacgtaacgtaccccggtaccgtaccgtaaaccggtaccgaaccggtaccgttaccggttacgttaacggtcgtacgtccggtaacggtaacggtacggttaccggtttaacgtttacggtaccgtaacggtaaccgtttaacgtttaaaaccgttcccgttaaaccgttaccggttaccgttacgggtaccggttaccggttaccggggaaccggttaccgggacccgttaaacccggg

SEQ ID NO: 247144 - DNA, 676 bp, Homo sapiens
  misc_feature: GYAE6OF02IPK1I.9.70.G04.1.454.CMB.1.raw
  modified_base (372)..(372): a, c, t, g, unknown or other
  misc_feature (372)..(372): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcgctgcaggagtccggccaggactagtgaagccttcacacggccctgtccctcacctgctactgtctctggtcgacctccatcgacgtaggtcggttccgttcctacggtcggacccgtggacctccggcacggtcccgaccgaacgaagggacgtgggaagttagttagttcgggaacgtaattacgtacgtcgacgtaggtcgggacccncacttaccaccctaaccccgtcctacgaagtacgtacgacgttcacgactagttcgtacacggtaccacccgaccgtaccccgaagtaaaccctcggttccctacccggtagaacccgtagggttacgaatttacgacttaccggacccggtcaccgacgaccgtacccgggtcttagttattccggtggtacgacggtaacgcgtaacggttacgtttaggttaccactacgtacttaaacgttaacctcccgttagtaccggtcgtacggtacgttcggacgggaccggtacgacgtaccgg

SEQ ID NO: 247145 - DNA, 577 bp, Homo sapiens
  misc_feature: GYAE6OF02HFP7U.9.70.G04.1.454.CMB.1.raw
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcagaggtgtcttcctactggacctggactccggcagtccgccggcaagggactgggagtatagttggacgaatcgtatgccaggtcgggaccncatcctacaaccccgtcctacaagcgtcgagtcagcatcgtcacgtacacacgtcccaagaaccctagttcctccctagacagtcgaagttatagtcgaccgccgacacgaccgaccggtcgtacgttacttacgtgtgacgagacgacggtcgtttaagttacgactagtacgtaacgttaaacctcgttaacctacggtctacggtacgtccggtacgggaccgtacgggtaccgtaacgg

SEQ ID NO: 247146 - DNA, 817 bp, Homo sapiens
  misc_feature: GYAE6OF02HBI1Y.9.70.G04.1.454.CMB.1.raw
  modified_base (171)..(171): a, c, t, g, unknown or other
  misc_feature (171)..(171): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggngtcgggcccaggactagtgaagccttcacacggccctgtccctcacctgcactgtcctctggtgacctccgatcgagtaggtggttaccgttcctacgtcggacctcggactcccggctacggtcccggcccggacgaaggggtcctagggacgttataggttcggaacgtaactcgttaatcggtacccaggttcgggaccccgtcctaagtcccttaaaccgaaccccccggttccctaacgaaacggtacggtaccggtaacgtccgaacgtccgtaagttcgtacccgtacgggttacccgaacccgtaacccgtaccccaaacgtaaacccgttaacgtttccccttaccccgtgtaaccgtaaggttacggtaaagtttaactacgttaccgggaacccgtcccggtaaccgtacgaaccggtaccgggtacccgttacggttaactttaccggtcgtacggtacgggtaacgtaacgggttaccggttaaccggtttttaacggtttaaccggtaccgtacggttaaccgtttaacgtttaaaaaccgttcccgttaaaccggttaccggtttaccgtacgggttacccggttaccggttaccggggggacccggtacggggtaaccccgttaaccggg

SEQ ID NO: 247147 - DNA, 691 bp, Homo sapiens
  misc_feature: GYAE6OF02GFRM9.9.70.G04.1.454.CMB.1.raw
  modified_base (294)..(294): a, c, t, g, unknown or other
  misc_feature (294)..(294): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcaccctgccacttcgtctctggtcgacttccatcagtacggtgtcgttcctactggacctgatccggcacgtcccgccggngaaaggtctagggagtattagttgggaacctaaattctaagtcgaccgtaggttacggaccccgcctatacctaacccgaaaccccggttcctaacgaaaggtaccgttcggagttccgaaggtcctagttcggttaccgaaggtccccaacgtaccccggtcccaacgtaaaccgtacgtttaccctcccgtagaaccgtagtacgtaagttaactacgtaccgtcccgcgaccgacgaccgtaccgggccgttagtaacgttacgtacgttcggacgaagacggtaggtaccgtttaagggttaccgtacgtacgtaacgtaactttaaaaccgtccgttaaacgttcgttacgtggtaccgttcgggtccgggtacggaccgggtacgaaccgg

SEQ ID NO: 247148 - DNA, 818 bp, Homo sapiens
  misc_feature: GYAE6OF02JAKUQ.9.70.G04.1.454.CMB.1.raw
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctcgtcccaggtgcggctgcaggagtcgggcccaggactagtgacgtcctcacacggccctcgtccctcacctgcactgtctcgtggtacgactcccatcagtaggtcggttcgttaccgtactggacctggactccggggctacggttcccggccgggacggaagggaccgttagggagttaagtacgttcggaacgtaacttcgtagtcgaccgtaacgggttcgggacccgcctacttccaaacccgtaccccgtccctacgtaaacgcgttacgggaacgtcgtaaacggctaaccgttggaccgtaacgggtaccgtaccccaaaccgggttaaccccgaaaccgttaaaccccgttaacggtttcccccgtaccctaacgggtacctacggggttaagtaaccgtttaacgtacggtaccgaccccggtacccggaacttacgggaaccccggtaacccgggcccgggtttaaagttccggttttaacctggggtacggaccgttaaaggaccggggtacggttaccgtttaaggtttaacccggacgttaaccgtacggttaaaccggttaaaacccttaccggttaaccccgttgggttacccgtagggtttcccggacggttacccgggggacccggtaaacgggaccccgttaaacggg

SEQ ID NO: 247149 - DNA, 556 bp, Homo sapiens
  misc_feature: GYAE6OF02GLANV.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcacgtccgccggcgaagggactggagtatattggacgaatctatcgcagtcgggaccgccatctaccacccgtccctcaagagtcgacgtcagcagtgttcacgtcgactacgtcccacgaacctacgttcctccctgacagtgtagtatatgaccgcgcgacgacacggtccgtgtacttacgtgtcgcgagacgaggtacgttatttaggacacgtcgttaacgtaaaccttcctacgtacgtcgtacggtacggtcgtcgggacggacggacgtaacgg

SEQ ID NO: 247150 - DNA, 1013 bp, Homo sapiens
  misc_feature: GYAE6OF02HKNQG.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgacctccatcaggtagggttcggttccgttcctacgtcggacccttgggacttcccgggctacggtcccggcccgggacgaaacggggtacctgggaagttacttacggttacgggaaccgaattccgttaagtcggacccgtaaggggttcggggacccctaccgtaattaccccgtaaacccgtaaacccccccggtttccccttaacgaaaacgggtacgggtttaccgggtaacggttaccgaacggtccctaaaggtttccgggtaaccctaacggggtttaccccgaaacccgtaaccccgggttaacccccgtaaaccgggtaaaaccccgtttaaccggtttttacccccgttaccccccgttaacggtaacccgtaaacgggtttacggttaaccggttttaaacgttaaccggtttaacccgggaaccccgggtacccccgtaaccggtaaacccgggaaaccccgggtaaccccggggttacccggtttacggttttaaaccgtttacccggttagggtttaccgggaaccggggttaacgggaaacggggttaccgggtttaaccccggtttttaaaggtttttaacccgggaacccgttaacgggtttaacccggttttaaaaccggttttaaaaacccgttcccggttttaaacccggtttaacccgggtttaacccggtttaccgggggttaacccggttacccggggtttaacccggggggtaccccggggttaaccggggggtaaccccgttaaacccggggg

SEQ ID NO: 247151 - DNA, 722 bp, Homo sapiens
  misc_feature: GYAE6OF02GKWSX.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgtggctgcaggaggtccgggcccaggactagtagaacgtccttcacgacggcccctgtcccctcacctgcacctgtccttgtggtcacctccatcgaaggtacgggttcggttccgtttccgtaacgtcgggaaccctgggaccttcccggcgtacggtcccggaccgggacgtaaacggggacttagggaattattagttacggaactaatctaagcgaccgtaggtcggaccctacgaactacctaaccctaaccccgtaccctaagaacgtacgtacggtacgtacagctaatcgtactaacggtccgaacctacccgtacccgaacgtaacctacgttccctcccgtacgactaggtacgtaacgttactaacgttccgaacccgccgtacgaacgaaccgtaccggtccgttaagttacttacgtgtacgacgtaaggacgtacggttaacgtttacgttaccgaacgttacgttaaccgttaaacgttaaaccttaccgttacgttaaccggttcgtacggtacggtcggtaacggaccggtacggaccgtaaccgg

SEQ ID NO: 247152 - DNA, 625 bp, Homo sapiens
  misc_feature: GYAE6OF02H8FS0.9.70.G04.1.454.CMB.1.raw
  modified_base (350)..(350): a, c, t, g, unknown or other
  misc_feature (350)..(350): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtcgggcccaggactagtgaagccttcacaggccctgtccctcacctgcacttgtctctggtgactcatcagaggtggttcgttcctacgtggacctggactccggctacgtccggccggagtaacggggctgggaagttatacgttggaacgtaatctagtcgacctaggtcgggaccnctatcctaaccgaaccccgtccctagaagtgtcgagtcagctatgtcagtcaacctacgtaccacgaacctacgtttcctcccgtgtaacgagttagtaagtttatacgtcggtacccgccgacgacgaccgacggtccgttagttactttacgtggtcgcgtaagcggtacggtaccgttttaagttaccggactacggttaaccttaacgttaaaaccttcctaacgttacgtcgtcggtacgtcggtacgggaccgtacgggacgtaaccgg

SEQ ID NO: 247153 - DNA, 613 bp, Homo sapiens
  misc_feature: GYAE6OF02IUJF1.9.70.G04.1.454.CMB.1.raw
  modified_base (262)..(262): a, c, t, g, unknown or other
  misc_feature (262)..(262): n is a, c, g, or t
  modified_base (339)..(339): a, c, t, g, unknown or other
  misc_feature (339)..(339): n is a, c, g, or t
  modified_base (396)..(396): a, c, t, g, unknown or other
  misc_feature (396)..(396): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgagccttcacaggcctgtccctcacctgcactgtctctggtcgacctccatcgagtaggtcggtcttcctacncggtactggactcggcacgtccgacggtcaagggctggagtatagttggaactaatctatcgacgaggtcgggaccncctagtacctaccgaacccgtcaacgtaagacgtccgagtacacgctagtcgtccgngtaccgacacgtacccacggaacctacgttccctacctacgaactaggttagtacttactaagtccgtacccgacgtacaacgacgtacggtccgttaagtacttacgcgtggacgtagacggacgtacgtttaagtttaccgggactaggtactaacgttaaacctcgtaacgttacggtgacgttcggtaccgtacggggcacgggtactaacgg

SEQ ID NO: 247154 - DNA, 656 bp, Homo sapiens
  misc_feature: GYAE6OF02HDDDJ.9.70.G04.1.454.CMB.1.raw
  modified_base (358)..(358): a, c, t, g, unknown or other
  misc_feature (358)..(358): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggagtccgggcccaggactagtgaacgccttcacgacggccctgtccctcacctgctactcgtctcgtggtcactccatcgaggaggtcgtcgttcctacgtcggacctggactccggcgtacgtccgcggacgaagggactaggagtagtagtacggaactaatactagtcgacgtaggtcgggaccnccagtacctaaccgtaaccccgtcgtaacaacggtcgtcgaacgtcacggctagtctcgagtacgactaccgtaccaacggacctacgttacccctcgtagaacgtgtagtaacgttactaacgtaccggaccgaccgaagtaaccggaaccgtacccgggtacttaacgttaacgttcgtggtacggaaccgtaggacggttacggttcgtttaacgtaccgacttaacgtaccgttaaaattaaacctccgtacggtagtccgtacggtcgtcggacgggacgacggtaccgtacg

SEQ ID NO: 247155 - DNA, 563 bp, Homo sapiens
  misc_feature: GYAE6OF02FWLTI.9.70.G04.1.454.CMB.1.raw
  modified_base (328)..(328): a, c, t, g, unknown or other
  misc_feature (328)..(328): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccncatctacaacccgtccctacaagagtcgagtcagcatgtcagtccgacaccgtccagaaccagttcctccctgactagtgagttatattgaccgccgcagaccacggccgtgtattacgtgtgcgagagacggtcgtttagtttacggacctagcgttaacgttaaaacctccgttaacttacggttcgttacggaccgttcggtacggggacccgtacgggggaccctaacggg

SEQ ID NO: 247156 - DNA, 574 bp, Homo sapiens
  misc_feature: GYAE6OF02GD6E8.9.70.G04.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgtggctgcaggagtcgggcccaggactagtgaagccttcacaggccctgtccctcacctgcactgtctctggtgactccatcagaggtggtcgttcctactggacctggatccggcagtccgccggcaagggctggatatattggacgaatctatgccaggtcgggaccncatcctaccaacccgtccctacaagcgtcgagtcagcagttcgtacagtccgaactaccgtacccgacgaaccctagttcctacccgtcgacgacgtgtagttatagttacgaccgccgcgacgacgaccggccgtagtacttacgtgtgacgagaggacggtcgttagtttacggacagtacgttaagttaaaacctcctaacgttacgtcgtaggacgtcgtacgggcgacgggacgtaacgg

SEQ ID NO: 247157 - DNA, 741 bp, Homo sapiens
  misc_feature: GYAE6OF02H63ZH.9.70.G04.1.454.CMB.1.raw
tcagtgatacgtctcacgaccggtgctcgatttagtgtagtgtgaagggaaaggcatgtgaaggcttcactagtcctggacctcctgtgcaagaacatgaaacatctgtggttcatcctcctcctggtggcagcctcccagagtgggtcctgtcccaggtgcggctgcgaggagtcgggcccaggactaggtgaacgtccctttacacgacggcccctgtccctcacctgcctactgtctacgtggtcgactccataccgaggtagggttcggtcccgttcctacgtaggtaccgtggactccggtcacggtcccggaccggacgaaagggcgttagggaacgttatacgttaggaacgaattcgtagtcgaccgagggtcggaccctacacttaccgtaaacccgaaccccgttcctagaaagtaccgtacgacgtacgacgtaccaagttcgtacacgtaccgaacgtaccgtacccaacgtaaacctacgttcctacctagactacggtagtaacgttaacgtactacgaccgtaccgacgaacggaaccgccgggtaaccgttacggttactttacgtcggtacgacggtaagtacggtaccgggttaccggttttaagtttacccgggaccgtaacggtaaccgtttaaacggttaaaacccttacccgttaacgttaaccgggttcggtaccggtacggttaccgggtacggggtacccggaacgggtaacccgg

SEQ ID NO: 247158 - DNA, 572 bp, Homo sapiens
  misc_feature: GYAE6OF02FQ0BI.9.70.G04.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctgggatatattggacgaatctatgccagtcgggaccnccatctaccaacccgtccctcgaagagtcgagtcagcatgtcagtcgacaccgtccagaacctagttcctccctgactagtgtagttatattagaccgccgcgagaccaccggccgtgtattactgtgcgaagagtacggtcgtttagttacgaccgagtacgttaagttaaaaccttcccgtaacgttaccggtacgttacggtaccggttccgtacggggcgtacggggacccgtaacggg

SEQ ID NO: 247159 - DNA, 637 bp, Homo sapiens
  misc_feature: GYAE6OF02HRUD7.9.70.G04.1.454.CMB.1.raw
  modified_base (407)..(407): a, c, t, g, unknown or other
  misc_feature (407)..(407): n is a, c, g, or t
  modified_base (455)..(455): a, c, t, g, unknown or other
  misc_feature (455)..(455): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtcgactccatcagaggtggtcgttcctacgtggacctggactccggcacggtccgccggacaagggactgggagttattagttgggaacgtaattctagtcgaccgaggtcgggaccgccattaccgtaaccaaccccgtccctacgaaaggtcgtacgtacgtcacgctatgtcncgtacgacaccgtaccaacgtaacctcgtttcctaccgtgactaggtntaagtttcacgttacgacccgcgtacaacgaccgtagggaccgttagttacttacgtggtacggacgaaggtacggtacggtaccgttttagttacggaccgtagttacttaaacggttaaaccctccgttaacgttacgttgtacggtacgtccgggtgggaacccggagggacctaacgg

SEQ ID NO: 247160 - DNA, 849 bp, Homo sapiens
  misc_feature: GYAE6OF02HBXKG.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcgctgcaggagtcggcccaggactagtgaacgccttcacacggccctgtccctcacctgcactgtctcgtggtcgactccatcgagaggttcggtcgttcctacgtcggacctggactccgacacgtcccgccggacaacggggtactgggagttatagttggaacgaattctagtcgccgtaggtcgggaaccgcctaattcctaaccgaaccccgttcctacgaaggtacgtaccgtagttaccagctaacgttcgtacgaacgttaccgacccgtaaccgtacccgaaccggtaaacccttaccgtttaccccgttaccccgtacggtaaccgtaacggtacggttaacgtttaacgttaaccgttaaccgggaccccggtaccccggacgtaaaccgggtaacccgggtaacccgggttacccggttaacggtttaaccggttttaaccgttccggggttaacgggtaccgggtaaagggttaaccgggttaccgggtttaacccggttttaaagggttttaaccgggtaacccgttaacggtttaacccggtttaaaaccgttttaaaaaccgttccccgtttaaacccgggttaacccgggtttaccggttaacggggttaccggtttaacccggggtaaccgggggtaccccgggttaacgggggtaacccgttaaccgggg

SEQ ID NO: 247161 - DNA, 537 bp, Homo sapiens
  misc_feature: GYAE6OF02FT1ZC.9.70.G04.1.454.CMB.1.raw
  modified_base (244)..(244): a, c, t, g, unknown or other
  misc_feature (244)..(244): n is a, c, g, or t
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagnggtgtcgtcctactggacctggatccggcagtccgccggcaagggacctggagtatagttggacgaatctatgccagtgggaccgcatcctacaacccgtcccacaagcgtcgagtcagcatcgtcngtcacaccgtccagaaccacgttctccctgactagtgagttatagtcgacccggccganacgacgaccggccgttgtattaccgtgtgcgagagacgtcgtttatttagcagctaagttaaacctccgtactcgtcgtggtcgtccgtgggccagggacctaacgg

SEQ ID NO: 247162 - DNA, 702 bp, Homo sapiens
  misc_feature: GYAE6OF02GFE4I.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgctactgtctcgtggtgactccatcagaggtgtcgttcctacgtggacctggactccggcacgtccgccggcgaggactggagtatagttaggacgtatactatcggccgaggtacggcccgtactacttaccgtacctaacccccgttccgtacaacggtggtacgtagtccggaataccgagttcgaccgtacgtaccgaaccgtacccgtaccgaaccgtaaaccgtcgttccctacccggtgaactagggttacgtaagttactacggtaccgccggccgacgtaacggccgttaccgggtcgtttacgttaaacgttcggtcgtaacggcggtaacgttacggttaccgggttttaaccgttttaacgtacggtaccctaagttaaccggtttaaaaccctaaacccgttcccgtaaccggttccggttacgggtcggtaacccgttgggacccggtagggacccggtaccgtaccgg

SEQ ID NO: 247163 - DNA, 740 bp, Homo sapiens
  misc_feature: GYAE6OF02FJMN6.9.70.G04.1.454.CMB.1.raw
tcagtgatacgtctcacgaccggtgctcgatttagtgtagtgtgaagggaaagggccgtgtgaaggcttcactagtcctggacctcctgtgcaagaacatgaaacatcctgtggttcatcctcctcctggtggcagctcccagatgggtcctgtcccaggtgcggctgcaggagtcgggcccaggactagtcgaagccttcaccaggccctgtccctcacctgcacctgtctctggtcgactccatcagtaggtggtcgttcctactggacctggacttccggcagtccgccggcaaggactggagtatagttggacgtaatctatcgccaggtcgggacctccgtatcctaaccgacccgtcctacgaaagcggtacgagttacgacgctaagtcggtacacgggtaccaaccgtaccgtacccgaaggaacccttacggttccccttcccgtacgacgtaaccggttgaacgtttaacttacgtcgaacccggtccgacgtaaccgtaccgtacccgggtccgtttacggtaactttaaccgtcggttacgaccgggtaaggaacgggtaccgggtttaccgttttaaacgttttacgggacccgtaaaggtccccgttttaaaagggttaaaaaccccttaccccgttaaacgtacccgggtttacggtacgggttaacccggttacccgggttaccgggggaccccggtaaggggggtaaccccttaaacccgggg

SEQ ID NO: 247164 - DNA, 796 bp, Homo sapiens
  misc_feature: GYAE6OF02I17Q0.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacgacggccctcgtccctcacctgcacttgtctcgtggtacgactccatccgaggtacggttcggttccgttcctacgtcggtaccgtacggtacgtccggactaccggtcccggtaccgggacgaaaacggggtaccggttagggtaacgttaagtttaacggttacgggaaaccggtaaacgttaccgttaacttcggaaccggtacgggtacggggacccctacccgacgttacctaaccccggtaaacccccgttcccctaaaccggtaaacggaccggttacggaacgtcgaacgtactacgtcgtacgacgtccgaactaccgtacccaaggtaacctacgtttaccaccctacgaacgtgttaacggacgttaattacgtacgtacccgaccgtacgaaccgacggtaccggtaccgttaacgttacgttactggtacgacggtaagtagtaaaccggtttcgtttaacgttaccgtacccgtaagttccgttaaaacggtttaaacccgtaccgtttaaacccgtacggttaccgtacggtaaccggttccggtaacggggaccgggtaccggggtaaccttaacccgg

SEQ ID NO: 247165 - DNA, 793 bp, Homo sapiens
  misc_feature: GYAE6OF02IIBS5.9.70.G04.1.454.CMB.1.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctgatggcagcctcccagatgggtcctgtcccaggtgcggctgcaggagtccggcccaggacgtagtgaagtccttcgacaggcccttcgtcccncacctgctacctgttctcgtgngtacctccattcaggtaggtcggttaccgttccgtaaccgtggaccttagggacgtcccggactacggtcccggcccggtaacgaacggggtacccttgggtaaacgttacgttagtaacgggtaaactaaccgtttctaacggtcgcccgtaaggggtaccggacccgaccgttaacttccgtaaaccccgtaaccccgttcccttaagaaaacggtcgttacccgaacggttacaacggtacctaacggttgtaaccgtacggttcccgaaaccgtaccgttacccggaaacgtaaccgttacgttcccgtaccgtaagacgtaacggtacgtaagttacgttacgtacgtacccgccgacgtaaccgacgtaccgggtcgttagttaccgtacgtcggtacggtacggtaacggtacggtacggtttcgtttaacgtttacgggaacccgttacgtaaccgttaacggttaaaaccttccgttaaacgtacccgggttcaaccggggttccgttacggaaccgggggtacccgtaacgggtaacccgg

SEQ ID NO: 247166 - DNA, 710 bp, Homo sapiens
  misc_feature: GYAE6OF02J0GFF.9.70.G04.1.454.CMB.1.raw
  modified_base (649)..(649): a, c, t, g, unknown or other
  misc_feature (649)..(649): n is a, c, g, or t
  modified_base (687)..(687): a, c, t, g, unknown or other
  misc_feature (687)..(687): n is a, c, g, or t
tcagtgatacgtctcacgaccggtgctcgatttagtgtagtgtgaagggaaagggaccgtgtgaaggcttcactagtcctggacctcctgtgcaagaacatgaaacatctgtggttcatcctcctcctggtggcagctacccagatgggtcctgtccaggtgcggctgcaggagtcgggcccaggactagtgaagccttcacacggccctgtcccctacacctgcactcgtcttctgggtcactccaatctaggaggttcggtccgtttaccgtacgtcggaccctgggtacgtccggccgtaacggtcccggaccgggccggaaacgggacgttgggaacgttagttaagttcgggaaccgtaatttacgtacgtcgacccgaggttacggggaacccctcgtacttaccgtaacccgaaaccccgttcccgaaccgaaggtacgttcggacgtacacggcgaatcgttacacggtaccgacctaaccgtacccaagtaacccctagttcccgccctagtaaccaggtacgtaagttactaggtccgaacccgtcgacaacgtacgaccgggtctacggtattacgtgtagacggagacgtacgggttctttaaggttacgcgtacttaacgtaaccgtttaaaaccnccggttattaaccggtgtttaacgggcgtttaccgggngggacccggaggtacctaaccgg

SEQ ID NO: 247167 - DNA, 872 bp, Homo sapiens
  misc_feature: GYAE6OF02IZUG6.9.70.G04.1.454.CMB.1.raw
tcagtgatacgtctcacgaccggtgctcgatttagtgtagtgtgaagggaaagggcctcgtgaaggcttcactagtcctggacctcctggtagcaagaacactgaaacatctgtggttcatcctcctcctgggtcggcacgctccccagaatcgggtcctgtcccaaggtgcggctgcaggagtcgggcccaggactagtgaagtccttcacagggtcccttgtccctcacctcgcactgtctcgtgtcgctccatcgaggtggtcgttcgttacccagtcggtaccgtggtactcccggagtaccggtccccggaccgggacgaacggggtaccgttagggtaacggttatacggtttacgggaaccgttaagttccggttaatccggaccgtaacgggttaccggggacccctaccctaaacggtttacccctaaaacccccgtaacccccccgttttacccgtaaaccggaaaacggggttccggttaccgggtaacggttaccgaaccgggtacccttaaggttaccggggttaccctaaacggggtttaccccggaaacccggtttaaccccggttaccccggaaaccggtaaaaccccggttaccgtttaaccccgttaccccgttaccgaaaccggttaggttaacggttaacgtttaaccgttaacgtaaccggtaccccggtacccgaccgtaaccggtaccgtaccgggtccgttaacggttactttacgtacgtcggtaacgagtaacggtaccggttactttacgttacggactacgtacgttaacgttaaaccgtccgttaacgtaccggttgtaacggtccggttacggtaccgggaccggtaacgggactaaccggg

SEQ ID NO: 247168 - DNA, 742 bp, Homo sapiens
  misc_feature: GYAE6OF02JGZY2.9.70.G04.1.454.CMB.1.raw
tcagtgatacgtctcacgaccggtgctcgatttagtgtagtgtgaaggggaaagggcctgtgaaggcttcactagtcctggacctcctgtgcaagaacatgaaacatctgtggttcatcctcctctggtggcagctcccagtgtcggtcctgtcccaggtgcggctgcgaggacgtccgggcccaaggtacctagtggaacgtccttcacgacggtccctcgtaccctcaccgtgcgtactcgtctcgttggtcactccatcgaggtcggttggttccttacctacgtggacctggactccggcacggtcccggcggacgtacggacgtggagtactagtcggaactagtctagtcgccgtaggcggacctcctagtaccctaccgacccgtttccgaacgtaagtacgttacgacgtacaggtactacgtcgtaccgtaacggtccgaactaccggtaacccctaaccggtaaacttccgttaccgtaccgtagaacccgttagtctaacgttactacggaccacgggtcccaacgaccgtaaaccggtccgggtacttggttaaacttcggtacgggtacgacgggtaaccgttaagggacccgggttttaactttaacgggttaacggcctaacggtaagttttaaacccgtaaaccgtttccgtaacggtttacggtaccggttaacgggtaccgggttacgggtaccgggacgggtttaacggaacccctttacggg

SEQ ID NO: 247169 - DNA, 703 bp, Homo sapiens
  misc_feature: GYAE6OF02JTNDB.9.70.G04.1.454.CMB.1.raw
  modified_base (283)..(283): a, c, t, g, unknown or other
  misc_feature (283)..(283): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcgacctgcactgtctcgtggtgactccatcgagacggtcggtcgttacctacgtggacctggactccggntacggtccgccgacgaagggctgggagtacttagtcggaacgtaactctagtacggccgtaagggtcgggaccccgtaccaacgtttccgaacccaaaccccggttccctacaaaagggtccggttaccggacgttaccgacggactaacgttcgtaacgtacgtaccggtaaccgtacccgtacccgaaacgtaaccctacgttaccctcccgtagaaccgtagtcgttaacttacgtaatacgtacccgaccgacgtacgaaccgtaccgggtccgttacggttacgttacgtagttccggacgtaggaacggtacggtaccgtttaacgtttaccggaccgtgtaaccgttaactaaaccgttctaccggtacgtcgtcggtacgttaccggcgggtaccgacgggtaccgtaacgg

SEQ ID NO: 247170 - DNA, 744 bp, Homo sapiens
  misc_feature: GYAE6OF02HWQZ3.9.70.G04.1.454.CMB.1.raw
  modified_base (388)..(388): a, c, t, g, unknown or other
  misc_feature (388)..(388): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtagaacgtccttacacgacggcccctcgtcccctcacctgccactcgtctcgtggtcgacctccatcaggtaggtcggttccgttacctacgtcggaccgtggactccggcctaggtcccgccggacgaacggggtacctagggaattagttaaggttacgggaactaacttcgtatcgaccgtaagggtcgggacccncctaatacctaacccgtaaccccgtccctaagaaacggacgtcgtaagtcaacggctaagttcggtactacggtaccgaccgtaacccgtacccaacggtaaacccttcgtttaccacccgttagaaccgtagtacgtaagttacacgtacgacccgcgacgaacgaccgtaccggtacgttacgttaacgtacgtgggtacgacgaacggtacggtaacggtttaaccgtttaaggtttaccggaaaccctggtttaaaccgtaaacgtttaaaccctaccgttaaccgttacggttacgtacgggttaccggtaccgggttccgggaaccggtacgggtaaccgtaaccccggg

SEQ ID NO: 247171 - DNA, 835 bp, Homo sapiens
  misc_feature: GYAE6OF02GVI1U.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtcctctgtcactccatcagtaggtcggttccttcctacgtcggaccgtggacgttcccggactacggtccccggccggacgaaacggggtacctagggtagttaacttagtttacgggaacggtaaacttccgttaagtcggaccctaagggttcgggaaccccgtaccgtacttaccgtaaacccgaaacccccgttcccctaacgaaacgttacggtaccgtaacgtaccgaagaccgtagttaccgtacgtacgtacccggtaacctacccgtacccgaaactaacccgttacgtttcccctaccgtaacgaacctaggttacgttaacttacgtaacgtccgtaccccggtacgaaccgaacgtacccggacgggttaccgttaagttacgtttacggtcggtaccggaacgtaacgggtaaggttaaccccggtttaacgttttaacgtttaaacccgggacttaacccgtttaacgttttaaaaccggtttaaacccctacgggttttaaacccgttacccgggtttacgttaacccgggtttcccgggttaacggggtacccccggggaacgggttaaacccggggaccccgtttaaacccggg

SEQ ID NO: 247172 - DNA, 566 bp, Homo sapiens
  misc_feature: GYAE6OF02IV5ZW.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtgactccatcagaggtggtccgttcctacgtggacctggatccggcagtccgccggcaagggctgggagtatagttggacgaatctatgaccaggtggaccgcatctacaacccgtcctacaagcgtcgactcagcatgtcagtcgactacgtcccacgtaaccacttctccctcacagtagtagttatatcgaccgccgtacacgacaccggcgtgtattacgtgtgcgagagacggtacgtttagtttacgacgacgtacgtacgttaaaacctccttaacgtacggtacgtacggtacggtcgtacggggtaccgtacggggaccgtaacgg

SEQ ID NO: 247173 - DNA, 1002 bp, Homo sapiens
  misc_feature: GYAE6OF02IBY28.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatcgggtcctgtcccaggtcgcggctgcgaggagtccgggcccaaggctaagtgaagccttcacacggccctgtcccctcaccctgcctacttcggtccttcgtcgggtcaacctccaatcgaaggtagggttacggggttcccttttaccgtaaccgttaccggggaccccttagggggtaaccgtttccccgggaccgtaacgggtttccccccgggacccggggaaacccggaaaaggggggttaacccttaggggggtaaatttaaacggttttaaaggttttaacggggaaaaccccgttaaattttacccggtttaagttccgggtaccccgtaaaggggggttacccggggtaacccccgaccccttaaacgtttacccgttaaaaaccccgaaacccccccggtttcccctaaacgtaaaaagggtccgtttacccgggaaacgtttccgaaaggttcccgtaaagtttcccgggtaaccgttaacggtttaaccccgggaaaccccgtaacccgggtttacccccgaaaacccggttaaaccccgttaacggttttacccccgttaccccgttaacggtaaaccgttaacgggttaagtttaaacggtttaacgttaaaccggttaccggaaccccggtacccgtaccgtaaccggaacccggtaaccgggtaccgtttacggttaacgtttacgttcggtacggaacggaacggtacggtacggttaaccgttttaacgtttaaccggacgtacgttaaccgtaaacgtttaaaaccgttaccgtaaacgttaccggttacgtacggttacggtacggttaccggggacggtaaccggggtaccgtaaccgg

SEQ ID NO: 247174 - DNA, 781 bp, Homo sapiens
  misc_feature: GYAE6OF02GAY5N.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtacccaggtgcggctgcaggagtcgggcccaggactagtgaagtccttcacacggccctgtccctcacctgcactgtctcgtggtcactccatcaggaggtcgtcttcctacgtggacctggactccggactacggtcccggaccggacgaaaggggtaccgtagggtaacgttaagttaggttacgggaacgtaaattccgttaagtcggaccggtaagggtccggggaacccctaccgtaacttacccgtaaaccccgtaacccccgttcccgtaacgtaaaacggcggttaacgagtaccgaagtacctaagttccggtacaggttacccgaaacccttaccggtaccccgtaaacggtaaccccgttacgtttaccccgtcccgtacgtaacgtaggttaacgttaagttaacgtacgttaccggaacccgccgtacgaacgaccgccgggtaccgttagttaacgtttacgtcggtacggacggtaaggacggtacggttaacggttttaacgtttacggaccgtagttaccgttaaacgttaaaaccttccgtaaccggttacggttaccgtacgggtaccggttaccgggtacggggaccggtacggggaacccgtaaccggg

SEQ ID NO: 247175 - DNA, 718 bp, Homo sapiens
  misc_feature: GYAE6OF02G600E.9.70.G04.1.454.CMB.1.raw
  modified_base (354)..(354): a, c, t, g, unknown or other
  misc_feature (354)..(354): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcactccatcagaggtggtcttcctagtggacctggactccggcacggtccgccggacaaggggtactgggaacgttattaggttacggacgtaatcgtaagtcgaccgtaggtcgggacccncacgttcctaaccgaaccccgtcctacaaaggcgtcgaacgttcagtcaagttcgtcgacgtccgaacctaccgtcccaacgtaacctacgtttccctacccgtagaacgtagtacggtaacgtttactaacgttacccggacccgtacccggaacgtaccggaaccgtaccgggttaccgttacggttaacgtttaccgtaggtccggaacggtaacggtacggtacggttaccgttttaagttaccgggacctacggttaaccgtttaaacggttaaaccttaccgttaaccggttaccggttacgtacgggttacggttaccgggtacggggtaccgtaaccgggggtaacctaacccggg

SEQ ID NO: 247176 - DNA, 610 bp, Homo sapiens
  misc_feature: GYAE6OF02GOHA6.9.70.G04.1.454.CMB.1.raw
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccagggactagtgaagccttnacnggcctgtccctcacctgcactgtctctggtnctccatcagnggtgtcgttccactggacctggatcggcagttcgccggnaagggctggagtatagttggactaanctatcgcngtgggaccgcatctacaacccgtccctanaagtcacggtatcagcagtcgacnggtaccgacaccgtccaagaacctagttccctcctgaacaggtgtagtatactcgacccgcgtaccagaccgacggtcccgtagttacttacgtcgtgcgacgaggaacggttccgtttaagttttaacgggacctaacggaccgttttaaacggtaaaacctttacccgttaacggtaacggtttcctaagggacccggttccggttacggggaccgtacgggggtaacccgtaaccggg

SEQ ID NO: 247177 - DNA, 767 bp, Homo sapiens
  misc_feature: GYAE6OF02HCX6J.9.70.G04.1.454.CMB.1.raw
  modified_base (364)..(364): a, c, t, g, unknown or other
  misc_feature (364)..(364): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacaggccctgtccctcacctgcactgtctctggtcactccatcgagtaggtgtccgttcctacgtcggacctggactcgtggctacggtccgccggacgaaagggcgtagggacgttaatagttacgggacgtaatccgtagtcgaccgtaggtaccgggacccnccgtaagttacctaacccgtaaccccgtccctacgaacgtacgtacgagtacagctagtcggtacacgtaccgaccgaccgtacccgaagaaacccgtacgtttccctacccgtagaaccgtacggtagtaagttaacttacggtaccggtacccggaccgtaccgtaaccgaacccggtaccgggtacccggttaacggtttaacttaccgttaggtaccggacggtaaacggtacggtaaccgggtttacccggttttaagtttaacccgggaaccgtaaccgttaaccggtttaaacccgttaaaacccgttacccgtttaaacccgggttaaccggttaccggttaccgggtacccgggtttaccgggtaccggggaccggtaaccgggggtaaccccg

SEQ ID NO: 247178 - DNA, 785 bp, Homo sapiens
  misc_feature: GYAE6OF02H5LR0.9.70.G04.1.454.CMB.1.raw
  modified_base (171)..(171): a, c, t, g, unknown or other
  misc_feature (171)..(171): n is a, c, g, or t
tcagtgatacgtctcacgaccggtgctcgatttagtgtagtgtgaagggaaagggcctgtgaaggcttcactagtcctggacctctgtgcaagaacatgaaacatctgtggttcatcctcctctggtggcagctcccagatgggtcctcgtccaggtgcggctgcgtaggnggtccgggcccaggacttaggtagaacgtccttcacgcgggtccccttcggtcccctcacccgtgactaccttcgttctcgtcggtcgacttccatcgaaggtggttacgttccgttacccgtagtacggtaccgtaggtaccgttccggacgtacggtcccggaccggtacggaaagggtaccgtagggtaacttaagttacggttacggaacgttaactcgtacgtccggacgtacggtaccgggaccctacctacgtacctaaccgaaccccgttccctaaggtaaacggtccgttacggtaacgtaccaacggttccgtaattccggtccgaacggttcccgaaaccgtacccgtacccgtaaacgtacccgttacgttacccgtacccgtagtacgtacgttacgtaagttacctagtacccgaccgtacacgtaacgtaacggtaccgggtacttacgttaacgttacgtcggtacggacggttacggacggtacggtaccgtttaagttaacggaccttaggtaccgttaacgttaaacccttcggtaaccgttacggtacgtacggttacggtccggtacgggaaccgtacggggacctaaccggg

SEQ ID NO: 247179 - DNA, 823 bp, Homo sapiens
  misc_feature: GYAE6OF02H3TQX.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggacttagtgaagccttcacaggccctagtccctcacctgccacttgtctctagggtctacctcctatcaggtacggtcggttcctttcctacgtcggtacctgggactccggacacggttcccgccggcgaaacggggctcgggagttactaggttacggagtaacttcacgttcggacctaagggttcgggaacccctctaaccgtttacccgtaaacccgtaaacccccggtttccctaacgtaaacgggtacggtttacgggaacgttaccgacgggtaacctaacgttcggttacgaaccgtttacccgggaccgttaacccggtttaccccgaaaccggtaaacccgttaccgggtttaaccccttacccgttacgggtaaaccgtacggttaaccggttaaagggttttaacttaaccgttaaccggtaaccccgggtacccgtacggaaaccggtaaccgtacccgggtaccggttaacgttaacgttaaccgttagggtacggtaccgtaacggtagggttaccggttaccgttttacggtttaacgacgtacgtaacttaacggttaaaaccttcgttaaccgttacggtacgtcgtacggtcggtacgggtaccggtacgggacctaacgg

SEQ ID NO: 247180 - DNA, 581 bp, Homo sapiens
  misc_feature: GYAE6OF02I63PK.9.70.G04.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaagccttcacaggccctgtccctcacctgcactgtctctggtnacctcatcaggnggttcggtccgttcctacgtcggacctggactccggcacgtccgccggcgaagggctggagtatagttggacaattcagtcgccgagtcgggcctaccatacctaccaaccccgtccctacaacgacgtaccgagtcagctatcgtcagtccgactaccgtaccacgaactacgtcctcctagactagtagtagttatagtcgaccgcgccacgaccgacggtccgtagtacttacgtgtcgacgagacgaggttcctttagttcgacagtactaacgttaaactccgtaacgtacgtacgtcggtacgtcggtacgggacgtacgggacgtaccgg

SEQ ID NO: 247181 - DNA, 619 bp, Homo sapiens
  misc_feature: GYAE6OF02I5LWW.9.70.G04.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
  modified_base (332)..(332): a, c, t, g, unknown or other
  misc_feature (332)..(332): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctnacctgcactgtctctggtnctccatcagaggtgtcgttctatggactggactccggnacgtccgccggacaaggggtctggagtatagtcggaactaatctatcgccaggtcggaccnctatacctaaccgaaccccgtcctacgaaagtcgtcgagtcaggtcagtcgtcagtccgactaccgtccgaacgaacctacgttcctccgtagacgtagtagtacgttatacgtacgaccgaccgcgaacgaccgacggtccgttagtacttacgtcgtacgacgacgacggtacggtaccgttttaagtttacggaccgtagttaccgttaacgttaaaacctccgttaacgttacggttacgtcggtacgtccggtacggggtaccgtacgggtacctaaccggg

SEQ ID NO: 247182 - DNA, 681 bp, Homo sapiens
  misc_feature: GYAE6OF02GMXE3.9.70.G04.1.454.CMB.1.raw
  modified_base (234)..(234): a, c, t, g, unknown or other
  misc_feature (234)..(234): n is a, c, g, or t
  modified_base (285)..(285): a, c, t, g, unknown or other
  misc_feature (285)..(285): n is a, c, g, or t
  modified_base (361)..(361): a, c, t, g, unknown or other
  misc_feature (361)..(361): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtncctccatcgaggaggttcggtccgttcctacgtcggacctggactccggcncggtccgccggacgaaggggcctagggagttattaggttacgggaacgtaatcctagcgccgtaggtcgggacccnctactcctaaccgaccccgtcctacgaacgacgtacgagtcaggtcagttcgtacacgtccacgtaccgtaccgaaacgtaacctacgtttccctacccgtagaccgtaacggttacgtaacgtttacgtacgttccgaccccggtaccgcgaaccgaccgtaccgggtaccgttagtttacgttacgtcgggtacggacgtaaggacgggttacggttaaccgttttaggtttacgaccgttagttaaccttaaacggttaaacctccgttaacgtacggttcgtaacggtcgtcgggaggccggtacgggacctacgg

SEQ ID NO: 247183 - DNA, 695 bp, Homo sapiens
  misc_feature: GYAE6OF02JFN6E.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacacggccctcgtcccctcacctcgccacgttgtcctctgggtcacctccatcgagaggtcggtcttcctacgtggacctggactccggcacgtccgccggacgaaggctggagtatagtggaacgtaatctatcgacctaggtcgggaccncactcacccaacccgtccctacaagtcggtacgacgtcgagcagttgtaccaggtaccacgtaccgtaccccaacgaaccgtacgttacccgtacccgtcgaaccgtacgttagtaacgtttaacgtacgttaacggaccccgaccggaccgtaacgaccgacgggtcccgttacgttaacgttaccgtgtacgtacggtaacgtaacgggtacggttaccgtttacgtttaacggtaccgtagtaccgttaaacggttaaaaccttcccgtaaacgttaccggtacgttacgggtaccgttacggtaccggggtaccggtaacccggggtaccgtaacccggg

SEQ ID NO: 247184 - DNA, 600 bp, Homo sapiens
  misc_feature: GYAE6OF02F3VB1.9.70.G04.1.454.CMB.1.raw
  modified_base (511)..(511): a, c, t, g, unknown or other
  misc_feature (511)..(511): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagtaggtgtcgttcctacgtggacctggactccggcacggtcccgccggacaagggctggagtatagtggacgtatctatcggaccaggtcggacctccatacctaacccaccccgtccctacgaaagtcgtacgtagtcagactagttcgtcgaggtccgaacctccgtacccaagaacccgagtacttcctaccagaccgtagtacgtaacttagtacgtcgacccgacgacgacgacgaccggtctagtacgttacgtgtcgacgnaggtacgttaccgttagtttacgacgtgtactaacgttaaactccttacgtacgttacgcggtaccgtcggtacgggtacgacggtacg

SEQ ID NO: 247185 - DNA, 695 bp, Homo sapiens
  misc_feature: GYAE6OF02FZRE1.9.70.G04.1.454.CMB.1.raw
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtgactccatcagaggtcggttcgttcctacgtggacctggactccggcacggtccgccggcaagggactgggatatagtaggactaatctatcgaccgaggtcgggaccnctatcctaaccaaccccgtccanaagcgtcgatcancatcgtacagtcactaccgtacccaacgtaaccgtacgttcctcccgtagaccgtagttacgtagttaagtacgtaccgacccggcccgacgaacggaaccgtaccgggtccgttagttaacctttcgttacgggtacgacgggaacggtaacggtacgggttaccgttttaagttttaccgggaccttaaggtaaccgttttaaacggttaaaaacccgtttccggttaaaccgtttaccggttaaccgttacgggttaccgggttaccgggttaaccgggggtcccggtaaccggggggtaacccgttaaccggg

SEQ ID NO: 247186 - DNA, 615 bp, Homo sapiens
  misc_feature: GYAE6OF02FI1UO.9.70.G04.1.454.CMB.1.raw
  modified_base (316)..(316): a, c, t, g, unknown or other
  misc_feature (316)..(316): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctcgcactgtctctggtgactccatcagaggtgtcgttcctactggacctggactccggcagtccgcggcaagggactggagtatagttggacaatctangccaggtcggaccgccatctaccacccgtccctcaagcgtcgatcagcatgtcagtcactacgtacccagaacctcgttcctccgtcgaccgacgttacgtaacgttatacttcggacccggtcccgacgaacgtaccgaccggtccggttagtacgtttacgttcgtcgacggacgaacggtacggttaccgttttagtttacggaccgtacgtaccgttaacttaaaaccgttccgttaaccgttacggtacgttacggacggttcggtagggcccggtacgggtacccgtaacggg

SEQ ID NO: 247187 - DNA, 712 bp, Homo sapiens
  misc_feature: GYAE6OF02FQ0KQ.9.70.G04.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatcgggtcctgtcccaggtgcggctgcaggagtcgggcccaggactagtgaagccttcacncggccctgtcccncacctgcactgtctctggtgacctccatcaggtaggttcggttccgttcctaacgtcggtaccgtggactccggctacggtccccgcggacgaaaggtcgtagggattagtagttaggacctaatctagtcgaccgtaggtcgggaccctcgtactccgtaacccacccggttccctacgaacgtacgtcgacgtacacgactacgtcgtaccgacggtccaaccgtacccgtaccaaacggtacctaggttacccccttaccgacgaacctacggtgtaaaccgttcttaacgtaccggaacccgcccgtagaccgaaccggtccggtaccgttagtaaccggttcgtcggtagtaccggtaacggtcggtacggttaaccgtttaaggttacgaccgtaactaccgtttaaaacgtttaaaccgcccgttaaccgtaggttaccgtcggtacccggttaacggaccgggggtacctaccggggtaccttaaccgg

SEQ ID NO: 247188 - DNA, 595 bp, Homo sapiens
  misc_feature: GYAE6OF02FUXZH.9.70.G04.1.454.CMB.1.raw
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
tcagtgatacgtctcacgaccggtgctcgatttagtgtagtgtgaagggaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcactccatcagnggtcgtcgttcctactggacctggactccggcagtccgcggcaagggctggatatattggacgtaatctatcgcaggtcggaccncatccaacacccgtcctanagctcgagtcagcatgtcgagtcgacncgtaccagactacgtctcctgactacgtagtacgtatacgtgaccgcgacacgaccgacggccgtagtacttacgtgtcgcgacgtagacggttaccgttagtttacggaccttacggtacgtttaaacgttaaaacccgttcccgtaaccgttacgggttaccgttacggtaccggttaccggtaccggggtacccggtaccgggggaccgtaacccggg

SEQ ID NO: 247189 - DNA, 932 bp, Homo sapiens
  misc_feature: GYAE6OF02IYU29.9.70.G04.1.454.CMB.1.raw
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
  modified_base (351)..(351): a, c, t, g, unknown or other
  misc_feature (351)..(351): n is a, c, g, or t
  modified_base (425)..(425): a, c, t, g, unknown or other
  misc_feature (425)..(425): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagagtgtcttctacnggacctggactccggcacgtcccgccggacaaggggactgggattatattaggggaacctaaatcctaagtcgaccgtaggtcggggaacccnccaattccgtaaaccgaacccccgttcctacgaaacgtacggttccgaaggtccaagtacctaagttcggtacncggtaacccgaccgtaccgtacccccgaaagtaaaccccgtaacgttttaccccgtaccccgttagtaaccgtaacgggttaacgtaaacggttttaacgttaacggttaacccgggaacccccggtacccggttaccgaaaccgggtaaacccggtaaacccggggttacccggtttaacggttttaaaccggttttaaacccggttagggttaaccgggtaaaccccggggtaaaggggttaaaacccgggggtaaacccggggttttaaccccgggtttttttaaaacgggtttttttaaccccgggggaaaacccccggttttaacggtaaaaccccggtttttaaaacgggtttttaaaaaaacccccgttaccccggttttaaaacccggtttaaacccggggtttacccggtttaacccggggttaacccgggtttacccggtttaacccggggggggaccccggttaaaaccgggggggtacccgttaaaaccccgggg

SEQ ID NO: 247190 - DNA, 635 bp, Homo sapiens
  misc_feature: GYAE6OF02GIADG.9.70.G04.1.454.CMB.1.raw
  modified_base (160)..(160): a, c, t, g, unknown or other
  misc_feature (160)..(160): n is a, c, g, or t
  modified_base (216)..(216): a, c, t, g, unknown or other
  misc_feature (216)..(216): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (468)..(468): a, c, t, g, unknown or other
  misc_feature (468)..(468): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtncggctgcaggagtcgggcccagggactagtgaagtccttcacaggccctgtccctnacctgcactgtctctggtcgacttccatcgagaggtggttccgttcgtactggacctggactaccggcacgtccgccggacgaagggactgggattactagttggacgtaatctatcggctaggtcgggaccnctatcctaccaccctccacgagngtcgagtcagcatgtacagtcgactacgtcccaacgtacctacgttcctcccgttacggactcggtagtaacggtttatagttcggaacccgccgngaaccggtaccaccggggtccgttaacgttacgttaccggtagtccggtaagtacgggaaggacggtttacgtttacgtttacggacgtacgtacgttaaacgttaaacgttccctacgttacggtcttacgggccggttagcggggacctaggggaccttaacggg

SEQ ID NO: 247191 - DNA, 750 bp, Homo sapiens
  misc_feature: GYAE6OF02H4S4N.9.70.G04.1.454.CMB.1.raw
  modified_base (198)..(198): a, c, t, g, unknown or other
  misc_feature (198)..(198): n is a, c, g, or t
  modified_base (439)..(439): a, c, t, g, unknown or other
  misc_feature (439)..(439): n is a, c, g, or t
tcagtgatacgtctcacgaccggtgctcgatttagtgtagtgtgaagggaaaggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgagccttcanacggcctcgtccctcactgcactgtctcgtaggtcgacctcatcgaggtaggttcgttccgttcctagtcgggacctgggtactccggactcgtcccggaccggagaacgggtactcgggaattagttaacggttggaaccgtaatctagtcggaccgtagggtacgggacccctacgaacttaccgtaaacccgttaaccccgtccctaacgaaggtaccgtacggtacgtacaaccggntaaacgttcacgtacgtacgaacccgtaccgttaacccaccgtaaacccgttacgttccctacccgtacgtaacgtacgtacgtaagttaacgtacgttaccggaccgtccgacgtaaccgacaccgggtaccgttacgttaacgttccgtacggtacggtacgaacgggtaacgtaccggttaccgttttaacgttacgggtacctacggttaacgttaaacgtttaaaccgtccgttaaccggttaccggtacgtaccgggtaacgttccgggttaacggggaccgtacggggtaacccgttaaccggg

SEQ ID NO: 247192 - DNA, 773 bp, Homo sapiens
  misc_feature: GYAE6OF02IQ1EL.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacgaggccctgtccctcacctgcactcgtctcgtggtcactcctagtcgaggtaggttcggttccgtttcctaacgtcggtaccgtggactcccggactacggtccccggaccggcgaaaacggggtcctgggtaacgttaattacggtttagggaacccgtaaatttccgtaacgtcggacccgtaagggttccggggaacccccgtactaacgttacccgtaaacccgaaaccccccggtttcccctaacgaaacggtaccggtccggaagttaccacggtacaacgttacggtaccacggttaccgaacccgtaccgtaccccgtaaacgtaaaccgtaccgtttcccgtacccgtacggaacgtaggttacgttaagtttaactacggttaccgacccggtccgacctaacgaccgtaccggtccgttagtacttacgtagcgacgaaggtacggtacggttaccgtttaagtttaccgggaccgtaggtacgttaaacgttaaaacccgttcctaacgttaccgttgtaccggtacgtccgggtacgggaccggtacgggaccgtaaccgg

SEQ ID NO: 247193 - DNA, 758 bp, Homo sapiens
  misc_feature: GYAE6OF02G2EG7.9.70.G04.1.454.CMB.1.raw
  modified_base (385)..(385): a, c, t, g, unknown or other
  misc_feature (385)..(385): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtcggcccaggactagtgaagccttcacacggccctgtccctcacctgcacttgtctcgtggtcgacctccatcaggagggttggtcttcctacgtggaccgtggactccggcacggtcccggccgggacgaaggggtacgtacgggaacgttaagtaggtttacgggaacgtaacgttcgttagtcggtacccgtaggggtccggggtaacccnccctaattcccgtaaacccctaaacccccgttccctaaagaaacggtcgttaccggacgttaccgaagtctaacgttcggtaccgagttaccgaacctaccgtacccgaacgtaacccgtacggtttccctacccgttacgaacgtggttacgtaacggtttataccgtcggaccccggtccaaccgtacggaccgtaccgggtccgttacgttacttacggtgtacgacgtaacggacggtacggttaccgtttttaagttacggacccttagtaccgtttaaaccgttaaaccgtcccgttaaacggttcggtacgttaccggtacggttccggacggggtacccggtaaccggggaacccggttaaccgg

SEQ ID NO: 247194 - DNA, 795 bp, Homo sapiens
  misc_feature: GYAE6OF02G440Q.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctcgtccctcacctgcactgtctcgtggtcgacctccatcaggaggtcggtccgtttcctacgtggaccttgggactcccgggactacggtccccggccggacgaaacggggacttggggaagttattagttacggggaaccgtaattccgttaagtcggaccgtagggttaccggggaccccgaccgtaacttacccgtaaccctaaaccccccggttcccctaacgaaaggtacggttaccggtaaagttccgaacggtctaacgttcggtaccacggttaccggaaccctacccggtaccccaaacgtaaacccctacggttttcccctacccgtagaaccgtaggttacgtaacgtttactaacgtaccggacccgaccggacgaacgacccgtacgggtcccgttagttaaccgtttcgtacgggtcgacggtaacggacggtaccgggttacgtttttaacggtttaccggaccgtaaggtaccgttaaaacgtttaaaaccgttccctttaaaccggtacggtttcccgttaggggttaccgttacgggtaccgggggaccggtaacggggtacctaaccggg

SEQ ID NO: 247195 - DNA, 661 bp, Homo sapiens
  misc_feature: GYAE6OF02GWI79.9.70.G04.1.454.CMB.1.raw
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgttgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtgacctccatcagtaggtggtcttcctactggacctggactccggcacgtccgcggcgaaggactggagtatagtggacgtatctagcgcaggtcggaccnctatcctaaccaaccccgtcctacgaagtacgtcgagtacagctatcgtacaggtccaacgtaccgtacccgaacgtaaccctacgtttaccctacccgtacggaacgtacggtacggttaacgttaagtacgttacggacccgtaccgcgtaaccggaccgtaccggtccggttagttacgtttaacgtcgtaggtacggaagtagggtacggttaccgtttaacgtttacggaccgtagtaccgttaacggttaaaaccttccgttaacgttacggttcgtacgggttacggtcggtccggggacggtacgggaccgtaaccggg

SEQ ID NO: 247196 - DNA, 886 bp, Homo sapiens
  misc_feature: GYAE6OF02HVTCG.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtcgacctccatcaggacggttcggttccgttcctacgtcggaccgtgggacttcccggctacggtccccggaccgggtacgaaacggggtacgtagggtaacggttaattaacgtttaggggaaacccgtaaatttccgttaaacgtccggacccgtaaacggggttcggggaacccccggtacctaaccgttacccgtaaaccccgtaaaccccccggtttcccctaacggtaaaacggtcggtaccggtaaacgtcaacggactaagttcgtacgacggttaccgaaccgtaccgtaccccgaacgtaaacccgtacgttttaccctaccccgtacgtaacctaaggttacgttaacggtttaactaaccggttccggaaccccggttacccggaccgaaacggaacccgtaccgggtaacccggttacgtttaacgtttaaccggtggtacggtaccgggaacggttaacgggtaaaccggttaccggtttttaaacgttttaccgggacccgtaaggttaacccggtttaaacggttttaaaaacccgttcccgtttaaaccggttaccgggtttaccggttacgggtacccggttacggggttacccgggggtaaccgggtaaccgggggtaacccgttaaacccgggg

SEQ ID NO: 247197 - DNA, 903 bp, Homo sapiens
  misc_feature: GYAE6OF02H8ZZI.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggacgtccgggcccaggactagtgaacgtccttcacgacggccctgtaccctcacctgctactcgtcctcgtggtcaaccgtcctacgtcgaggtacgggttcggttccgtttaccctaggttccggaccgtacgggtacgtccccggacgtaccggttacccggccgggtaaccgaaacggggtcgtacggggtaacgttagtttaacgggttacgggaacgttaactttaccgttaggtaccggtacccggttaagggtccggggaaccctaccgtactaacccggttaacccgaaacccccggtttaccctaacgaaaccgggtacggttaccggaacgttaccggtaacgaccgttaacgttccggtaccgttaaggttccccggaaaccgtaccccgggttacccgaaacccgttaaaaccccgtcgggttttaccccctacccgtaggaaccgttagggtttacgtaacggtttaaacgtccggtacccggaccccgtccgggtaacctacggaaccgggtaccggtttacccgtaggttttaaacttcccgtggggtaacccgtaacggtaagggtaaccggttcccggtttaacgttttaaagtaccggaccgttacggtttaacgttaaacccgttaaaacctttccggtaacggttacccggttaacgtacggttaccggggttcggaccgggggttaaccgaaccggggtacttaaccccggg

SEQ ID NO: 247198 - DNA, 596 bp, Homo sapiens
  misc_feature: GYAE6OF02I9KP7.9.70.G04.1.454.CMB.1.raw
  modified_base (335)..(335): a, c, t, g, unknown or other
  misc_feature (335)..(335): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcagtccgccggcaagggctgggagtatagttggacgtaatctatcgaccaggtcgggaccncaatcctaaccaaccccgtccctagaaacgcgtcgagtcagcagtcgtacagtccgactaccgtacccacgaacctagttcctccctagacgtagtagtagttatacgtacgacccgccgacgaacgaccaccgggtccgttagtacttacgtgtcgacgaagacggtacggtccgtttagtttacggacctagtacgttaacgttaaacctccttaacgtacggtactacggacgttcgtcgggacgacgggactaacgg

SEQ ID NO: 247199 - DNA, 708 bp, Homo sapiens
  misc_feature: GYAE6OF02IQC8R.9.70.G04.1.454.CMB.1.raw
  modified_base (369)..(369): a, c, t, g, unknown or other
  misc_feature (369)..(369): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccaagatgggtcctgtcccaggtgcggctgcaggagtcgggcccaggactagtgaagccttcacaggccctgtccctcacctgcactcgtctcgtggtgctccatcagaggtggttccgttcctacgtcgaccgtggactccggtcacggtccgccggacaaggggctgggagtatgttggaacgtatcgtatcgcgaggtcgggaccgcctactactacaaccccgtcctanaaggacgtcgacgtacagctagtcgtacacggtacgaccctacgtacccgacgtaaacccgtacgttcctcccgtacgtaccgagtacgtaagttagtaacttccggacccggtcccgaccgaacgaccgtaccggtccgttacgttacgtttacgtcgttacggaggtaacggtacgggtaacggttaccggttttaacgtttaaccgggtacccgtacggttaaccgtttaaccggttttaaaaaccgttcccgtttaaccgttaccgggtttaccggttacggtcccgggtttaccggtacgggggacccgggtacggggtaacccggtacccggg

SEQ ID NO: 247200 - DNA, 914 bp, Homo sapiens
  misc_feature: GYAE6OF02IBG5J.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctgggtcacctccatcgaggtaggttcggtccgtttcctacgtcggaccttggactcccgggctacggtcccggcccggacgaaacggggtcctagggaggttaattaagtttacggggaaccgtaaaatttcctaagttccggacccgtaaaggggttccgggggaaaccccctcctaacgttaacccgttaaaccaaaacccccccggtttccctaacgaaaaccggtaaaggtcccgggtaaacggttaccaaacggtcccgtaaagttcggttaccggaaacggtacccgggtaccctaacccggtaacccccgaaccggtaaacccgttaaccggtttcccctaacccccgtttaggaacccgtaacggtttaaggtaacggtttaaacttaccgttaccgggtaaccccgacccgtaacccggtaaacggaacccgtaacccgggtacccggttaacggtttaacgtttaaaccgttcggggtaccgtaaccgggaacggttaaccgggtaacggggtttaacccgttttaagttttaaccgggtaaccgttaaccgtaccggtttaaaacggtttaaaaaccctccccgtttaaacggttaacccggtttccggttaccgggtaaccggttccgggttaacggggggtacccgtaaccgggggtaacccgtaacccgggg

SEQ ID NO: 247201 - DNA, 708 bp, Homo sapiens
  misc_feature: GYAE6OF02FXBTN.9.70.G04.1.454.CMB.1.raw
  modified_base (235)..(235): a, c, t, g, unknown or other
  misc_feature (235)..(235): n is a, c, g, or t
  modified_base (432)..(432): a, c, t, g, unknown or other
  misc_feature (432)..(432): n is a, c, g, or t
  modified_base (464)..(464): a, c, t, g, unknown or other
  misc_feature (464)..(464): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcacacggccctgtccctcacctgcactgtctctggtnactccatcgagtaggtggttccgttctacgtgacctggactccggcagtccgccggcgaacgggactgggtaatacttagtggaacgaatcgtatcgacgaggtcgggaccgcctatccgtaaccacccgtcccagaagtcgtacgacgtcgagctaagcgtactaggtaccgacgtaccgtaccgactaacccgtnttccctacgttagactacggttgtaacgttanacgttcgacccggacctacgaacgaccgtaaccgggtacgtttaacgttacgttacgtcggtacggaaccgaagggtaaccgtaacgggtttaccttttaacgggttttaaccggaccgttaaacggtacgtttaaaacccggttaaaaacccgtccgttaaacccgttaccggttacggttaccggtaaccggttaccggggttacgggaaccccgggtaacggggttaaccccgtaaccggg

SEQ ID NO: 247202 - DNA, 699 bp, Homo sapiens
  misc_feature: GYAE6OF02G8RJZ.9.70.G04.1.454.CMB.1.raw
  modified_base (589)..(589): a, c, t, g, unknown or other
  misc_feature (589)..(589): n is a, c, g, or t
  modified_base (600)..(600): a, c, t, g, unknown or other
  misc_feature (600)..(600): n is a, c, g, or t
  modified_base (663)..(663): a, c, t, g, unknown or other
  misc_feature (663)..(663): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctctcctggtggcagctcccagatgggtcctgtcccaggtgcggctgcaggagtcgggcccaggactagtgaagtccttcacaggccctgtccctcaccgtgcactgtctctggtcactccatcgaggtaggtcgtcgtttcctagtcggtaccgtggtactcccggctacggtcccgaccgggacgaaggggtacctagggagtattacgttgggaaaccgtaattaccgtatcggaccgtaggttacggggaccctccaatcccgttaacccgaaccccgttccctacgaaggtactaccggtagtacccgagtacgtaaagttcgttacccgtaaaggttcccggaacgtaacccgtacccgtaaacgtaacccgttaacgtttcccctaacccgttgaaccgtaggttacgtaagtttacagttaacgcccgccgtagacgtaacgccggtacgttagtacgttacgngttcgcggtanacgggtacgtaccgtttaaggttaccgatacggtacttaaacgtaaccgtctaacgtacggtntacggtcgtcggtcgggtaccgacgggtacctacgg

SEQ ID NO: 247203 - DNA, 691 bp, Homo sapiens
  misc_feature: GYAE6OF02HJ13Y.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacaggccctgtccctcacctgcactgtctctggtcactccatcaggaggtcggtcttcctacgtggacctggactccggcacgtcccgcggacaagggactggatatagttcggactaatcgtatcggccgtaggtccgggaccaccgtattaccttaacccgaaacccccggttccctaacgaaacggtacggttacgaacgtccgaagcctaagttcggtacgtaacggtccgaacctacccggtacccgaaccggtaaaccctacgtttaccctaccccgtacgaccgtaaggtacgtaagtttaactagttaccgacccgccgaccgaacgacgaccggtccgtagttacttacgtgtacgacgagacggtacggtacgtttacgtttacggaccgtacgtacgttaagttaaaaccttccgttaaccgttaaccggttcgttacggtaccggttccggtcggggtaccggtacgggaccgtaacggg

SEQ ID NO: 247204 - DNA, 636 bp, Homo sapiens
  misc_feature: GYAE6OF02G4WZ3.9.70.G04.1.454.CMB.1.raw
  modified_base (491)..(491): a, c, t, g, unknown or other
  misc_feature (491)..(491): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaacgtccttcacgacggccctgtccctcacctgcactcgtctcgtggtgacctccatcagtacggttgtccttcctacgtcggacctggactccgggctacgtcccggcggacgaaggggtctaggaacgttatacggttggaacgtaattcgtatcgaccgtaggtcggacccgctaacttcctaaacccgaaccccgttcctaacgaaagtcgtcgagtccagcacgttcgacaggtccaacctaccgccaagtaccctacgttccctcctgacctaggtcgtaattactagtcgtaccnccgacacgacacggtcttagttacgttcgtgtacgacgagtacggacggttacgtttacgttacgacctgtaacgttaacttaaaccgtcctaacgttaccggtctacggtaccgtcggtcgggaccgtacgggtaccgtaacgg

SEQ ID NO: 247205 - DNA, 717 bp, Homo sapiens
  misc_feature: GYAE6OF02F0A5N.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaacgccttcacacggccctgtcccctcacctgcctactcgttctcgtggtcactccaatcgaggtaggttcgttccgttcctacgtcggaccgtggtacgtccggcacggtccgcggacgaagggcgtaggagttatagtacggaacgtaatctagtcgaccgtagggtccggacgacctattccgtaacccgaacccgttcccgtaacgaaacgtacggtcgaacgtcgagacgtattcggtacgaacggtacccaaccgtacccgtacccgaacgtaacccttcggttacccctacccgtagaaccgtaggttacgtaagtttactagtccgaacccgtcgacaacgccgtacggccgtttagtaattaccgtgtacggacgaaggtacggtaaccggtttacttttacgggttaacgaccgtaacgttaccgtttaaaacgttaaacccgttccgtaaccggtacggttaccgtacggtccggttaacgggtccgggtaaccgtaaccggggtacttaacccggg

SEQ ID NO: 247206 - DNA, 817 bp, Homo sapiens
  misc_feature: GYAE6OF02HIL2F.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggacgtcgggcccaggactagtgaacgccttcacacggccctgtcccctcaccgtgcctactgtcctcgtggacacctccatcgagtaggttcggttccttaccgtagtcggacctggacctccggacgtacgtccccggccggacgaaaggggtacctggtaacgttaagttacggttacgggaacctaaattccgtagtccgaccgtaagggtccgggaaccctcctaacgttaccccgtaaacccgtaacccccgttccgtaaacgaaaacgggtcggttaaccggacgtacgaacggtctaagttcgtaacgtacggtacccgtactaacccggtaccccaaacgtaacccgttacgttacccctccgtaacgtaaccgtacgggttaacgtaacggtttaactaacgttacccggaacccggtacccgacggtaacccgtaaccggaacccgggttaccgttacggttaaaccgtttacgtacggtaccggaacgggtacggtaaacgggtaccggtttaaccgtttaaacgtttaccggaccgtaacgttaaccgttaaacgttaaaaccgtccgttaaccgttaccggttaacgttcggtaccgtcgggttaccgggaccggtaccgggaaccgttaaccgg

SEQ ID NO: 247207 - DNA, 776 bp, Homo sapiens
  misc_feature: GYAE6OF02I8HWW.9.70.G04.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (465)..(465): a, c, t, g, unknown or other
  misc_feature (465)..(465): n is a, c, g, or t
tcagtgatacgtctcacgaccggtgctcgatttagtgtagtgtgaagggaaagggccgtggtgaaggcttcactagtcctggacctcctgtgcaagaacatgacacatctgtggttcatcctcctcctggtggcagctcccagatgggtcctgtcccaggtgcggctgcaggagtcgggcccagggactaggtgaacgccttnacaggccctgtcccctnacctgcactgtctctggtgactccatcgaggtaggtggtcgttcctcgtcgactcggatccggcacggtccgccggcgaacgggtcgtaggacgttagtagttacggaacgtaaagtcgttatacgtcccgaaggtcgggtaacccggccctaagttcccgtaaacccgtaaaccccgtcccgtttaacgaacggttaaaccggccgggtaaacgttccgaacggtaacgtacttaccgggttanaccggtttcggaacctaaccggttaccccgaacgtaaaccgtacggtttaccttccccgtacggacctaaagtcgttaagttacgtaactaacgggtcccgaccgtccgaagtacccgacgggtccgtagttacgttaccgtggttccgacggtaagacgggaacgggtactttttacgggttaacgtacggtaacggtacccgttttaaagggttaaaacccttacccgtttaaccggtaacccggggttttatacccgggggttaccgtttacgggtaccgggggtaacccgtacggggggtaaacccg

SEQ ID NO: 247208 - DNA, 548 bp, Homo sapiens
  misc_feature: GYAE6OF02FORE5.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaaggggctgggagtatagttgggacgaatctaatgaccagtcgggaccgcatctaccaacccgtccctacgaagagtcgagtcagcatgtcagtcgacacgtccaagaccagttcctccctgacagtgtagttatatgaccgccgacacgacacggcgttagtattacgtgtgcgagagacggtcgttagtttaggacctagacttaagttaaactccgtaactacggtacgtaggcgtcgtagggccgtagggactaacgg

SEQ ID NO: 247209 - DNA, 828 bp, Homo sapiens
  misc_feature: GYAE6OF02G0QSC.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctccgtggtgcagctcccagatgggtcctgtcccaggtgcggctgcaggagtccgggcccaggactaggtgaacgtccttcacacggccctgtacccctcacctggcctactcgtcctcgtggtcaccttccatcgaggtagggttcggttccgtttaccgtaacgtcggtacccgtggtaacctcccggagtaccggtccccggaccggtacggaaacgggtccgtagggaacgttattacggtcggaactagtacttacgtagaccgtacggtacggaccggtacctacgttacctacccgtaaccccgtcccgtaacgtaacggaacgtcgtaacgcgtacgagtaccgtgtacggtacgtccgaaccgtcccgaccgaacccgtaaccgtacgtttaccccgtcctaaccggtagttaacggtacggttaacttaacggtttacctacgggtaccccgaaccctacggaaccgaccggtacccggtcggtttaagttaaccgtttagtaccggggtcgtaacggacgggtaaacggttacggttaaccgttttaaaccgggtttacggtaacccgtaacggtttacggttaaaaacccgttttaaacccgttaacccgttaacccggtttaacggttaccggttaacggttccggtttacccgggaccgggggttacccggaacgggttaaccccgaaccggg

SEQ ID NO: 247210 - DNA, 619 bp, Homo sapiens
  misc_feature: GYAE6OF02FQNU1.9.70.G04.1.454.CMB.1.raw
  modified_base (246)..(246): a, c, t, g, unknown or other
  misc_feature (246)..(246): n is a, c, g, or t
  modified_base (327)..(327): a, c, t, g, unknown or other
  misc_feature (327)..(327): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcgctgcaggagtcgggcccaggactagtgaagccttcacgaggccctgtccctcacctgcacctgtctctggtgactccatcgagnggtggtcgttcctactggacctggatccggcagtccgcggcaaggctggatatagttggacgaatctatgccagtgggacncagtctaccgaacccgtcctagaagcgttcgagttcgaggcaagttggacaacgtcgaacctacgtcccaaggtaaccctaggtttccctaccccgttagaaccgtagtccggtaagtttatagttacgacccgccgtacaacggacaccgggtccgtagtacttaacgtgtcgtagacgtagacggttcgtttaatttacggggaccaggtaccgtaacgttaaaacctcccgttaagtaaccgttgtcggtaacggtccggtacggggtaccgacggggactaacccggg

SEQ ID NO: 247211 - DNA, 628 bp, Homo sapiens
  misc_feature: GYAE6OF02F56RU.9.70.G04.1.454.CMB.1.raw
  modified_base (325)..(325): a, c, t, g, unknown or other
  misc_feature (325)..(325): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgccactgtctctggtgactccatcaggaggtgtcgttcctacgtggacctggactccggcacggtccgcggcgaagggactgggatatagttcggaacgtaatctancgccaggtcgggacctcaatcctaaccaacccgtccacaagtgtcgagtcagcagtgcaggtccaactccgtacccaacgaacctagttcctccgtagtacgtagtagtagttactgttaccgaccgccgtacacgaccgcgggtccgttagtaacttcgtggtacgacggtaagacggtacggttaccgtttacgtttacggacctaggttaccgttaaacggttaaaaccgttccgtaacgttaccggttcgtacggttacggtaccggtacggggtaccggtacggggtacctaaccggg

SEQ ID NO: 247212 - DNA, 711 bp, Homo sapiens
  misc_feature: GYAE6OF02HICL2.9.70.G04.1.454.CMB.1.raw
  modified_base (382)..(382): a, c, t, g, unknown or other
  misc_feature (382)..(382): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctgtgactccatcaggaggttggtccgttcctacgtggacctgggactccggcacggtccggccggcgaaggggtactgggacgtattacgttgggaacgtaacgttctaagtcggaccgtaggtcgggacccgtcatcgaccaacccgtcctnaaggcgtcgacggtcaggctagtacgccagttccgaacctaccggtacccaacggtaaccctaacggtttccctacccgtacgtaccgtaggtacggttaacgtttagtacgtaccggtaacccgcccggtaccgtaaccggacccgtaccgggtaccggttacgttaacttaccgttgtcggacgtaggacggtacggttaccgtttaacgttttaccgggaccgtacggtaccttaaacggtttaaaacccttaccgtaacgttacccggttcgtaccgggttaccgttccggtacggggtcccggtaacggggtacccgtaacggg

SEQ ID NO: 247213 - DNA, 703 bp, Homo sapiens
  misc_feature: GYAE6OF02I4UY4.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtcccctcacctgctactgtctctgggtcacctccatcgagaggttcggtcttcctacgtggacctggactcgcacgtccgcgcgaaggcgtaggagtatgtaggacgtatctagtcgccgtaggtcgggaccctcgtaactcctaacccgtacccgtccctacgaaacgtcgtcgacgtcgacgtcattcgaccgtacgtccgtaccaccggtacccaacgtaacctccgttacctacccgacgtaccgtaggttacgtacgttaacgttacgtacggtaccccggtaccgacgtaacgacccggtaccgggtccgttagttacgttacgtagtggacgtaggtacggtaacggtttacggtttacgtttaccggaccgtagttaacccggttaaacgtttaaaaccccgttccgttaaccggttaccggttacggtaccgggttaccggttaccggggaccggggaaccggttaccggggaacccgtaacggg

SEQ ID NO: 247214 - DNA, 762 bp, Homo sapiens
  misc_feature: GYAE6OF02HNNBT.9.70.G04.1.454.CMB.1.raw
  modified_base (288)..(288): a, c, t, g, unknown or other
  misc_feature (288)..(288): n is a, c, g, or t
tcagtgatacgtctcacgaccggtgctcgatttagtgtagtgtgaagggaaagggcctgtgaaggcttcactagtcctggacctcctgtgcaaagaaacatgaaaacatctgtggttcatcctcctcctggtggcagctcccagatgggtcctgtcccaggtgcggctgcaggagtcggcccaggactagtgaagtccttcacgacggccctcgtccctcacctgcactgtctctggtgactccatcgagaggtcgttcgttcctaactcggaacctggacttccggnacggtcccgaccggcaaaggggctagggagttaataggttggaacgtaatcgtaatgtaccgaaggttccgggaaccgctaacgtaccctaaccgtaaacccccggtcctaagaaacgtacggttacgaacgtcggaagtacgaaagtttcggaacgttaacgtaccgaacccaccgtaccccgaaagtaaacctacgtttaccctccctacggaccgtaagtagtaacgttaatacgtaccggaacccgtccgacgtaaacggaccgaccgggtaccgttacgttaacgttcgtacggtgaacggtcgaacgggtaaaccggttaccgttttaagttttaaccgggacccgtaaggttaaccgttttaaaacgtttaaaaacccgttaccgttaaacgtttaaccgggttaccggttacggttaaccggtaccgggtaccggggtaccggtaaccggggaacgttaacccggg

SEQ ID NO: 247215 - DNA, 779 bp, Homo sapiens
  misc_feature: GYAE6OF02GAHWP.9.70.G04.1.454.CMB.1.raw
  modified_base (171)..(171): a, c, t, g, unknown or other
  misc_feature (171)..(171): n is a, c, g, or t
  modified_base (436)..(436): a, c, t, g, unknown or other
  misc_feature (436)..(436): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggngtcgggcccaggactagtgaagccttcacaggccctgtccctcacctgaccactgtctctggtacgacctccatcgaggaggttcgtccgttcctacgtcggaccttggactcccggactaccggtcccggaccggacgaaacgggtcgtagggtaagttatagttcgggaacgtaattctagtcgaccgtaagggtccgggacccgtacgtactaccgtaccgtaaaccccgtccctaacgtaaagtcgtaccggactaccganataacgtgttaccgacgtaccgacctaccgtacccgaacgaaaccgtcgttaccctacccgtagaacgtaggtacgtaagttaactacgtaccgacccgcgtacgaacgaccgtaccggtccggttacgttaacgttacgtcggtacggacgtaacggtaacgggtacggtttaacccgtttttaaggtttaaccggaacgtttacggtaaccgttttaaaacggttttaaaaacccttacccggttaaaccggtttaacccggttaggtttaaccgggtaccgggtttacccggggttaccggggtaaccgggtaacccgggggaacccggttaaacccggg

SEQ ID NO: 247216 - DNA, 641 bp, Homo sapiens
  misc_feature: GYAE6OF02GX334.9.70.G04.1.454.CMB.1.raw
  modified_base (372)..(372): a, c, t, g, unknown or other
  misc_feature (372)..(372): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgctccatcagaggtggtcgttcctacgtggacctggactccggcacggtcccgcggcgaagggctggagtatagttcggacgaagtctatgccaggtggaccgcagtcaccacccgtcctcaagagtcgacgtcagcatntcgagtcgacgacgtaccgagaccgtacgttcctcccgtgacctagtcgtagttatacgtacggaccgtaccgacgaacgtaccgccggtaccggttcgttacttaccgtgtcggacgagtacggtacggtaccgtttggtttaacgggaccgtaacgtacgttaaaccgtttaaaacccttccgttaaccggttacccggttaccgttacggggttaccggttaccggttaccgggggtacccggtacggggtaacccggtaaccggg

SEQ ID NO: 247217 - DNA, 676 bp, Homo sapiens
  misc_feature: GYAE6OF02J15OB.9.70.G04.1.454.CMB.1.raw
  modified_base (102)..(102): a, c, t, g, unknown or other
  misc_feature (102)..(102): n is a, c, g, or t
  modified_base (560)..(560): a, c, t, g, unknown or other
  misc_feature (560)..(560): n is a, c, g, or t
  modified_base (570)..(570): a, c, t, g, unknown or other
  misc_feature (570)..(570): n is a, c, g, or t
tcagtgatacgtctcacgaccggtgctcgatttagtgtagtgtgaagggaagggcctgtgaaggcttcactagtcctggacctcctgtgcaagacatgaacntctgtgttcatcctcctcctggtgcagctcccagatgggtcctgtcccagttgcggactgcgaggcggtccggaccaggtacgtagtcgactcctcacgcggtcctcgtcctcacctgacctcgtcgtcctcgtggtacaccttaccgacgtccgaggtacggttcgttacccttcctacgtccggtacgtcggtaccttcccggacgtacggtaccccggacgtacggaacggtccgtagtagtacttacggttacggactaactcgtacgtccgacgtagggtccggacctctaactccgtaacccgtcccgtctaacggacgtcggttacgcgttaccgatcgtagtcggacgtacgtacccaacgtaccgtaccgaactaacgtcgttacccctccgtagactaggttactagtacctagccggaccggctaacgacgcccgtacggttacttntcgttaccgnggtaccgagtacggatacccgggttattacgtaacggctacgtacgtttaaaccacgccttaacggtcgtgaccggtacgtcggcggaaccgtacggtactacccg

SEQ ID NO: 247218 - DNA, 797 bp, Homo sapiens
  misc_feature: GYAE6OF02I56D4.9.70.G04.1.454.CMB.1.raw
  modified_base (161)..(161): a, c, t, g, unknown or other
  misc_feature (161)..(161): n is a, c, g, or t
  modified_base (192)..(192): a, c, t, g, unknown or other
  misc_feature (192)..(192): n is a, c, g, or t
  modified_base (366)..(366): a, c, t, g, unknown or other
  misc_feature (366)..(366): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctacccagatgggtcctgtcccaggtncggctgcaggagtcgggcccaagggactagngaagtccttcacaggcccctgtccctcacctgcctactgtctcgtgtcgactccatcagtaggttcgtcttcctaagtcgaccgtgactccggtacacgtcccggcggtcgaaacggcgtacggattacgtagtgggaactaactatacgtcgaccgtacggttccgggacccnctacgttacctacccgtaccccgttacccgacgtaacgtacggtccgtaacgttaccgaggtacctacgtagtaccgtaaagtcccgaaaccgtccggtaacccgtaacgaaaccctttccgtaaccctcccgttacggaacgtaacgttagtacgttacgtaacgttaccggacccgtaccgaccgtaaggtacccggtaaccggtcccgtttagttaacccgttacggtagttaccgggcgtaaacggggttaacggtacccgggttttaacccgttttaaggttaccgggtaccctaaggttacccgttttaaaacggggtttaaaaccccttccggttaacccgtttaccggggtttaccgttaaccggggtccggttttaccgggaacccggggtaaccggttaaccggggaaccttaacccgggg

SEQ ID NO: 247219 - DNA, 785 bp, Homo sapiens
  misc_feature: GYAE6OF02G1UU7.9.70.G04.1.454.CMB.1.raw
  modified_base (249)..(249): a, c, t, g, unknown or other
  misc_feature (249)..(249): n is a, c, g, or t
tcagtgatacgtctcacgaccggtgctcgatttagtgtagtgtgaagggaaagggcctgtgaaggcttcactagtccctggaccctcctgttgcaagtaacattgaaacatctgtggttcatcctcctcctggtgcagctcccagatgggtcctgtcccaggtgcgctgcaggagtccggccaggtactagtgaacgtccttacacgacggtccctgtccccgtcgacctgccactgtcctcgtaggtnacctccatcgaggcggtcgttccgttcctactcggacctggtacgttccggctaccggtccggaccggtacgaaacggggtcctagggagttacgtacgttggaacctaatccgtaatccggacgagggtacgggtaccctaccgtaactccgtaaccctaaccccgttccgtacgaacggtacggtacgacgtacaacggtcacgtcggtaccacggtcgtaacccgtaccgaccgtaacgtaaccctcgttacccgtccccgtaaggaactcggttacgtaaacgttacgtaacgtcgaaccccggtcgaacgtacccggacggtacccggtacgttaacgttacttccggtaggtacggaccgtaagggtaacgggttacccggttaacgttttaacggttaaccgtacccgtaggtttaacctttaaaccgggtttaaacccgttagttaccccggtaacggtacccggttcgggttaacccggttgggtaaccccggggaacgggttaccgggaacccgtttaacccgggg

SEQ ID NO: 247220 - DNA, 643 bp, Homo sapiens
  misc_feature: GYAE6OF02JWTXO.9.70.G04.1.454.CMB.1.raw
  modified_base (238)..(238): a, c, t, g, unknown or other
  misc_feature (238)..(238): n is a, c, g, or t
  modified_base (481)..(481): a, c, t, g, unknown or other
  misc_feature (481)..(481): n is a, c, g, or t
tcagtgatacgtctcacgaccggtgctcgatttagtgtagtgtgaagggaaagggaccgtggtgaaggcgttcactagtcctggacctcctgtgcaagaacatgaaacatctgtgttcatcctcctcctggtggcagctccagatgggtcctgtcccaggtcgcggctgcaggacgtcggcccaggactagtagagcttcacgaggccctgtccctcacctgcactgtctgtggtacnctccatcagaggtggtcgtcctacgtcggactggactccggcacgtccgccggacgaagggtcgtagggacgtatacgttagggaactagtctagtcgaccgaggtcgggaccacctactaccttaaccgaacccgttcccaaggtacggacgttcggaacgttaccagacttagcgtaacgacgtccgaactaccgtccaacgtaacccgtattccgtccgtacacgtacgtcgtacgttanactcggtaccgcgacacgtacgaccgtcgtacgttattaccgtgtacgcgaagacggtacggttacgttagtttaccggactacgtacgttaaacgttaaaccttccgtaacgtttccggagttcggtacggtcgtaccggggacgtacgggaccgtaacgg

SEQ ID NO: 247221 - DNA, 772 bp, Homo sapiens
  misc_feature: GYAE6OF02IP0BM.9.70.G04.1.454.CMB.1.raw
tcagtgatacgtctcacgaccggtgctcgatttagtgtagtgtgaagggaaagggcctgtgaaggcttcactagtcctggacctcctgtgcaagaaacatgaaaacatctgtggttcatcctcctcctggtggcagctcccagatgggtcctgtcccaggtgcggctgcaggagtcgggcccaggactagtgaagccttcacacggccctgtccctcacctgccactcgtctcgtggtcacctccagtcaggtaggtggtcgttcctacgtcggacccttggactccggcacggtcccgaccggacgaaacggggacctaggggagttaagttagtttgggaaccgaaacgttcctaatcggacccaagggttcggggaacccgccgtaacttccgaaaccctaaccccggttacccctaacgaaacgtacggttacgaaacgttcgaacgtacaacttgttaaccgaggttacccgaaccgtaacccgtacccgaaaccgtaaaacccgtaccgtttacccgtacccgtaacgtaacgtaagtacggtaagtttaacgttaacgtacggaacccggtcccggacaaccggaaccgtaccgggtacccgttagttaacgtttaaccgttgtacggacggtaaggaagggtacggttacggtttacgttttaacggacgtaacgtacgttaaacgtttaaaaaccctccgttaaaccgttaccgttcgttacgggtacgtccggtacgggaccggtacgggtaccgtaaccgg

SEQ ID NO: 247222 - DNA, 871 bp, Homo sapiens
  misc_feature: GYAE6OF02IZX5C.9.70.G04.1.454.CMB.1.raw
  modified_base (203)..(203): a, c, t, g, unknown or other
  misc_feature (203)..(203): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaacgccttcacncggccctgtccctcacctgctactgtctcgtcggtcgactccaagtccgaggtaggttcggttccgttacccgttacgtccgggtaccgttacgggtaaccgttcccggtaccgtaaccgggttccccggtacccgggacgtaaaacggggtccggttacggggtaacgtttagtttaaccggtttagggaaaccggttaacgttccgttaacggtcggaccccgtaagggttcccgggacccgtcctaaccgttacctaacccccgtaaccccgttcccctaacggtaaaccggttcgtaccggtacgtaccgacgtacctagtcgtaccggaacgtcccgtaacgtacccgttacccgggaaaacctacgtaccgttccccgttacccgagggtactacgggttatacgttagtaaccgtcgacccgccgagtaacgacccgggacggttcccttaagtttacccttacggttacggggtccgaggtaccggttaaccggtaccgggttttaaccttcgggtttaacccggactttaacggtttaacgtttaaaccctttaaaccccggtcgtttaacccgggtacggtttaaccggtaacccgggttcccgggttaaacgggtcccgggggtaaacccggttacccgggtaacggttacccccgg

SEQ ID NO: 247223 - DNA, 658 bp, Homo sapiens
  misc_feature: GYAE6OF02FFYWI.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtcctctggtgactccgatcagtaggtggtcgttcctacgtggacctggactccggctacggtcccgcggcaagggctgggatatagttggacgtaactctatcgaccgaggtcgggacccgccaattcctaacccgaaccccggttcccttacgaaacggtacggttaccggaacgttccgaacggcctaacgttcggtaccacggttccgaacctacccggttccccgaagaacccgtacgttccttaccccgtagaccgtagtacgtaagttaattacgtcgaccgccgcgacgaccgtacggtccgtagtacgttacgtgttacgacgagacgtacggtccgtttagtttacggactacgacgttaacgttaaacctccgtaacgttacggtcgttacggtaccgtcggtcggccggagggtacctaacgg

SEQ ID NO: 247224 - DNA, 615 bp, Homo sapiens
  misc_feature: GYAE6OF02I5W2G.9.70.G04.1.454.CMB.1.raw
  modified_base (340)..(340): a, c, t, g, unknown or other
  misc_feature (340)..(340): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcagtcccgccggcaacgggactgggagtatagttggacgtaatctaatcgaccaggttcgggaccnccgattcctaaccgaaccccgtccctcgaacgtagtcgagtcagcatcgtcagtcgaacaccgtaccacgtaaccagttcctccctagacctagtacgtagttactagtacgaccgccgcgacgaccgaccggtaccgtagttacttacgtgtcgtacgacgtaggtacgttaccgtttacgttttacggaccgtagtaccgttaacgttaaaacctccgtaaccgttacggttcgtacggtacgtcggtacgggcccgtacgggaccctaacgg

SEQ ID NO: 247225 - DNA, 807 bp, Homo sapiens
  misc_feature: GYAE6OF02GO0RP.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatccctcctcctggtggcagctccagatgggtcctgtcccaggtgcggctgcaggacgtcgggcccaggactagtgaagtccttcacacggcctgtccctcacctgcactgtctcgtgtgacctcatcaggtacggtggtccttaccgtacgtcggtaccgtggacgtccggactaccggtcccggaccgggacgaaacggggtctagggtaacgtagtacggttacgggaacgtaacttcgtacgttccggaccgttaacgggttccgggaccccgtccgttaactaccctaaacccgtaaccccccggttcccttaaaccgaagtaccggtaccgtaagtacccaaggtaccttagtcggtaacgtacggtaacccgaccggtaccccgttacccgaaacgtaaccccggttagttaccccgtttcccgagttaaccgtacggtacgtaacgtttacggttaattcccggacccgttaccgacgtaacgacccgacgggttacgttcgttaacttaccgtagtcggtaacgtaacggacggttacgggtttaccgtttacgtttaaccgggtaccttaacgggtaccgtttaaaacgttaaacccgttccggttaaccgttaacgggtccgttaacggggtaccggtccggttacccgggggtaacgtaccgggtaaccgttaacccggg

SEQ ID NO: 247226 - DNA, 767 bp, Homo sapiens
  misc_feature: GYAE6OF02HZJ3M.9.70.G04.1.454.CMB.1.raw
  modified_base (416)..(416): a, c, t, g, unknown or other
  misc_feature (416)..(416): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcgaggtacgtccggggacccagggtacttaggtggaaacgtccttccaacgacggtccctggtcccctcacctgcacgttgtcctcgtgggtcactcctatcgagtaggttcggttccgtttacctagtcgggtacctgggtaccgtcccggcgtacggtccccggccgggaaccgaacggggacttgggaagttattaggttacgggaacgtaaattccgtagtcggtaccgtagggtccgggaaccccncctacgttacctaaccgaaccccgtcctaacgaggtacgtcgtaacgtcgagcctaatcgtacgtacggtaccaccgtaacccggtacaaaccgtaaccgtcgttttccccaccgtagtaacgtggttacgtaagttaagttaccgcggtaaccccggcgtacgaaccgaccgggtaccggtcgttaagttacttacggtcgcggaacgtacgggacggtacggtttccgttttaataaccgggcttaagtaccggtttaaattaaccccgttagtaccgggttaaccgttcggtaaccggttccgggtacgggtacccgggggtaactacccggggaacccgttaaccgg

SEQ ID NO: 247227 - DNA, 658 bp, Homo sapiens
  misc_feature: GYAE6OF02FP51G.9.70.G04.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (346)..(346): a, c, t, g, unknown or other
  misc_feature (346)..(346): n is a, c, g, or t
  modified_base (438)..(438): a, c, t, g, unknown or other
  misc_feature (438)..(438): n is a, c, g, or t
tcagtgatacgtctcacgaccggtgctcgatttagtgtagtgtgaagggaaagggcctgtgaaggcttcactagtcctggacctcctgtgcaagaacatgaaaacatctgtggttcatcctcctcctggtggcagctcccagagtggtcctgtcccaggtgcggctgcgaggacggtcggcccgaggactagtgaanccttcacaggccctgtccctcacctgacacgtntctcgtggtcgactccntcgaggnggtcggttcgttcctactggacctggacgtcgcncgtccgcgacgaggtagtggagtagngtacggacgatagtatcgcgtagtcgggaccnccatccgacgtaccctccagaacgcgtacgactcgaacgctagtcgtacgtgtaccgaaccgtcgtacccaacgaccgtacgttcctccgtntaaccgagttagtacttaagtacttcggacccgtaccgtacgacggtaccgacgggttaccgttaggtacttcggttaggtcgacgggtaagacgggtaccggttttaccgtttaacgtttacggaccgtattaaaccggttaacctaaacgttccccgtaaggtttaccgtcggttacggaccggtcgggttccgggaacgtacggggacccgtaacgg

SEQ ID NO: 247228 - DNA, 723 bp, Homo sapiens
  misc_feature: GYAE6OF02H2C2D.9.70.G04.1.454.CMB.1.raw
tcagtgatacgtctcacgaccggtgctcgatttagtgtagtgtgaagggaaaggcctgtgaaggcttcactagtcctggacctcctgtgcaagaacatgaaacatctgtggttcatcctcctcctggtggcagcctcccagatgggtcctcgtcccaggtgcggctagcgaggagtccgggcccaggactagtgaacgcttcacgcggccctgtccctacacctcgcactgtctcgtaggtcactccatccgaggtaggtcgttccgttcctactcggacctggactccgcgtacggtccgccggacgaagggacgtggaaggttatacggttacggaacgtaacgtctaacgttcggaccgttagggaaccgggtccgtactaccgtaaccgtaacccgaaccccgttcccgagaaaacgggtcgtcgttaaccgacgacgtaccttaagtcgtaaccgtcgaccgtaaccgtacccgttaacccgaagtaaacccttccggtttccctacccgtaggtaaccgttgtaaggtaacgttttaacaacgttccggacccggcaacggttacgaaccggccgttcgttaacgttaattcggtacgtcgacgaggtaacgcggttaccttttaggtaccggacacttacgttaaacgtaaccttctaacggtaccgtcggtacgttacggacccgggttaccgggaggtaccggaacctaccggg

SEQ ID NO: 247229 - DNA, 785 bp, Homo sapiens
  misc_feature: GYAE6OF02JUKZ2.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctccagatgggtcctgtcccaggtgcggctgcaggagtccgggcccaggactagtgaagccttcacgacggccctcgtccctcacctgcctactgtctcgtggtcaccttccatcgagaggtcgtccgttcctacgtcggacctcggacgtccggctacggtccccggcggtacggaaacggtccggtaggtaagtattacgttacgggtaacgtaacttccgtagtccgacggtacgggtacgggacccgtccgtaactacccgttaaaccgaacccccgttcctaacggtaaacggtcgtacccgtagtaccacggtccctaagttcggtacgtaaccggtaccgacccgtacccgtacccgaacccgtaaccgtaccgttaccgtacccgttacggtaacgttacgtttaacgttacgtacgtaccggtacccgtaccgtacgaacggtaacccgtaccgggtcccgttacggttaacgtttaccgtcgtacgtacgggaacgtacggtaccggttaacggtttacgttaaccgtacgtacgttaacttaaccggttaaacccttacggttacccgtaacggtaccggtcggtaaccggttcggtacccggggtacccggtaccggggtacccgttaacggtaccccgg

SEQ ID NO: 247230 - DNA, 794 bp, Homo sapiens
  misc_feature: GYAE6OF02H5UBA.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaaacatctgtggttcactcctcctcctgggtggcagctcccagagtgggtcctgtcccaggtgcggtctgcgaggaggtccgggacccaggactaggtgaacgtccttcacgacggccctcgtcccctctaccgtcgacctacgtcgttctcgtggtcaacctccataccgaggtaggtcggttccgtttcctacgtcggacctggacgtccggcgtaccgtcccggacggtacgaacgggtacgtgggacgttagttaggttacggaacgtaacgttaccgtacgtcggtacgtacggtaccgggtacccgccgtaaccgttacctaaaccccggtaaaccccgtacccgtaacgtaaagggtacggttaccgtaaggtacaacggtactaacggtactccgtacggaccgtaaccgtaccggtacccaaaacggttaccctgtttccccgacccttaagggaccctaggttacgttaacttacgttaagcccgtaaccgccgaccgttaaacggaccggtaccggtacgtttaacgttagttaccggtgtaccggtacgaacgtaacgggttacgggtttaccgtttaagttccgaaccggttagttaaaccgttaactttaaacccggcgtttacggtaacgttcggcggttaccggtccgggtcgggaaccggtacgggtacacccggg

SEQ ID NO: 247231 - DNA, 640 bp, Homo sapiens
  misc_feature: GYAE6OF02IZBTU.9.70.G04.1.454.CMB.1.raw
  modified_base (587)..(587): a, c, t, g, unknown or other
  misc_feature (587)..(587): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtgactccatcagagtgtcgttactctggacctggactccggcacgtccgcggacaagggctgggaattatagttaggacgaatctatcgcaaggttcgggaccgccaacttcgtaacccaaccccgttcccacaaaggcgtacgaacggtcaaggccagtacgcctaaggtcccgaaacaccgttccccgaagtaaaccctacggttacctcccctaggacctaggtacgtaagttactacgtcgaaccggcctaacgaacgacccgacggtccgtaagttacttacgtagtcggacaacggtagtacgggttaactttagttacgggactaggtaccttaaagtttaaacccncgttaacgtacgttacgtacggtacgtcgtacgggaccgtagggacctaacgg

SEQ ID NO: 247232 - DNA, 647 bp, Homo sapiens
  misc_feature: GYAE6OF02GG6P6.9.70.G04.1.454.CMB.1.raw
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcgacctgcactgtctctggtgactccatcagaggtggcttcctactggacctggactccggcagtccgccggcaaggctggagtatattggaccgaatcatgccagtcgggaccnccatctaccaacccgtcccacaagcgtcgatcanctatcgtacaggtccaactacccgtacccacgaaaccctacgttccctacccttcgaaccacggttacgagtttaatacgttacggacccgtccgaccagaccgaccgggtaccgttagttaacttaccgtagtcgacgggtaagaacggtacgggtaccgttttaacgttttaacgggacctacggtaccgttaaacgtttaaaaacctcccgtaaaccgttaccgggttaccgttacgggtaccgtccggtacgggggtacccgtacggggacccgtaacggg

SEQ ID NO: 247233 - DNA, 664 bp, Homo sapiens
  misc_feature: GYAE6OF02HH04D.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgccctcacctgcactgtctctggtcacctccatcagtaggtcggtcgttcctacgtggacctggactccggcaggtcccgccggacaaggggctagggtagtagttagttgggaacgtaactcgttaatcggaccctaggttcgggacccgtcctaatcctaccaacccgtcctacgaacgacgttcgagtcacgctagtgtcaagtccgacgtacgtcccaacgacctacggttccctacctagaccgtagtaggtaattacgtaggttaccggacccgacccgacgaacgcccgtaaccggtccgttgttaacttaccggtgttcgacgtaggagtaccgggttacccgtttagtttaccgggactacggtaccgttaaacggttaaacccttacggttaacgtaccggttctacgggtacctcggttacgggaccgttacgggacctaacggg

SEQ ID NO: 247234 - DNA, 673 bp, Homo sapiens
  misc_feature: GYAE6OF02F49A4.9.70.G04.1.454.CMB.1.raw
  modified_base (552)..(552): a, c, t, g, unknown or other
  misc_feature (552)..(552): n is a, c, g, or t
  modified_base (565)..(565): a, c, t, g, unknown or other
  misc_feature (565)..(565): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctcgtcccaggtggcggctgcgaggacgtccgggcccgaggactagtagaacgtccttacacgacggtccctcgtaccctcacctgaccacttgtccttcgtggtacgtacctccgatcgaaggtaggttcggttccttcctacgtacggtaccgtggtaccgtccggcgacgtcccggcggacgaagggtcgtaggagtagtagtcggaactatctacgtcgacgtacggtcggacctaccgactaccgtaaccctaccccgtacgacgaagtacgtacgacgtacgacgctagtacgtacgtacgtcccgaactaccgtacccaagttaacccgtcgttccctacgtaaggacttaggtactagttaatccgaccgtacccggctacgacgaccggtccgtnttattacttacgngtggacgaagggtactacggtttactttagtaccgagttacgtactaaacgttaaccgtcttaacggcgtacggtagggtcctacgggacggacggacggtactccgg

SEQ ID NO: 247235 - DNA, 740 bp, Homo sapiens
  misc_feature: GYAE6OF02HYZ61.9.70.G04.1.454.CMB.1.raw
  modified_base (145)..(145): a, c, t, g, unknown or other
  misc_feature (145)..(145): n is a, c, g, or t
tcagtgatacgtctcacgaccggtgctcgatttagtgtagtgtgaagggaaagggcctgtgaaggcttcactagtcctggacctcctgtgcaagaacatagaaacatctgtggttcatcctcctcctggtggcagcctcccaagntcgggtcctcgtcccaggtcgcggctgacgaggacggtccgggacccagggactagtgaacgtccttacacgacggccctcgtccctacacctgactactgtcctcgttgggcacctccattcaggtaggtcgttcgttcctagtcggactggactcccggctacggtcccggccggagaaacgggacgtaggtattaagttaggtacggaactaactccttaagtcggaaccgtacgggtaccggggacccctactaccgttaccgtaaacccaaccccggttcctaacggaaacggttacgtccgaaacggttcaaacggccttaaattccggaaccgaacggtaccgaacgtacccgtaccgaaaccgttaaccgtaccgtttaccacccgtagaaactcggtaaagtagtttaacgacgtaccggaacccgtcgaacgaacgtaccgaccgggttactacgtttacttaacgtgtacggacgaagtacgtacgttaacgttagtttacgacgtaacgtacgttaaacttaaacctccgttaacgtacgttcgacggttacgcggttacgggaaccgtacggaacgtaccgg

SEQ ID NO: 247236 - DNA, 746 bp, Homo sapiens
  misc_feature: GYAE6OF02FQ49Q.9.70.G04.1.454.CMB.1.raw
  modified_base (248)..(248): a, c, t, g, unknown or other
  misc_feature (248)..(248): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccggcccaggactagtgaagccttcacgacggccctagtccctcacctgctactgtctcgtgtgactcatcgagnggtgtcgtcctacgtggactggactccggcacgtccgcgacgacggctaggtatagtagtacggaacgtactcgtagtcgaccgtaggtacgggaccctcgtataccgtaacccgaaccccgttcctacgaaacgtacggtacgtagtccaacgtctagtcgtaccgtacgtaccgtaccgtaaccggtacccaaacgtaaccttcgttcccgtacccgtagaacgttacggtagttaacgttaagtacgttaccggaaccgtccgacgaaccgtaccgtaccgggttaccgttagttaacgttaccggtcgggtacgtaccggaacggttaacggttaccggggtttaacccgttttaacgggttttaccggaccgttacgttaaccggttaaacgtttaaaacccgtcccgtttaaaccgggttacggttacgttaccgggttaccggtccggggttaacccgggaccgggttaaccggggtaacccgttaaccgg

SEQ ID NO: 247237 - DNA, 873 bp, Homo sapiens
  misc_feature: GYAE6OF02IOAP6.9.70.G04.1.454.CMB.1.raw
  modified_base (246)..(246): a, c, t, g, unknown or other
  misc_feature (246)..(246): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggacgactccatcagnggtggtccttcctacgtggacctggacgtcccggactacggtccccggccgggacgaaacggggtacgtagggaaggttacttaggttacgggaaacgaaactttctaagttcggcccgtaggggtaccgggaccgacctaacgtacctaacccgtaacccccgttccctaacggaaaacggtcggttccggaaacgttaccgaacggtacgtaacgttaccgtaccggtaaccgttaccgggaaccccgtacccggttaccccgaaacggtaaacccgttaccggttttaccccgttaccccgtacggtaaccgtacgggtttaacggtaaaggttttaacgttaacgttacccgggaccccgtacccgtaaccgaaacggtaacccggtaaccggggttccgtttaacgttaacgtttacccgtaggttaccggacggtaagggacgggtaacccggttttaaacccggttttagtttaaaccgggtacccgtaaacgttcccgtttaaaaacggttaaaaacccctttccggtttaaacccgttacgggttacccggttacggttaaccggggttcccggttaccgggggacccgggtttaacgggggaacccgttaacccggg

SEQ ID NO: 247238 - DNA, 674 bp, Homo sapiens
  misc_feature: GYAE6OF02FZM2M.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacaggccctgccctcacctgcactgtctcgtgtgactccatcgagaggtcgtcgttcctactggacctggactccggactacgtcccggccgggccgaaggggctgggaagttatagttgggaacaactcgtaatcggcctaggtcgggaccaccattacctaacccaaccccgttccctagaacgacgtccgtagtcagtcagtcgtacacgtcgaactcccgtaccaacgaacctacgttcctcccgtcgacgtacgtagtagtatacgtacgacccgaccgaccgagaccggaccggtccggttattaacgttacgttcgtggtacggagtacgtacggttaccgtttagtttaacggaccgttagtaccgttaacggttaaaacccgttcccgttaaccgttaaccggttaccggttacggtacccggttacgggtaccgggacccggaaccgggggtaacccttaacccggg

SEQ ID NO: 247239 - DNA, 633 bp, Homo sapiens
  misc_feature: GYAE6OF02G5MTZ.9.70.G04.1.454.CMB.1.raw
  modified_base (284)..(284): a, c, t, g, unknown or other
  misc_feature (284)..(284): n is a, c, g, or t
  modified_base (345)..(345): a, c, t, g, unknown or other
  misc_feature (345)..(345): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgccactgtctctggtgacctccatcgagtaggtggttccgttcctactggaccctgggactccggnacggtcccgcggacgaagggctggattagtattagggacaatctatcgccaggtcggaccncgtaatcgtacccaaccccggttccaacgaagtggtaccaggtcaggcattcgtacaggtccacgtaccgacccaacgaaccagtacctcctacccgtgaaccgtagttacgtagtttaatacgtacggacccgtccgaacgacggaaccgaccgggtcgttacgttaagttaccgtgtacggacgtaacggaggtaacgttccgttttacgttacgaccgtacgtacgttaacgtaaaccttccgtacgtacgtcgtcgggccgttcggcgggtccacgggtaaccg

SEQ ID NO: 247240 - DNA, 664 bp, Homo sapiens
  misc_feature: GYAE6OF02FQWHJ.9.70.G04.1.454.CMB.1.raw
  modified_base (346)..(346): a, c, t, g, unknown or other
  misc_feature (346)..(346): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagattgggtcctgtcccaggtgcggctgcaggagtcgggcccaggactagtgaagccttcacaggccctgtccctcacctgcactgtctctggtgactccatcagaggtggtcgttcctacgtggacctggactcccggcagtcccggccggcgaagggctgggacgtagtattacgggacgaatctaatcgccaggtcgggacccnccagtcctaccgtaacccgtccctcaagtacgtacgagttccaagcctagtacgtcaggtccgacctaccgtacccgaagaaccctacgttcctcccgtagaccgtagtacgtagtttaacgtacgttcgacccgtaccgcgaacgtaccgaccgggtcccgttagttaaccgtttacgcggtagcgtaagacggtacggttaccgtttagtttacggacctacgtacgttaacgttaaaaccctccgttaaccgttacggtaccttacgggttacccgttacggtacgggggacccgtaacgggggaccctaacggg

SEQ ID NO: 247241 - DNA, 627 bp, Homo sapiens
  misc_feature: GYAE6OF02FN3I5.9.70.G04.1.454.CMB.1.raw
  modified_base (235)..(235): a, c, t, g, unknown or other
  misc_feature (235)..(235): n is a, c, g, or t
  modified_base (359)..(359): a, c, t, g, unknown or other
  misc_feature (359)..(359): n is a, c, g, or t
  modified_base (406)..(406): a, c, t, g, unknown or other
  misc_feature (406)..(406): n is a, c, g, or t
  modified_base (501)..(501): a, c, t, g, unknown or other
  misc_feature (501)..(501): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtcctcgtggtnacctccatcagaggtcggttcgttcctacgtcggaccttggactccggcacggtccccggccggacaacggggtcgtagggagttagtagtttcggaacgtaatctatcgccaggtcgggaccncatctaccacccgtccacgaagcgtcgagtcagctatgcagtcgacncgtacccagacctgttcctcccgtgaacgtagttacgtagttatgtaccgacccgtccgacgaacgaccgtaccgggtcgttagtaactttacgnggttacggacgttaaggacggtacggttacccgttttaagttaaccggactaggtaccgttaaagttaaacctccgtacgtacgttcgtcggtacgttcggtcgggaccgtacgggtacctaacgg

SEQ ID NO: 247242 - DNA, 743 bp, Homo sapiens
  misc_feature: GYAE6OF02JK4PO.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggacgtcgggcccaggactagtgaagccttcacgacggccctgtccctcacctgcactgtctcgtggtcgactccatcgaggaggtcggtacgttcctacgtcggacctggactccggcacggtcccggccggacaaagggctcgggtagtattaacgttcgggaacgaacttctacgtcgtaccgtaggtaccggggtaccccgcctaagtacccgtaaccaaccccggttcccaacgtaaagtccgtaccggagttacgaacgtcctagttcggtaccgacgtcccgaaccgtacccgtacccgaacgaacctacgtttcctaccgtagaccgtaaggttacgtaagttaactgtaaccgtacccgacgtaccgaacgtaccgaacccgggttcgttacgtttaaccgttacgtggttaccgacgggaaactcgggtaacgtccgggtttaagtttaccgggacctacgttaaccgtttaaaccggttaaaaccttccggtaaccgttaccggtacgttaccgggtaccggttccggtaacggggaccccgtaacgggtacggtaaccccggg

SEQ ID NO: 247243 - DNA, 848 bp, Homo sapiens
  misc_feature: GYAE6OF02JTQ6F.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcgacacggccctgtcccctcacctgcactgtcctctggtacgacctccagtcgaaggtaggttcggttccgttccgttacctggtaccccgtaggaccgttcccgggactacggtcccggcccggtacggaacggggaaccgtgggaagttacgttaacgtcggaaaccgtaagtacgtagtcgaccgtacggtcgggaacccgcctaagtccctaaccgtaacccccgtccgtaacgaaaggtccgttacggaacttaccggaagtaccgacttacggtactaccggtaccgaaccctacccggtaaccccgaaccgtaacccgtaacgtttaccccgtacccgtacggtaaccgtaacgggttacgtaaaccggtttaattaaccgtaccggtaaccccggtcccggtaaccgtaacggaaacccggtaccgggtaacccgttaccgtttaacgttcggttaccggttcggtaaccggtacgtaacggtacggtttaacccgggtttaacgtttaaccgggaccgtacggttaacgttaaacccggtttaaaaccttacccgtttaaccgttaaccgggttccgttaacggggtaaccggttccggtaaaccgggggtccgggtaaaccgggttaccccgtaaaccggg

SEQ ID NO: 247244 - DNA, 760 bp, Homo sapiens
  misc_feature: GYAE6OF02G0SCF.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctgtgactcatcagacggtgtcgttcctacgtcggaccgtggactccggacacggtcccgccggcgaaacggggactacgggtagttaattaggttacggaaccgtaaattccgtaagtcggtaccgaacggtacggggaccccgtacctaacgttacctaaccgaaaccccggttccctaacgaaacggtacggttacgtaacggtaccacgacaacgtttcgtacgtagtaccgaaccgtaccgtacccaaacgtaaacccgtacgtttaccccgtaccccgttagtaacgtaacggttggtaacgtttaactacgttaccggaacccgccggacgaacgaccggaacggtccgttaggtaactttacgtgtacggtacgaggtaacggtcggttaaaccgtttagttaacggtaacgaggtaaccgtttaaacgtttaaaaaccgtcccgttaacggttaaccggttcgttacggggtaccgttaccgggtaaccggggtacccggtaacggggtaacccgtaaaccggg

SEQ ID NO: 247245 - DNA, 798 bp, Homo sapiens
  misc_feature: GYAE6OF02FZLGA.9.70.G04.1.454.CMB.1.raw
  modified_base (515)..(515): a, c, t, g, unknown or other
  misc_feature (515)..(515): n is a, c, g, or t
  modified_base (571)..(571): a, c, t, g, unknown or other
  misc_feature (571)..(571): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctccagatgggtcctgtcccaggtgcggctgcaggagtcggcccaggactagtgaagtccttcacgacggtccctgtcccctcacctgcctactgtctcgtgtcgacctccatcgaggacggttggtccgttcctacgtggacctggactccggctacggtcccgccgggctaagggctaggtaatagttagttacggaacgtaatcgttagcgaccgtaggttcgggacccgtcctacgtacctacccgtaaaccccgtcccctagaacggtacgtaccggtataccgagtaccgtaattccggtaacgacggttaccgaacccgtacccggttaccccgaaaacggtaacccctttaggttttaccccaccccgggttanaaaccgtttaccggttggttaaacgtttactaacggttaccggcccccgggtaacncccggaaaggtaaacccggtaccgggttaacgggtttagttaaccttacgggttcggtacggaaccgaagggttaaccggcggttttaacggtttaacgttttaccggggacctaacgggtttaaccttaaaaccggtttaaaccgtaccccttaacgggttacggtttacgaccggggttacgtccgggggaacccgggtaccgggaaccggggttacctaacggg

SEQ ID NO: 247246 - DNA, 730 bp, Homo sapiens
  misc_feature: GYAE6OF02JWEU6.9.70.G04.1.454.CMB.1.raw
  modified_base (561)..(561): a, c, t, g, unknown or other
  misc_feature (561)..(561): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctcgtacccaggtgcgggctgacaggacggtcgggcccaggactagtggaacgtccttcacgacggcccttgtcccctcaaccttgcctactgtccttcgtgggtcaacctcccaatcgaggtcgggttcggtccgtttcctaacgtcggtaccgtggaccttcccgggctaccggtcccgcccgggtacgaacgggtacgtggtagtatagttaggacgtaacgtcttacgtcgtaccgtaacgggtcggggacccctccgtaactaacctaacccgaccccggtaccctacgaaggaccgttcggaacgtccgaagtcctaagtcgtacgagtccgaccaccgtaccgtaacgaaccgtccgttacctcccgtagaccgtagttaggtacttaacgtcgttaccggacccnccggaccgaacgaccgtcggtacgttacgtacgttaacgtcgtacggacgtagcggtacggtacgtttaacttcgggaccagttaccgtaaacttaaccgttaccgtaacggttccgttacggtacggtacggtcggtaccggggacggtaacgggtaccggtaaccgg

SEQ ID NO: 247247 - DNA, 830 bp, Homo sapiens
  misc_feature: GYAE6OF02GTTFK.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtccgggcccaggactagtgaagccttcacacggccctgtccctcacctgcctacttcgtcctcgtgggtactacctcctatccgaaggtacggttcggttcccgtttaccctacgtcggtaacccgttgggtaaccttcccgggactaaccggttccccgggacccggggaacggtaaaacggggtaccgtaggggtaacttaacggtttacggttaacggggaaaccgttaagttacctaagtccggaccgtaaggggtccggggaacccctacctaacgttaccccgtaacccgtaacccccgtcccgtaagaaacggtcgtaccggacgttcgaacgtacgtagtcggtccaacggtaccgaacctccgtacccgaaccgtaaccgtccggtttaccctacccgtagtaaccgtaaggttacgtaacgttacttacgtacccggaccgtaccgacgaaccggtaacggacccggttaccggttagttaaactttcggtagtacggtacggaaggtacggtaccggtttacgtttaacggtttacggaccgtaacgttaccgttaaacttaaacccggttccgtaaaccggtttacgtccggttacggttaccggttcgggtacccgggtaaccggaccgggtaaccgtaacccggg

SEQ ID NO: 247248 - DNA, 644 bp, Homo sapiens
  misc_feature: GYAE6OF02IMN7G.9.70.G04.1.454.CMB.1.raw
  modified_base (235)..(235): a, c, t, g, unknown or other
  misc_feature (235)..(235): n is a, c, g, or t
  modified_base (338)..(338): a, c, t, g, unknown or other
  misc_feature (338)..(338): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgccactgtctctggtnactcatcagaggtggtcgttcctacgtggacctggactccggacacggtcccgccgggacgaaacggggtctagggagttagtagttagggaacgtaatctancgccaggtcgggaccgccactcctaaccaacccgttcccacgaagtacgtcgagtcacgctatcgtacagtaccgacaccgtacccacgaaacctcgttcctccctagacctagtcgtagttatacgtcgtacccgccgacgaacgtaccgaccgggtccgttagttacttacgtggtcggacgagtaggtacggtccgtttaagtttacggacctacgtacgttaaacgttaaacctccgttaaccggtaccgtcgttacgggaccggttcggtaccggggtaccgacggggtaaccctaacggg

SEQ ID NO: 247249 - DNA, 788 bp, Homo sapiens
  misc_feature: GYAE6OF02JV5S0.9.70.G04.1.454.CMB.1.raw
  modified_base (142)..(142): a, c, t, g, unknown or other
  misc_feature (142)..(142): n is a, c, g, or t
  modified_base (177)..(177): a, c, t, g, unknown or other
  misc_feature (177)..(177): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (410)..(410): a, c, t, g, unknown or other
  misc_feature (410)..(410): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagngtgggttcctcgtcccgaggtgcggctgcgagggnggtccgggcccgaggactagngaanccttcaacgcggccctgtccctcactgctactgtctcgtggtcacctccatcgaggtggttcggttccgttcctacgtcgaccgtggactccggngcgtccggccggagaaggacgtggtagtacgtagtaggaacaagttcctagacgtccggaggtcggacccgactacgtacctaacccgacccgctacgaaggtcgttaccggntacgagactacgtcgtacgccggtaacacccgaccgttaacccggacgtaacccgttacgtcccgtacccgttacgagtttaacgggtccgtttaaattcccgttacggttaaccggtacccccgggacgaaccggttacccgaaccgggtcccggttttacggttacgttttaccgttaaccggttcggtaacgggtacggtaaggggttaccgttaaccgggtttaaccgtttttaagttacccggaaacgttaccgggttttaaaccgttaaaaccccgttaaacccgtcggtttaaaccgttcccggggttaagaaccggttttccgggaacggtttaccggggggaacccggtaacggggtaaccctacccgg

SEQ ID NO: 247250 - DNA, 708 bp, Homo sapiens
  misc_feature: GYAE6OF02GP65X.9.70.G04.1.454.CMB.1.raw
  modified_base (161)..(161): a, c, t, g, unknown or other
  misc_feature (161)..(161): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctctggtgcagctcccagatgggtcctgtcccaggtgcggntgcaggagtccgggcccaggactaggtgaacgtccttcgacgacggccctggtcccctacaccgtgcctaccgttgtccttcgtaggttcgaccttccagtacgaaggtcgggttggttaccgttccctagtcggtaccctgggcctccggactacggtcccgcgggacgaaaggggtctaggggattaactggttacggaacgtataccttagcgtacccgagggtcggaccctacctaagttcccaaccgtaaccccgtcctacgaaacgtcggtacgtactacagctgtaggcctaggtacccacgcccgtacccacgaacctcgtttcctcccgtgaacgtaggtacgtagtactacgtaccgccgtaccgacgacgacgtcggtaccgttagttacttacgtcgtcgagacggtagtaccggttacgtttaggttaacgtaccgtaacggtacctttaaacggtaaaccttccgtaacgttcggtaccggttacggaaccggttccgggttacgggacccgggttaacggtaccgtaacccg

SEQ ID NO: 247251 - DNA, 797 bp, Homo sapiens
  misc_feature: GYAE6OF02JDITQ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctccagatggtcctgtcccgaggtgcggctgcgaggtacggtccgggcccaggactagtacgaacgtccttcacgacggtccctggtccctacgaccctgacacgtgtctacgtggtacactccatcgagtggtgtccgttctacgtcgacgtggactccggacaccggtcccggaccggacggaaggtaccgtggtaattacgttaggtacggtaacgtaacgttacttaaggtccgtacggtacgggtaccggacccgtactaacctaccgtaacccaaccccgtttcccgaactaacgggtacgtcgtagaccacgtaactgtcgtacgtacggacctacgaacccgtccgaaaaccgtaaccttccggttaccccacgttacgaaccgtagggttaacttaccgttaagtaccgggttacccgaacccggtccgaacggtaacccgtaaacccggtcccggtttcgtttaaaacggttcttaaccgggtcgggtaacgacgggttaaacggtccggttaacgttaccgttttaacggttaccgacctacggtttaaaccgttaaaccgtttaaccgttaccgttccgggttaaccgttcggttacggtttccggggtacggggtacccgggaaccggttacgggtaaccccggttaccgg

SEQ ID NO: 247252 - DNA, 692 bp, Homo sapiens
  misc_feature: GYAE6OF02GQQAS.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgccactgtctctggtcgactccatcagaggttgtcgttcctacgtggacctggtactccggcacggtccccgccgggacgaaacggggccttagggattacgttaacgtttagggaaccgaatcctaagtgacccgaggttcggggaccccaccagttcctaacccgaaccccgttccctagaaacgtcgtacgagtcgacggctagtcgtactaggtcccgaacctaaccggtacccgaacgtaaccctacgttcctccctacgacgtaggttacgtaacgttatacgttacgacccggaccgaccgacgaaccggtaccggtccgtaggtacttaacgttcgtacgtacgacgaggtacggtacgtttagtttaacggacctacggtacgttaacgttaaaaccttccgtaaccgttaccggttacgtacgggtacggttccggtcgggaccggtacgggacccgtaacggg

SEQ ID NO: 247253 - DNA, 759 bp, Homo sapiens
  misc_feature: GYAE6OF02GGB80.9.70.G04.1.454.CMB.1.raw
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctctcgtggtggcagctcccagattcgggtcctgtcccgaggtgcggctgcgaggacgtcgggccaggtactagtagaacgtccttcgacgacggtccctcgtcccctacgaccttcgacctacgttcgtcctcgtacgggtacacctccctagtacgaggtacgggtggttaccgtttcctacgtacggaccgtgtacgtccggtacncggtccgccgtacggacgggtatcggagttacgtagtacggacgtaacgtntaacgtcgacgtacgggtacgggaccgtacctacgtacccgtaaccgaacccccgttactaacccgtaagtaacggtcggtaacgtcgacgacgtacgtagtacgtacgtacccggactacccgtaccgtaaacgaaccttaccgttacccgtcctaacggtccgtagtttaacggttacgttaacgtaaacgttccgggaacccccgtcggtacgtaaccgggtaaccgtaaccgggttccgttaaacgttccgttttaacgccgttacgacggtacggtacgtaaccggttacgttaacgttacccggacgttacgtaacgttaaactaacgttccgtaagtcgtacgtcggacgttccggagggcttacggcgtaacg

SEQ ID NO: 247254 - DNA, 580 bp, Homo sapiens
  misc_feature: GYAE6OF02GLDH1.9.70.G04.1.454.CMB.1.raw
  modified_base (233)..(233): a, c, t, g, unknown or other
  misc_feature (233)..(233): n is a, c, g, or t
  modified_base (337)..(337): a, c, t, g, unknown or other
  misc_feature (337)..(337): n is a, c, g, or t
  modified_base (477)..(477): a, c, t, g, unknown or other
  misc_feature (477)..(477): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcaggaggtggtcgttcctactggacctggatccggcagtccgccggcaagggactgggagtatagttggaacgtaatctatcgccaggtcgggaccncgatcctaccaaccccgtccctacaaggcgtcgagtcaagctatgtcagtccgaaccaccgtcccacgaacctacgttcctccctgacagtgtagttatatcgaccgcgcacgacacggtccgtagtagttacgtgtcgngagacggtacggtacgttttaagtttacggacctgtacgtaaggttaaaacctcgtaacgttacgtacgtggacgttcggagggtccggacggggactaacgg

SEQ ID NO: 247255 - DNA, 775 bp, Homo sapiens
  misc_feature: GYAE6OF02HA15U.9.70.G04.1.454.CMB.1.raw
  modified_base (105)..(105): a, c, t, g, unknown or other
  misc_feature (105)..(105): n is a, c, g, or t
tcagtgatacgtctcacgaccggtgctcgatttagtgtagtgtgaagggaaagggcctgtgaaggcttcactagtcctggacctcctgtgcaagaacatgaaacntctgtgttcatcctcctctggtgcagctcccagtagtgggtcctgtccgtaggtgcggctgcaggcgtccggacccaggtactagtgaacgtccttcacgtacggtccctcgtccctacacctgcctacgtgtacctcgtaggtctactacctagtcgaaggtcggttcggttccgttacctacgtcggaccgtggtaccgtaccggtctaccggtccccggacggtaacgtaacgggtacgttacggtaacgttacgttaacggttacggaaacgttaaccttcgtaacgtccgtaaccggtagggtaccggaacccctacgtaacctacccgttaacccgtaaccccgttcccgtaagaaacggttcgtaccgtagtaccgtaagtaccgttacgtcgtaaccgacgtacccggtaaccctaccgtacccgaaaccgttaaacccgtcgtttacccctaccggtataaccggtaagttacgtaagttactaacggttcccgaaccgtcaaacgtaccgcgttacgggtactaggtttcacggtcgcgacggtagtacggtacgtttacgtttacgactacctaggttaacctaaaccggtttaacctacggttcgttccgtaaccggtcggtacggtccggaccgggacccgtaagggcctaaccggg

SEQ ID NO: 247256 - DNA, 591 bp, Homo sapiens
  misc_feature: GYAE6OF02JQ73Y.9.70.G04.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
  modified_base (520)..(520): a, c, t, g, unknown or other
  misc_feature (520)..(520): n is a, c, g, or t
tcagtgatacgtctcacgaccggtgctcgatttagtgtagtgtgaagggaaagggcctgtgaaggcttcgactagtcctggacctcctgtgcaagaacatgaaacatctgtggttcatccgtcctcctggtgcagctccagatggcctgtccctaggtgcggctgctaggatcgggcccaggacctagtgagccttnacaggtcctnccctacacctgcctactgtcactggtcactccgatcagngtgtctcatgacnggactcgctacgccgcggnaacggacgtgggatatagttagacgaattcgaagtgaccaggttcgggacctacggtacctccgtaccaacccggtctcctaaagcgggtaccctaacgccgtaaggtctaccttgcgtaaacgtcgaacaccgttacgacaacctgttcacccgtgacgaagtcagttacaatcggaaccncggnaaccgttcgacgtcgtggtactgtcnggactgacgtgtccttgtttaacccggacngtacttaacggtaaacctttcgacgttaacgtcgtttacgccgtttgaccgggtcgtagggtacccgaacg

SEQ ID NO: 247257 - DNA, 609 bp, Homo sapiens
  misc_feature: GYAE6OF02FFC7H.9.70.G04.1.454.CMB.1.raw
  modified_base (160)..(160): a, c, t, g, unknown or other
  misc_feature (160)..(160): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtncggctgcaggagtcgggcccaggactagtgaagccttcacaggccctgtccctcacctgcactgtctctggtgactccatcagaggtggttcttcctactggacctggacttccggcagtcccgccggcaagggctggatatattggacgaatctatcgccgagtcgggaccnccatctaccacccgtcctcaagngtcgagtcngcatgcacgtcgacaccgtccagaacctacgttcctccctgaccagtagacgttatagtcgacccgtccgaccagtaccgaccggcgttacgtacttaccgtgtcgacgagacgtacggtaccgtttagtttaaccgaccgtacgccgtttaaacggttaaaaccttcccgtaaaccgttacgggttaccgttacgggtacctaccgggttacgggacccggtacgggggaaccctaaccgggg

SEQ ID NO: 247258 - DNA, 959 bp, Homo sapiens
  misc_feature: GYAE6OF02G8XT8.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcgtggtggcagctcccagatgggtcctcgtcccgaggtgcggctgcgaggacggtccgggcccaggtactagtagaacgccttcaacgcggccctcgtccctcacctgactcttcgtctcgtggtacgactcactcgaggtaggttcggttccgtttcctacgtcggaccgttggacgtcccggacgtacggtcccgaccgggacggaacggtacgtaggtaacgttagttacgttacgggaacgaattacgtagtcggacccgtaaggggtaccgggaccccgtacgtaccgttaaccgtaacccgtaaccccccgtttaccccgtaaacgtaaacgggttcggttaacccgggttaaacgttacccggaaaccgtccgttaaacggtttccggtaaccgggtaccggttaaacccggaacccgtaaccccggtaacccccgtaaaccggtaaacccccggtttaacccgttttccccgtttaacccccgttaggtaaacccgttaggggtttaacggttaaacggtttttaaccgaacggttaccccgggtaaaccccggacccggtaacgaacccgggtaaacccggtacccggggtacccgtttaacggtttaaccggtttaccgggttcggtaaccggtaaccggggtaaagggttacccggggttaaaccgttttaccgggttttaaacggtttacccgggaaccgttaacggtaaccgtttaaaccggtttaaaacccgtttccggttaaccgttaccggttacggtaccgggttaccggttaccgggtacgggggtaaccggttaaccggggaacccgttaacccggg

SEQ ID NO: 247259 - DNA, 784 bp, Homo sapiens
  misc_feature: GYAE6OF02H407C.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccaggactagtgaagccttcacaggccctgtccctcacctgcactgtctctggtgacctccatcaggaggtgtacgttcctacgtcggacctggactccggacacggtcccgccggacgaaggggactagggtagtatacgttggaaccgtaatctaagtcgaccgaaggtcgggaccgcctaactcctaaaccaaccccgttccctaacgaagtacgtcgaagtcacgctaagtcgttacgacggtccgtaactacccggtacccgaacgtaacccgttacggttacccctacccgttacggaaaccgtcggtaggttaacgtttaaacgtaacgtaccggttacccggcccggaaccgtaaccggaaccggtaacccgggttcccggttaaggtttaaccgtttacgtcgggttacggaccggtaacgggtaacgggtaacggtttacccggttttaacgtttttaaccgggaccgttaaccgttaaccgtttaaaaccgtttaaaaacccgttacccggttaaaccgttacccggttacggtaaccgggtaccggttaccgggtacccggggtaccgggtaaccggggaacccgttaaccgggg

SEQ ID NO: 247260 - DNA, 771 bp, Homo sapiens
  misc_feature: GYAE6OF02G2Q4R.9.70.G04.1.454.CMB.1.raw
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (680)..(680): a, c, t, g, unknown or other
  misc_feature (680)..(680): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggaccaggactagtgaacgccttcaacgacggccctgtccctcaccgtgctacttgtcttcnggtacnctaccactacgaggtagggtcggttccgttccgtacgtcggacccgtggaaccgttccgggacgacggttcccgggaccgggacgtaaacggggacgttagggaagttaagttaacggtttacgggaacggtaacttcgttaacgtccggaccggtaacgggttccggggaaccccgtaccgtacttacctaaacccgtaaccccggtttccccaacgaaacgtcggttaccgtacggtaccgtaagggtactacgttacgacggttacggtacccggaacctacccggtaccgaaacggtaccttaccgtttaccccgtccgtacgagtaggtagttaacgttagacgttccgaccgcgtaacgagaccgtacggtctaaacgttcgtaacgtggtagaccgagggaacgtacgggttcgtttaacgttacgaccncgttaacgttaacggttaaacccttggtaacccgttacgtcgttaacgggtccgttaagggcccggtacggttaccggaaccgttaccggg

SEQ ID NO: 247261 - DNA, 776 bp, Homo sapiens
  misc_feature: GYAE6OF02GYCGH.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcacaggccctgtaccctcacctgccactgtctcgtggtcgacctccatcgaggtaggtcggttcgttcctacgtcggacctaggacgtccggctacggtcccgaccggacgaagggacgtaggagtatagtacggaacgtaactcgtactcgccgtacggtcgggaccgactaacgtacctaaccgtaaccccgtacccgactaaacggtcgtacggacgtacgacgtctaagtcgtaccaaggttaccgaacgtacccgtaaccccaacgtaaacccgtacggttccctaccccgttaggtaaacccgtaggttaagttaacgttaaacgttcgtaaccggtaccccgaccgaaccgtaacgacccggttacggacccggtttaagttaccttacggtcggtacggacgtaagggtaacggtaccggttacgttttaaacgtttaccggaccgtaacggttaaccgtttaaacggtttaaaaccgttacccgttaaccgttaaccgggttacggttaacggtacgggtttacccgggtaccggggaaccgggttacccgggtaaacggtaacccggg

SEQ ID NO: 247262 - DNA, 1082 bp, Homo sapiens
  misc_feature: GYAE6OF02G2ZQO.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccagttgcgctgcaggagtcgggcccaggactagtgaagccttcacgacggccctggtcccctcacctgcacttcgtctcgtggtcactccatacaggaggttcggtcgttcctacgtggaccttggactcccggctaacggtcccggaccggacgaaaggggtaccgtagggtaacgtaattacgttacggggaaccgttaacgttccgttaagtccggtacccgtaaggggttaccgggggaccccgtacccctaaggttaaccccgttaaaccccgaaaaccccccggtttcccctaaccggtaaaacgggttaccggtaccggtaaacggttccgtaacggtaaccgttaaggttaccgtacggtaaccgggtttaccccgtaacgttaacccccggttaccccctaaaaacgggtaaaccccgtttaccggtttttacccccttaaccccccgggtaaggttaaacccgttaacgggtttaccgtttaaaaaccgggtttttaacgttaacccggttaaccccgggtaaccccccggtaacccgggttaccgtaaaaaacccggggttacccccggtaaaccccggggggttttacccgttttaaccggttttaaacccggttttacccgggtttagggttaacccgggggttaaaaccggggaaaccgggtttaaaccgggggttaacccggggttttaaaccccgggttttttttaaaggttttaaaccccgggggaacccctttaacgggtttaaaccggttttaaaaacccggttttaaaaacccccttccggttttaaaacccgggtttaacccggggtttacccggttaaacgggggtttaccccggggtttaccggggttacccgggggggtaaaccccggtaaccgggggggttaaaaccccccttaaacccggggg

SEQ ID NO: 247263 - DNA, 723 bp, Homo sapiens
  misc_feature: GYAE6OF02IDMKH.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcgcgtgcaggagtcggcccaggactagtgaagccttcacacggcctgccctcacctgcactgtctcgtgtgacctcatcgagtaggtgtcgttacctacgtggacctggtacgtccggcgacgtccgaccggacgaaacgggtactggaacgttaagttacgttacgggaacgtaaacttcgtacgtcggaccgtagggtacgggacccgacctaacgtaccgtaaacctaaccccggtccctacgaaagcggttaccgagttaccaagtcgtaactggtaccgacgtaccgaaccgtaccgtacccgaaacgtaacccgtatttaccctcgtacgaagtacgtagtacgtttataacgttaccgaaccgccggtacagtaacccgtacggtaccgttcgttaacgttacgtagttcggacgtaacggacggtacggtaaccgttttaagtttaaccgaccgttaaggtaacgttaacgtttaaaacctcccggtaaccgttaacggtccgtacggtaccggttaccgggtacggggaccgtaacggggaccgttaacccggg

SEQ ID NO: 247264 - DNA, 676 bp, Homo sapiens
  misc_feature: GYAE6OF02FUVQ8.9.70.G04.1.454.CMB.1.raw
  modified_base (330)..(330): a, c, t, g, unknown or other
  misc_feature (330)..(330): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagattgggtcctgtcccaggtgcggctgcaggagtcgggcccaggactagtgaagccttcacaggccctgtccctcacctgcactgtctctggtgacctccatcagaggtgtcttccactgacctgactcggcagtcccgcggcgaaggcgtggagtatagttggacaatctatgaccgaggtcgggaccncctatcctaaccaccccgtccctacaaggtacgtcgaacgtctacggacagttacgtccaggtaccgaactacccgtcccgaaagtaaacccgacgtttccctccccgtaaggacctaggttacgttaacggttattaccgtcgaaccccgccgacgtaacgcggtaaccgggccgttagttaacgttacggtgttacggacgtaaggtaacggtacggtttacggtttaacgttacgggtaccctaggtacctttaaacggttaaaaccttcccgttaaaccggtttacgtcgtacgggttaccgttccgggtaacgggggtaccgacggggttaccctaacggg

SEQ ID NO: 247265 - DNA, 730 bp, Homo sapiens
  misc_feature: GYAE6OF02IHQZ3.9.70.G04.1.454.CMB.1.raw
  modified_base (426)..(426): a, c, t, g, unknown or other
  misc_feature (426)..(426): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctctggtgcagctccagatgggtcctgtcccaggtgccggctgcaggacgtccgggacccaggactagtagacgccttcacacggcccttgtcccctcaccgtcgactactgtcctcgtggtacgccttaccacttcgaaggtaggttccgttccgtttacctcgtccggacctggaccgtccggacgtcggtcccggacgggacgaacgggtcgtaggtacgttattacgttagggaactacttactagcggtaccgtaacggccgggacctacgtaccttaccgaacctaaccccgtccctaanacggtacgtcgtagaccagactacgtcgtacgacgtaccgaccgttaacccgaccaacggtaaaccctccgttacctaccgtggtaccagttacggttaatttagtacgtcccgacggctaccgaacccggtccggaccggttccgttagtaaccgttaggttccgagacggtacgacggtaggtttacccttttaagtccgaacgttagtaacccgttttaagttaaaccctccggtaaaccgtttcgtcggttaacggtcgggttaccggtacggggacccggtaacggggtcctaaccggg

SEQ ID NO: 247266 - DNA, 785 bp, Homo sapiens
  misc_feature: GYAE6OF02G2GZ1.9.70.G04.1.454.CMB.1.raw
  modified_base (530)..(530): a, c, t, g, unknown or other
  misc_feature (530)..(530): n is a, c, g, or t
  modified_base (575)..(575): a, c, t, g, unknown or other
  misc_feature (575)..(575): n is a, c, g, or t
tcagtgatacgtctcacgaccggtgctcgatttagtgtagtgtgaagggaaagggcctgtgaaggcttcactagtcctggacctcctgtgcaagaaacatgaaacatctgtgttcatcctcctctggtgcagctcccagatgggtcctgtcccaggtgcggctgcaggagtccggaccaggctacgtagaacgccttcaccacggtccctcgtccctacaccgtgacacgtcgtcctcgttggtcacctccagtacagggtaggttcggtaccttaccgtaacttcggaccttaggctaccggctacggtccggaccggacggtaagggtaactacggggattacgttacggtcggaacgtaattccgttaagtcccggtaacgtacggggttcccggggtaaccctccccggtaacttaccgtaaccccgtaaccccgttccgtaacgaaacgggtccttacgacgttcaacgctacgttcggacctacggtacctacctaccggtacccaaacgtacctacgtttccncccgttaagaccgtagttagtacgttaacgtactaccggtacccncggtaacgaacgaccggtacgggttacgttcgttacgttacgtcgggaaggtaccgaaagtcggggttaaccgtttacggttttacgtaccgggtaccgttaggtaaaccggtttaaaccgttaaacccgttaccggttaaaccggttccgttacgtacgggttaccggtacggggttacccggacgggtacggggtacccttaaccggg

SEQ ID NO: 247267 - DNA, 788 bp, Homo sapiens
  misc_feature: GYAE6OF02I3C7Q.9.70.G04.1.454.CMB.1.raw
  modified_base (166)..(166): a, c, t, g, unknown or other
  misc_feature (166)..(166): n is a, c, g, or t
  modified_base (381)..(381): a, c, t, g, unknown or other
  misc_feature (381)..(381): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagagtgggtcctcgtcccaggtggcgntgcaggagtcggccaggactagtcgaagccttcacgacggccctcgtccctcacctgcactgtctcgtggtcgactaccatacgaggtacggttcgttccgttacctacgcggtaaccgtggtaccgtccggaccgtacgggtcccggaccgggaacggaagggttaccggtagggtaagtttacggtagttacggggaaccgtaagtcgttacncggtaccgtaacgggttcggaaccctccgtaacttaccgtaaaccccgtacccgtaccctaacgtaaaggacggttacggagtacgacgtacgtatcgtacgacgtacccgaacccacggtaccccaaaccgaacccgtgtttaccccgtaaccgttcggaaaccgtggtaacggttaagttaccgtacgtacggcccgtcccgtaagacccgtaccgtaccgggacttttagacctttcggtaccgtggaaccgggactaagggtaccggtttacttttaacgttaaccggccgttaaggttaaactttaaacggtttaaacccttacgttaaccgttaccggttaccgttaaggtacccggtaccggggtacggggaacccggtaacgggaaccgttaacccggg

SEQ ID NO: 247268 - DNA, 873 bp, Homo sapiens
  misc_feature: GYAE6OF02FKVDR.9.70.G04.1.454.CMB.1.raw
  modified_base (235)..(235): a, c, t, g, unknown or other
  misc_feature (235)..(235): n is a, c, g, or t
tcagtgatacgtctcacgaccggtgctcgatttagtgtagtgtgaagggaagggcctgtgaaggcttcactagtcctggacctcctgtgcaagaacatgaaacatctgtggttcatcctcctcctggtggcagctcccagatggtcctgtcccaggtgcggctgcaggagtcgggcccaggactagtgaacgccttcacaggccctgtccctcacctcgcactgtcctctggtcncctccatccaggtacggtcggtaccgtttccctacgttcggacccttggacttccccggggctacggttcccccggccggaccgaaacggtaacgtcgggtaacgttaattagtttacgggaactaaactttccgttaagttcgaccccgtaggtttacccggggacccgtaccctacgttacccgtaaccccgaacccccggtttccctaaccggtaaacgtccggtaccgaaccgttacgaccggtactaacgttggtacccgtaggttacccgtaaccgtaaccccggttacccccaagtaaaccccggtactttacccccgttaccccttacggtaaaccgtacggttacggtaacgttttaacgttaacccggttcccggtaacccggcccgaccgtaacgaacccgaccgggtacccgttacgttaacgttaaccgttcggttacggaaccggttaacggaaggtaccgggtttaaccgttttaaccgggttttaccggacccgttaacggtacgttttaaaaccggtttaaaacccgtacccgtttaaccggttaacccggttggttaaccggtacccgggttacggttacccgggggaacccggtaacgggggtaccccgttaacccggg

SEQ ID NO: 247269 - DNA, 731 bp, Homo sapiens
  misc_feature: GYAE6OF02GWU1E.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatcgggtcctgtcccgaggtcgcggctgcaggagtcgggcccaggactagtcgaagtccttcacgacggtcccctggttacccctcaccgttgaccacgttgtctcgtaggtcgactcctatcgagtaggttcggtccttacctacgtggaccttaggactccggactacgttccggccgtagaacgggtctaggatagtagttacggaacgtaatctagtcgaccgagggttacggacccaccgtataccctaacccggtaccccgtcctacgtaaggtacgtccgtacggtcacggaccttgtacggtacacggtacaccgtaccgtacccgaacgtaaccgtcgtttacccgtaccctaggaacccgttagttaccggttaaatacgtttaccgacggtacccgaccgttaccgacgtacccggtaacgtccgttaaggttaccttacggtgttacggaccggttagaaccgggttacgttaccgtttaagttacggaccgtagttaccgtaacgttaaacgtcccgttaacgtaccggttaccgtaggtccggttaccggtacgggtaccgaacgggtcctaacgg

SEQ ID NO: 247270 - DNA, 719 bp, Homo sapiens
  misc_feature: GYAE6OF02F45Z7.9.70.G04.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttnacaggccctgtccctcacctgcactgtctacgtggtnactccatcaagtggtggtccttcctactggacctggtacgtccggcacggtcccggccggtacgaagggtactacggagttataggttacggaacgtaatcgtagtgcccgtagggtaccggaccgcctaacgttcctaaacccgtaaccccgtccctacgaaacgggtcgttacggagttacgaacggtactaagttcgggtaacctaggtacccgaaacgttaccccgtacccgtaaaccggtaaacccgtaaccgttccgtacccgtacggtaaccgtaaggttacgtagttactacgtcgaccgtaccgacgacgaccgacggtccgttagtacttacgtgtcggtacgacgtaacggtcggttaccggtttagttacggtaccgtaacgtacgttaacggttaaaaccttcccgtaacggttacggtacggttacggtaccggttacggtacggggtaccggtacggaccggtaaccgg

SEQ ID NO: 247271 - DNA, 835 bp, Homo sapiens
  misc_feature: GYAE6OF02HJTSJ.9.70.G04.1.454.CMB.1.raw
  modified_base (654)..(654): a, c, t, g, unknown or other
  misc_feature (654)..(654): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagcctcccagtatgggttcctcgtcccgagggttgcgggctgccgaggtacggtccgggacccgaggtaacgtagtaggaacgtccttaccacgacggcccttcgtccctacacctgactctcgtctcggtacgtcgtaccgtccactacgtaagggtggttcggtttaccgtttacccgtacggttaccggtaaccggtacgggtccgttaccccgggactacccgggtcccgggaccccgggaacgggttaaacgggggaccttaggtaaaccgttaggttaacgttaacgggaactaacgtttacgtacgtaccggtaccgtacggggtaccggacccgtaccgtaccgttaaaccccgttaaacccccggaccccgtttacccgtaaccggtaaaacggtcggttaaccggaactaccggacgtacgttaagttcctacggtacccgtaacggaccccgttaccgtaaccgaaacgtaccgttacgccccttacgagtaccgtagtacgttatacgttntacggcccgtacgccgtaacgccgtaacgggtaccgttagttttaaccgtcgtaggtccgagttacggggtaccgggtaaggttcgttttaaggtcggtacctacggttaattaaccgttaccctagtaccgtaacggtcgtacggtccgggtacgtaccggggccgtaggacccgtacgg

SEQ ID NO: 247272 - DNA, 730 bp, Homo sapiens
  misc_feature: GYAE6OF02GESGG.9.70.G04.1.454.CMB.1.raw
tcagtgatacgtctcacgaccggtgctcgatttagtgtagtgtgaagggaaaggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagtccttcacaggccctgtccctcacctgcactgtcctcgtggtcgacctccatcaggaggttcgtccgttcctactcggacctggactccggctacggtcccgccggacgaaggggtcctagggagttattacgttggaacgtaatctatcgccgaggtcgggaccgccagtcctaacccaaccccgtcctacgaaagtcgtcgtagtcacggtcctagttcgtacgtacgtacccgaccgtacccgtaccccgaaacgtaaccgtaccgttaccccgttcccgtacgtaccgtaggttacgtaacgtttaactggttaccggaccccgccgaccgaacgtacccgtaccgggtccgttacggttaacttaccgttggtacgggacggtaaacgggtacggtaaccgggtttaccgtttaaacgttttaccggacccgtaggtaaccgtttaaaccggtttaaaaccttcccggttaacgttaccgggttacgtacggtacggtttccgggaccggggtacggacgggaccgtaaccgg

SEQ ID NO: 247273 - DNA, 692 bp, Homo sapiens
  misc_feature: GYAE6OF02F3W0Y.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtcactccatcagtaggtgtccgttcctacgtcggtacctggacgtccggctacgtcccggccggacgaagggactagggacgttagtagttcggaacgtaattcgtaatcggccgtaggtccgggaccgacctatccctaaccctacccccgttcctacgaacgtcgtacgacgtcgacgtctaagtcgtaccgaggtaccgaaccgtaccgtaccccaaaggtaaccctccggtttaccctacccgtagtaaccgtagtgtaacgttaactacgttccggacccgtccgacaccgaccggtaccgggtcgttaggtaactttaccggtgtcgacggaagtaacggtacggttacctttaagtttaccggacctaaggttacgttaaacgttaaacccttccgttaacggtacggttccgtacggtacgtcgggtacgggacggtaccggtacgtaccgg

SEQ ID NO: 247274 - DNA, 641 bp, Homo sapiens
  misc_feature: GYAE6OF02F8W8H.9.70.G04.1.454.CMB.1.raw
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagtaggtgtcgttcctacgtggacctggactccggnacggtccgccggacgaaggctggactatgttggaacatctancgcagtcggaccncatctaccaccgtcctnaagtcgtcgatcagcatgacagtaccactaccgccgaacgaacctacgtttccctacccgtacgaccgtagttagtacgttaagtacgttaccgacccgtccgacgaacgaccgaccgggtccgttagttactttacgtaggtcgtacggaggtacggtacgggttacgttttaagtttaccggacctacggtaccgtttaaacgttaaaacccttcccgttaaccgttacccggttgttaccggtaccggttaccggtacggggacccggtaacggggaccgttaaaccggg

SEQ ID NO: 247275 - DNA, 739 bp, Homo sapiens
  misc_feature: GYAE6OF02FHQZJ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttccactggacctggacttccggcacgtccgaccggacgtaacgggactgggacgttataagtttcggaaccgaaatccgtaagtcaccgaggttcgggacccgtccatacctaccaacccgtccctacgaagcgttaccgagtcaagcattcgtacgacggttaccgacgtaccgtacccaacgtaaccctacgttcctaccccgtagaccgtacgttacggaacgttaacgtacgttacggacccgtacccgacgaacgtaccggtacccgggtacccgttagttaacctttacgtcgggttaacggtaccgggaaggtaacggtaacgggttaccggttttaacgttttttaaccgggaccttaacggtaccgtttaaacggttaaaaacctttacccggttaaaccgttaacggttacggttacgggtaccggttaccgggttaccgggggaaccggtaacggggacccggttaaacccgggg

SEQ ID NO: 247276 - DNA, 893 bp, Homo sapiens
  misc_feature: GYAE6OF02HVGYN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatcgggtcctgtcccaggtgcggctgcaggagtcgggccaggactagtgaagccttcacacggccctcgtccctcacctgcaccttgtcttcgtggtacgacctccatcgaaggtgggttggttccgtttacccttacgtccgggtacctgggacgttccggacgtacggtccccggccgggacggaaaggggtacgtagggaagttagttaaggttagggaaaccgtaattccgtagtcgaccgaacgggtcgggacccgcctagttaccctaaaccgaccccgttcctaacgaacgtacggtaccgaacgtcaacggacctagtcgttacgaacggtacccgaaccgtacccgtaacccaacggtaaaacccctttcggttttaccccttacccccgtagggaaccgtaaagggttacgtaaccgtttttaaagtaccggttacccgggaccccggacccttacggaaaccggtacccggtacccggggtttacgttaagtttaacgtttacccgttagggtaacggtacggtaagggtaaccgggtttacccggttaacccgggttttttttaaagttacccggggtaacccctacgtttaaaccgggttttaaaacctttttaaaaccccgtaccggtttaaccgttttaacccggggttacggtttaacccgggggtcccggttttaacccgggggaacccggggggtttaacccccggaaggggggttaccccctaaacccggggg

SEQ ID NO: 247277 - DNA, 667 bp, Homo sapiens
  misc_feature: GYAE6OF02FJQV4.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcactccatcagaggtcgtcgttcctacgtggacctggactccggcacgtccgccggacgaagggactgggagtatagttcggactaagtctaatcggcctaggtcgggaccgtccaattccgtaaccaaccccgtccctagaacgtcgtacgacgtcaagctagtcgtacagtccgaacaccgtcccaacgaacccgtagttccctacccgtacgacgtagtacgtaagttatagtccggaaccgtccgacgacgaaccgtaccgggtaccgttagtaacgttaccgtggtacgacggtaacggtaacggtacggttaccgtttaacgtttacggaccgtacggtaccgttaacgttaaaaccctccgttaacgttaccgttacggtacggtaccggttacggtacgggacccgggtacgggaaccgtaaccggg

SEQ ID NO: 247278 - DNA, 883 bp, Homo sapiens
  misc_feature: GYAE6OF02I247L.9.70.G04.1.454.CMB.1.raw
  modified_base (444)..(444): a, c, t, g, unknown or other
  misc_feature (444)..(444): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacgacggccctgtccctcaccgtgcactcgtctcgtacggtcacctccatcgaggtaggtcgtcttcctacgtcggactggacgtccggcgtacgtccggccggagaacgggtctagggtaagttagttacgttacggaacgtaatcgttaagtccgacgtagggtaaccgggtcccaccgtacttaccgtaaccccgtaaccccggttacccctaacggtaacggtacgtaccgtaacggtaaccncggtaacctggtttactaccggttaacggtaccgaacccgtaccggttaccccgtaaacgaaaaccccgtttcgtttccccgtacccgtaggtaaaccgtagggttacgttaacgtttaacgttaacgggtacccggtaaaccccggtcccgaacgtaaaccgggtaaccccgtaaaccgggggtttccccgtttaaaggtttaaccccgttttaccgggagggttaccccgggtaagggtaacgggttaagggtaaacccccggttttaacgggtttttaaacgttaccggggaaccttaaccggtttaaccgtttaaaagtttaaacccccggttccggtttaaacccgggttaaccggtttcgtaaccgggggttccccgttaaccggggtaccggggtacccggggtaaacccgggtaaccccggtttaaccggg

SEQ ID NO: 247279 - DNA, 690 bp, Homo sapiens
  misc_feature: GYAE6OF02F2933.9.70.G04.1.454.CMB.1.raw
  modified_base (333)..(333): a, c, t, g, unknown or other
  misc_feature (333)..(333): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgaggccctgtaccctcacctgccactgtctctggtcactccatcgagtagggttcggtacttcctacgtggacctgggactccggcacgtccggcgacgaagggctggagttatagttcggacgtaatctaancgccaggtcggaccgctaacgtcctaaaccgtaccccgtccctaagaaggtacgtacggtagccagacctagtacgtccgtaaggtacccgaaacctccggtacccaacgtaaaccctacggtttccctccgtacggactaacggttcgtaacttacgtacttaccggaccgccgttacgaacgaccggtaccggtaccggttagttacgttaaccgtggttaccgaacggtagaacgggtacggtaaccgtttaacggtttaccgactacggttacttaaacgttaaaccttaccgtacgttaccgtacggtaccggcggttacggtaccgggaccggtacggacccggtaaccgg

SEQ ID NO: 247280 - DNA, 724 bp, Homo sapiens
  misc_feature: GYAE6OF02I8XVU.9.70.G04.1.454.CMB.1.raw
  modified_base (105)..(105): a, c, t, g, unknown or other
  misc_feature (105)..(105): n is a, c, g, or t
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagtgatacgtctcacgaccggtgctcgatttagtgtagtgtgaagggaaagggcctgtgaaggcttcactagtcctggacctcctgtgcaagaacatgaaacntctgtggttcatcctcctctggtggcagctcccagagtggtcctgtcccaggtgcggctgcaggagtccgggcccagggacttaggtgaagtcccttcaacgcggcccttgtcccctnacctgccactgtctcgtgtcgactcactnaggaggtcgtcgttccacgttggacccgtggtacctccggactacggtcccggcccggagtaacgggtcctaggaacgttactaggttacggaactaagtcttacgagtccgnggtacgggaccctcgactaccgtaccaccccgttccagaacgtcgtcgagtcngaacgtnacgttccaggtaccacgtaccgaccgaacgtaccctagttcccgtaccctaggtacctagtacggttaagttacgtcgtacccggtaccggacccgtaaccgacgaaccggacccgggtttacacgtttaacttcccggttagcggttacgacgggtaacggccgttttaaaccgttttagtaagtacccgttagtaacccggttaaacgttaaacccgttcggttaaacccgttacgggttccgtaacggttaccggtaccggtacccgggtacgggaaccgggttaaccgtcccggg

SEQ ID NO: 247281 - DNA, 683 bp, Homo sapiens
  misc_feature: GYAE6OF02IDTP2.9.70.G04.1.454.CMB.1.raw
  modified_base (416)..(416): a, c, t, g, unknown or other
  misc_feature (416)..(416): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtgcagctcccagatgggtccctgtcccaggtgcggctgcgaggagtccgggcccaggtactaggtcgaagtccttcacgacggccctgtccctcacctgcctactcgtctcgtggtactacctccatcaggtagttcggtccttctacgtcgtacgtcgggacttccggctacggtccgccgggacgtaaggggtactgggtacgttagtagtggtaacgatttacgtatcggaccagggtccggacctcgacttccacgtaccccgtccgagaacggtgacgtagtanacggctagtcgtacgacgtccggaacgacccgtacccaacgtaacctcgttaccctaccgtcacgtacgtagttacgttactaggcccgtaccgaccgacgacgcgtacgacgttacgttaagttcgtcgtcggacgtaacgtagtacggtttcgtttaagttacggtacctaacggttacgttaaaccgttaaaccgttccgttaacccgtacgtttacgtcgggttaaccggtcggtaccgggtcgggtacgggtaccggtaccg

SEQ ID NO: 247282 - DNA, 930 bp, Homo sapiens
  misc_feature: GYAE6OF02IQV0G.9.70.G04.1.454.CMB.1.raw
  modified_base (236)..(236): a, c, t, g, unknown or other
  misc_feature (236)..(236): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcgacgggccctgtccctcacctgcactgtctcgtggtnacctccatcaggaggttcggtccgttcctacgtcggtaccctggacgtcccgggactacggtccccggccggacgaaacgggtccgtagggaacgtttaacgttaggtttacgggaaacggtaaactttccgttaaggtccggtacccggtaagggttcccgggggaaccccgtacctaacgttaccccgttaaacccgtaaccccccccggtttaccctaaccggaaacgggtaccggttacccggtaacgttacccggaagtaccttaacggtttcgggtacccgtaaaccgggttacccggtaaacccgttaaccccggttaaccccgtaaaccgggtaaacccccgtttaacgggttttacccccgtttacccccggtacggtaaacccggtaaggtttaccgggttaaagttttaacgttaacggtcccggtaaaccccgggtacccgtacccggaaacggtaaccccgggtacccgggttaccggtttaacggttaaccgtttacggttacggtaccgggaccggtaacgggtacggtaccggggttttaaccgttttaaacggttttaccggaaccgttacgttaaccgttaaaccgtttaaaacccgtcccgttaacgttccggttaccgtacgggttaccgtcgggttaccggggacccggtaacggggtaccctaacggtcccg

SEQ ID NO: 247283 - DNA, 700 bp, Homo sapiens
  misc_feature: GYAE6OF02IQ7K9.9.70.G04.1.454.CMB.1.raw
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
  modified_base (593)..(593): a, c, t, g, unknown or other
  misc_feature (593)..(593): n is a, c, g, or t
tcagtgatacgtctcacgaccggtgctcgatttagtgtagtgtgaagggaaagggcctgtgaatgcttcactagtcctggacctcctgtgcaaagaacatagaaactatctgtggttcatcctcctccgtggtggcacgctcccagtagtgggtcctcgtcccgaggtgccggctggcgaggtacggtccgggacccgaggtactagtagaacgtccttacacgacgtcctcgtccctcacctcgctactcgtcctgtgtnactcatcgagtaggtcgttccgttccgtcgtcggacctggacgtccggngtacggtccggaccggacgaaacggcgtagtacgttagtagttacggaactacgtcgtagtcgtaccgtagggtaccggtaccgacctacgtacctaacccgtaaccccgtcctaacgaacgtacgtccgtaagtacgacgtacgtacgtacgtacgtaaccgtccgacctacccgtacgaaaccgtaacctttcgtccctaccgactacggtagtaacgtaagttactacgtaccgacccgaccgacgaaccggaactccggtacttacgtacgtttaccgngtacgaagacggagtaccggtacgtttagtacggtactacgtaactaaaccgtaacttacccgtaggtacgtgtacggacgttcgggacggtaccggacggtaaccg

SEQ ID NO: 247284 - DNA, 720 bp, Homo sapiens
  misc_feature: GYAE6OF02IWTO3.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagcctcccagatgggtcctgtcccgagggtcgcggctgacgagggacgtccgggcccaggactaggtgaagtcccttcacgacggtcccttgtcccctcacctgccacttgtcctcgttgggtcacctcctatcgaggtaggttggtccgtttccacgtcggtaccgtggacgtccggacaccggtccggacggtacgaacgggtactggaagtctaggttcgaactaatccagtcggcctagggtccggaccgtctaacgtcctaaccgacccgttcccgactaaaggtcgtcgaacgtcaggtcctagtcgtaccgacggaccgtaaccgaccgtacccaacgtaaccgttcgttaccctccggtacgtacgtacggttagtattaacgtaggtaccgtaccggacccgtagacaccggacggtcgttaagttaacgtttcgaggtcggaccgtaaggtacggtacgttaccggtttaacgttaacgggctaacggtaacgttaaaccgtaaacttccgtaaccgtttaaccggtcggtaaccggtccggttcggaccggggtaaccgaccgggtacgtaacccgg

SEQ ID NO: 247285 - DNA, 618 bp, Homo sapiens
  misc_feature: GYAE6OF02GM4DM.9.70.G04.1.454.CMB.1.raw
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (495)..(495): a, c, t, g, unknown or other
  misc_feature (495)..(495): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggccaggactagtgaagccttcacaggccctgtccctcacctgccactgtctctgtcgactccatcagaggtgtcttcctacgtgacctggatccgntacgtcgccggngaaggctggacgtatagttggacgtaatntagtcgccaggtcgggaccncgtatccaaccgtacccgtcctacaagtacggtcgacgtcaagctaagtcgtacacggtccgaacgtacccgtacccgtaacgtaaacccgtacgtttaccctaccccgtagaccgtaggtacgtagttactacgtacgaccgacgcacgtacgcggtacgtntacttacgtgtcgacgagacgtaggtaccgtttagttacgaccgtagtacgttacttaaaccgttcgtaaccgtacggtaccgttacggacggtccgtaccgggccggtacgggacgtaacgg

SEQ ID NO: 247286 - DNA, 861 bp, Homo sapiens
  misc_feature: GYAE6OF02I4N0K.9.70.G04.1.454.CMB.1.raw
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatggggtcctgtcccaggtgcggctgcaggagtcgggcccaggactagtgaagccttcacaggcctgtccctcacctgcactgtctctggtcgactccatcagaggtcggtcgttacctactggacctggtacttccggcacgtccgccggacgacggacgtcggtagtatagttaggacgtaatctagtgacctaggtcgggaccnccgtacgtactaaccgtaacccccgtcccgtaccgaaagacggttcgacgttacggacgacgtaacgttcggtaccgtacgtaacccgggtaaccgtaacccgttaccccggtaacgtaaaaccccgtaacggttttaccccgttaccccgttaccgtaaccgtaccgggttacggttaaacggtttaacgtttaacgttaacggttaaccccgggacccggttaccgaaccgtaaacccggaaccgggttacccggttaacggtttaacccgttttaaaccgttcgtttaccgggacggttaacgggaacggtaaccgggtttaaccgtttaacggtttttaaccgggtacccggtaacggtaacccggttttaaacggtttaaaaaacccccgtttcgttaaaccccgttacccgggtttaacccggtttaccggggttaaccgggttttacccggggttaacccgggggtaccccgggttaacgggggtaacccggtttaaaccccgggg

SEQ ID NO: 247287 - DNA, 850 bp, Homo sapiens
  misc_feature: GYAE6OF02I5LN1.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctcccagatgggtcctgtcccaggtgcggctgcgaggaggtccgggcccaggactagtgaagccttcacgacggccctgtacccctcacctgctactcgtctcgtggtcgacctccatcgagtaggttcggtccttacctacgtcggaccgtggacgtccggctacggtcccggccggacgaacgggtctagggtaacgttagttaggttacggaacgtaattcgtagtcggaaccgtacgggtaccgggacccgtaccacgttccctaaaccccgtaaccccgtcccgtacgaaacggccggttcggtaaacgtcggaagtaccgtaagttcggtacctaacggttcccgaaaccgtacccgggttacccgaaaccgttaaccgtacccgtttcccgtaccccgttaagaaccgtaacgtttaggtaaacctttacgtaacggttaccggaccccgttaccggaaccgtacgtaccccgggtaccggtacggttttacgttaaccgtttaccgtggggtaacctacggggtaagttaccgggtaccggttttaaccggttttaggttttacccgaaccgtaacggtttaaccgtttaaaccgggtttaaaacccttaccggtaaaccggtttacccgggttaggttaacccggggtacccgtttcggggggaacccggtacccggggtaaacccggttaccggttaaaccccgggg

SEQ ID NO: 247288 - DNA, 787 bp, Homo sapiens
  misc_feature: GYAE6OF02JGXAS.9.70.G04.1.454.CMB.1.raw
  modified_base (170)..(170): a, c, t, g, unknown or other
  misc_feature (170)..(170): n is a, c, g, or t
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggngtcgggcccaggactagtgaagccttnacaggccctgtccctcacctgcactgtctcnggtnacctccatcaggtaggtcgtcgttcctacgtcggaccttggactcccggtacacggtccccggccggacgaaggggtacctgggtagttacgttagttacgggaacgtaacgttccgtaagtcgaccccgtaagggtccggggaaccctccgtaagttcccgtaaacccgaaccccccggtttcccaacgggtaaaaacgggtacggtttcccgggaacggttacccgttaagggaccctaaggtttcccggtaacgtaaccggggttacccgaaacccgttacccgttaaccccgtaaaccgggaaacccttaacgtttaccccgttcccgtacgtaaccgtaacggttacgtaacgtttaacgtacgttacggaccggtaccgtaccgacgtaccgacggtccgtacgttacgttaacgttgtacgtacgtaacgtacggtacggtaaccgttagtttacggtacgtacgtacgttaacgttaaaccgttccgtaacgttaccgtacgttacggtaccgtacggtcgggaaccggtacgggtaaccgtaccgg

SEQ ID NO: 247289 - DNA, 885 bp, Homo sapiens
  misc_feature: GYAE6OF02I0AOR.9.70.G04.1.454.CMB.1.raw
tcagtgatacgtctcacgaccggtgctcgatttagtgtagtgtgaagggaaagggccgtgtgaaggcttcactagtcctggacctcctgtgcaagaacatgaaacagtctgtggttcactcctcctccgtggtggcacgcctacccagatgggtcctgtcccaggtgacggctgcaggacgtccgggacccaggactaggtacggaacgtccgttacacgacggccccttacgttcccctacaccgttgacctactcggtcctcgtggtacgtacctccctataccgaaggtacgggttcggttacccgtttaccctaacgtcgggtaacccgttacgggtaccgtcccggaccgtaaccgggtccccggaccccgggaaccgggaaacggggttaacccgttagggtaaaggtttacttaacggttaccggggtaaaaccgtaaacgtttccgtaaagtccggaccccgttaacgggggtttcggggaaaccccctcctaaaccggtttacccgaaacccccgtaacccccgttacccgaacgtaaaacggccgggttaccgtaaccggttaccgaacggttaccagggttcgaacccgtacggtacccgtaacccgtaacccggttaccccaaaacggtacccttaccgttccctacccgtaggaacccgttagttacgtaagtttacgtcgttacgacccgtcccgagtaccgaccgccggtacggttactaacgtttcgacggtgaccgaacggtacggtaccggtttacgtttactttaccggaaccgtagtaccctttaaaacggttaacccttaccgttaacggtccggttacgtaccggtccgttacgggcccggaccggacggtaacccgtaccgg

SEQ ID NO: 247290 - DNA, 755 bp, Homo sapiens
  misc_feature: GYAE6OF02I0OS7.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctctggtggcagctcccagatgggtcctgtcccaggtgcggctgcaggagtccgggcccaggactagtgaacgtccttcacaggccctgtccctcacctgcacttgtctcgtggtcgacctccatcgagagggttcgttccgttcctacgtcggacctggacgtccggcacggtcccggaccggacgaaaggggtccttagggtaacgttacttaaggttcgggaaaccgtaattccgtaagccgtaccggtagggttacggggacccctacgtacgttaacccgtaaccccgtaaccccggttccctaacggaaacggttacggtaccgtagtaccgaacgtactagttcggtacctacggtaccgaacgtacccgtaccaaccgtaaacctcgttaccctaccgtgtacgtaacggtacgtacgttaactacgtaccgtaccgaccgacgtaacgtaaccggaccgttaccgtacgtttaacgttacgtcgttacggacggtaacgtacggtaacggttaccgttttaacgtttaccggacgtaacgttacgttaacgtttaaaccgttccgttaacgttacgttacgtacggtacggtcggtacgggaccggtacgggtaccgtaaccgg

SEQ ID NO: 247291 - DNA, 733 bp, Homo sapiens
  misc_feature: GYAE6OF02G22RZ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggccaggactagtgaagccttcacgacggccctgtccctcacctgcactgtctcgtggtcgacctccatcgaggtacggttggttccgttccgtacgtcggacctcgggactccgggctacggtcccggcggacgaaagggtactggggtaagttacttagttacgggaacgtaacgttacgtaaggttccggaaccgtcgggtaccggggtaccccactaacgttacccgtaacccgaacccccgtttaccgaacgtaaacgggtacgtacggtacgtacgaacgtcgtacgtacgtacgacggtaccgtaaccgacccgtacccgaaacggtacccttaccggttccctaccgtaacgtacgttacggtaattacgttaacgtcgtaaccgcccgttcgaacgtacgaccggccgttaagtcgttaaccgttggacgtagtacgacggtaacggtcgttaacggtttagttaccggacgtcgtaacgtttaaaccgtaacgtacgtacgtacgtcgtaggtccggtacggacgggtaccgtagggtaaccctcgg

SEQ ID NO: 247292 - DNA, 806 bp, Homo sapiens
  misc_feature: GYAE6OF02JN4G5.9.70.G04.1.454.CMB.1.raw
  modified_base (406)..(406): a, c, t, g, unknown or other
  misc_feature (406)..(406): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctccctcctggtggcagctcccagatgggtcctgtcccaggtgcggctgcaggagtccggccaggactagtgaacgccttcacgacggcccttcgtcccctcaccgtgacctactcgtctcgtggtcgacctcatcgagtggtcgtcttacctacgtcggtaccgtggacctccggactacggtcccggccggacgtaaacggggtctagggtagttaacgttacgtacgggaaccggtaaattccgtaagtccgaccggtaacgggtcgggaaacccctccgttaanaccccgttaacccgtaacccccggttctaaccggtaaaacgtcggttacgtaaacggtcccaaggtcctaacggttaccggtaaccggtaagaccccgggtaaccggtaccccggtaaccctaaaccgtaaccccggttaacgttacccttacccgtacgtacgtacggttaacgtacgttacgttaacggcggtacccgtccgacgtaacgtaccggacggtaccgttagttaaccgttacgtacggtacgacggtaacggagttacggttacggtttaaccggtttacgaccgttaggttaaccgttaacggtttaaacccgtacgttaccgttaacggtaccggttaggttaacccggttcggaacggggtaccggtaacgggtaccggtaacccgg

SEQ ID NO: 247293 - DNA, 659 bp, Homo sapiens
  misc_feature: GYAE6OF02F2HTA.9.70.G04.1.454.CMB.1.raw
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacaggccctgtccctcacctgcactgtctctggtgactccatcagnggtgtcgttcctatggacctggactccggnacgtccgccggcaagggctgggatatgttggacgtaatctatcgcagtcgggaccncatcaccacccgtccacgaagcgtcgagtcagccatcgtacgacgtccgacctaccgttacccaaggtaaccctacggtttacccctacccgttaggaacctaaggttacgaagttttacgtacgttacggacccgacccgtacgtacgaccgtaccgggtccgttacgttaacttaccggtgtacgacggaagtaacggtacggtttacgttttacgttttacggaccgttagtaccgtttaaacgttaaaaccttacccgttaacgtcccggtttacgtacgggtaccgttaccggtacggggtacccgtaggggaaccctaaccggg

SEQ ID NO: 247294 - DNA, 801 bp, Homo sapiens
  misc_feature: GYAE6OF02GU2E8.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtcggttcactccctcctcctgggtggcagcctcccagagtcgggtcctgtcccaggtcgcggctgcgaggacggtccgggacccaaggactagtacgaacgtcctcacgcggccctcgtccctcacctcgactactgtctcgtggcacctcatacgaggtaggttcgtccttcctacggtcggtaccgtgggtactccggacgttacggtccccggacggaccgtaaacggggcttacgggtacgttaacgtacggtcgggaacgttaacgttaccgtagtccggtaccgtaacgggggtcggtaccccgtaaccctaagttaccctaacccgacccccgttcctaaacggaggtacgtccgggtaaactccgaacgtactagttccgagtacggtaccgaaccgtacccgtaccaacgtaaccgtcgttacctccgtacgtacgtacgttcgtaaaaaaacgttcgtaacgtaccgacccggtaccgacgaacgtaacgtaccggtccggttaacgttacgttacgttacggtaggtacggtaacggtaacggtacggtttaccgtttaacgttaccgtaccgtaacgtaacggttaaaccgttaaaccgttaacccgtaccgttaaccggttcggtaccggtaccgggttaccggtaccgggtaccggtaacgggtaccggttaacccgg

SEQ ID NO: 247295 - DNA, 748 bp, Homo sapiens
  misc_feature: GYAE6OF02JYLBO.9.70.G04.1.454.CMB.1.raw
  modified_base (212)..(212): a, c, t, g, unknown or other
  misc_feature (212)..(212): n is a, c, g, or t
  modified_base (340)..(340): a, c, t, g, unknown or other
  misc_feature (340)..(340): n is a, c, g, or t
  modified_base (526)..(526): a, c, t, g, unknown or other
  misc_feature (526)..(526): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctccagatgggtcctgtcccaggtgcggctgcaggagtcgggccaggactagtgaagccgttcacaggccctgttcccncactgcacttcgcttcgtggtcgacctccgtatcgaaggtacggttcggttccgttcctaacgtcgggaccttaggggactccgggactaggtcccggaccgggagaaacggggtctagggtaagttnttaggttacggaacgaacgtagtttacgacgccggtagggtaccgggtaaccccgcgtaaccttaccttaacccgaaaccccggtcctaacgggtaagaggttacggaaacgttcaacggtctaacgttggtccgaaacggtcgtaaccgccgtacccgaaacgaccgtaacggttcctaccgtanaacgtagttacggtaagtttagtacgtaaccgtaccggaccggcctaaccgacgtacccgggaaccgtttagtaaccttaacggttgtacggtacgtacgtaacgggtacggtaaccgttttaggttaccggacgtagtaacgttaaacttaaaccgttacgttacgttaccgtcgttacggtaccgttcgggtacggtaccggaccggggtacctaaccgg

SEQ ID NO: 247296 - DNA, 670 bp, Homo sapiens
  misc_feature: GYAE6OF02HW6VE.9.70.G04.1.454.CMB.1.raw
  modified_base (560)..(560): a, c, t, g, unknown or other
  misc_feature (560)..(560): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccagatgggtcctgtccaggtgcggctgcaggagtcgggcccaggactagtgaagccttcacaggccctcgtccctcacctgcactgtctctggtacgacctccatcgagtagggtgttccgtttacctagtcggacgtggactccggcacggtcccggacggacgaagggtactaggataagttagttagggaacgtaattcgtatcgcgtaggtacgggacccgcctaagtacctaaacccgtaccccgtaccctagaaacggtcgtacgtaacgtcgacgctaattcggtacaacggtaccgacctaacccggaccgtaacgtaacctacggtttccctacccggtacgtaaccgtaggttacgtaagttactacgacgtacccgcgacgacgaccgaaccggtcgtagttaacttaccgngtcgagacgagtaacgttcgtttaagttacgactatacgttaaacgttaaacctcgtaaccgtaacggtgtacgggtaccgtcggtacggggaccacgggtactaaccgg

SEQ ID NO: 247297 - DNA, 849 bp, Homo sapiens
  misc_feature: GYAE6OF02IR98R.9.70.G04.1.454.CMB.1.raw
  modified_base (320)..(320): a, c, t, g, unknown or other
  misc_feature (320)..(320): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtcggcagcctcccagagtcgggtcctgtcccgaggtgcggctgcgaggcggtccgggcccaaggactaggtagaacgtccttacacgacggcccttcgtcccctacacctcgcacttcgtctcgtaggtcactccatacgaggtacgggttcgttaccgttccgtacgtcggtccgtaggtaccgtccggcnccggtccggaccggacggaacgggtacgtacgggtaagtacgttaggtacgggaacgtaacttaccgttagtcgaccgtaaggggttccgggaccccgtaccacgttacccacccgtaaaccccggttcctaacgtaaacggtaccggtacgtaacggtacctacgacgtcgttacgtccgtacggttaccgaacccgtacccgtacccgaacgtaaacccgtacgtttacccgtacccgtagaaccggttaacggttacgttacgtaacttaccggtacccgtaacccggccggtaacgaccgtacccggtaccggttaccggttaacgtttaaccgtttacgtcggtaccgggacgaacgggttaacggtaccggtttaaccgttttaagggttaccgaccgttacggttaaccggtttaaaccgttaaacccgtttaccgtttaaacccggttacggttacggtacgggttaccggttaccgggtaccggggtaccgggtaaccgggggtaaccttaaccccgggg

SEQ ID NO: 247298 - DNA, 739 bp, Homo sapiens
  misc_feature: GYAE6OF02HD2ML.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgaggccctgtcccctcaccccgctactgtctctggtcacctccatcaggaggttcggttccgttcctacgtcggacctggacttccggcacggtcccggccggacgaacggggactgggaacgttatagtttagggaaccgtaatctaagtcgaccgtaggtccgggaccgtccaacgttacctaaccgaaccccgttccctacgaaacggtacgtaccgacgttaccaaggcctaagttcgtacctacgggtaccaaccgtacccgtacccgaacgtaaacccgtacgtttacccgtacccctacggaaccgtacggttacgtaagtttaactacgtaccggacccgccgtacgacgtacccgacggtccgtacgttacttacggtcgtacgacggaaggtacggtacggttaccgttttaagttacggaccgtagttaccttaacggttaaaaccctccgttaacgtaaccggttaccgttagggtaacccgttgggaccggggtaccggtaaccgggggtaccctacggtaccccg

SEQ ID NO: 247299 - DNA, 691 bp, Homo sapiens
  misc_feature: GYAE6OF02HK1V7.9.70.G04.1.454.CMB.1.raw
  modified_base (156)..(156): a, c, t, g, unknown or other
  misc_feature (156)..(156): n is a, c, g, or t
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (506)..(506): a, c, t, g, unknown or other
  misc_feature (506)..(506): n is a, c, g, or t
  modified_base (516)..(516): a, c, t, g, unknown or other
  misc_feature (516)..(516): n is a, c, g, or t
tcagtgatacgtctcacgaccggtgctcgatttagtgtagtgtgaagggaagggcctgtgaaggcttcactagtcctggacctcctgtgcaagaacatgaaacatctgtgttcatcctctcctggtcggcagctcccagtatgggtcctgtacccnggtcgcggtctgacgtagggacggtcggacccaggactagtgaacgtcttcacncggtccctgtccctacactcgactacttcgtctcgtgggtcacttcacgtnagggtggttccgtcgttcctagtcggaatcggtctcggagccggtccgcgggacgaacgggtcnggtatactgtacggaatacgtcttagcgtagcgtaccgggccacgtatccgtaacgaacccctcggtanaaacgtcgttcggaanacgaacgttnaactttggaacgacgtcgaactaccgtaccacgtaacgtaccgttccaccgtagtacaggttaccgtatacgtgaacccgggttcnccggtaacgngacgtcccggttaagcgtttaaactccgggtcgaagttccgggaaagttagggtccttaaccgttttaggtaacgtaccgaagttaccgaacgtttaaacctccgggtaagttacccttgggtacttacccggggtacgtaccgggtaaacgtacccggggaaggttaaccccgg

SEQ ID NO: 247300 - DNA, 853 bp, Homo sapiens
  misc_feature: GYAE6OF02GYZVN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtgcagctccagagtgggtcctggtcccaggtcgcggctgcagggtagtccgggaccaggtactagtagaacgtccttacacgacggtcccttcgtcccctcacctgacctacgttgtccttcgtgggtacacctccgtatacgaggtacgggttccggttaccgttacccgttacgtcggggtaacctacgggtccttaccgggacctaccgggttaccccgggaccggaacggtaaacgggacgttagggtaaaggtttaactttaacgggtttaacgggaaaccttacgttaccgttaacggtcgtaccggtaacggggtttaccgggaccccgtaccctaacggttaccccgttaaaccccgtaaaccccggtttcccaaacggtaaacggtacggtacgtacgtacacggtctaggttccgacgtagtacccgacgtaaccccgtaccgtaaacgtaccttacgttaccctaccgacgtactaggttactacgtttacgtacggtcccgaccggtaccgagaaccgtaccggtaccgggttacgttagttaccgtttcggaggtaccgtacgggtaggtaacggttaccgttaacgttttacggtaacgaccgttacgtaacgtttaaaccgttaaaccctttcggtaaccggttacggttacggttacgggttaacccggtcggtacccggggtaccggtaccggggttaacgtaaccggg

SEQ ID NO: 247301 - DNA, 806 bp, Homo sapiens
  misc_feature: GYAE6OF02GEL7I.9.70.G04.1.454.CMB.1.raw
  modified_base (172)..(172): a, c, t, g, unknown or other
  misc_feature (172)..(172): n is a, c, g, or t
tcagtgatacgtctcacgaccggtgctcgatttagtgtagtgtgaagggaaagggcctgtgaaggcttcactagtcctggacctcctgtgcaagaacactgaaacatctgtggttcatcctcctcctggtggcagctcccagatgggtcctgtcccaggtgcggctgcaggngtccgggccaggactagtgaagccttcacaggccctgtccctcacctgcacgtgtctctggtgacctccatcagacggttggtcttccactggacctggactccggcaggtcccgcgacgaagggctgggatatagttggacgaattccgtaatcgaccaggtcgggacccgctaatcctaaccgaacccccgttcctacgaaacggtacgttcggaacgttccaaggtcctaagttcggtacctacggtaccgaaccgtacccggttacccgaaacgtaaacccgttaaggtttccccttaccccgttacggaaaccgtaacgggttcgttaaacggttacttaacggttaccggaccccgtacccgaccgtaaacggtaaccgtaaccgggtcccggtttaacggtttaaccgtttaccgttagggtttaccgggacgggtaaacggtaacgggtacgggtttacccggttttaagtttttaaccgggaacccgttaacgggttaccgtttaaacggtttaaaaaccctttcccggttaaaccgtttaacccgggttaccggttaccgggttaaccgggtttcccggtaaccgggggaccccggttaacgggggtacccgttaaacccgggg

SEQ ID NO: 247302 - DNA, 925 bp, Homo sapiens
  misc_feature: GYAE6OF02FL4ZQ.9.70.G04.1.454.CMB.1.raw
  modified_base (126)..(126): a, c, t, g, unknown or other
  misc_feature (126)..(126): n is a, c, g, or t
  modified_base (700)..(700): a, c, t, g, unknown or other
  misc_feature (700)..(700): n is a, c, g, or t
tcagtgatacgtctcacgaccggtgctcgatttagtgtagtgtgaagggaaagggcctgtgaaggcttcactagtcctggacctcctgtgcaagaacatgaaacatctcgtggtcatcctcctccnggtcgcagctcccagagttggtccctgtacccaggttgcggctgacgaggtacggtccggcccgtaagacgttaggtcgaacgccctttacgaaccgcggtcccttccggtcccctagtacccgtgacctcgttcgttccctggttcggtctacctccgtagtcgaggtacggttcgtttacggttccttaacggttcgaccggttaggtccgttaaccggccgtacggttcccggacccggaggaaacccggtacgttaggggtaacttaacggtacgtttacggacgtacttacgtcgtacggccggttaggaacggtcccctaaggtacccgtacctaaacccgtacccgttacccgtaagtaacgtaaccggttccaaacgtacccgtgttactaccgggtgtttaacccgagtaaacccgtccgaacccgtacccggtaaacctaccgtttaaccgtttcccgtcgggaacttaccgttacgggttacgtttaacgtaccggtttaacgtcccgggtaaccgttacccgggacaacccgggttaacccggtaccgggttacccgggttntttaaacccggggtttcgtaccggggttttaacggacgggaaacgggtacggttttaaacccggttttaggttttaaccggttaaaggtcccttaaacggggtttacccgttttaaaaacttaccccttttaaacccgggcgtttttaaccgggtacggtaaacggtttcccgggacccggtttaagggggacccccggtttttaaacggccgtaaaccccgggg

SEQ ID NO: 247303 - DNA, 766 bp, Homo sapiens
  misc_feature: GYAE6OF02IJ4O2.9.70.G04.1.454.CMB.1.raw
  modified_base (362)..(362): a, c, t, g, unknown or other
  misc_feature (362)..(362): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaacgccttcacacggccctgtcccctcaccgtgcactgtctctggtcgactccatcgagtaggtgttccgttcctacgtcggacctggacgtcccggcgacggtccgccggacgaagggtacgtaggagttagtagttacggacgtaatcgtagtcgacgtaggcggaccnctataccgacctaaccccgtccagaacgtacgtcgagtacgagtcagtcgtcgtacgtaccgaccgtacccgtacccgtaacgtaacccgtcgtttacccgtacccgtgtaaccgtaggtacggttaacgtttaacgtaccgttaccgggaccccggaccgtacggaaccggtaacccgaccggggttacccgttacggtttaacgtttacccgtcgggttaacggaccgggtaaggtaacgggtaaccgggttttaacccgttttaaggtttaaccggtacctacgggtttaaccgttaaacggtttaaaaccctcccggttaaaccggttaccgggttacgttaccgggttacgggttccgggaaccgggggttacccgaccgggggtaacctaacccgggg

SEQ ID NO: 247304 - DNA, 920 bp, Homo sapiens
  misc_feature: GYAE6OF02GX736.9.70.G04.1.454.CMB.1.raw
  modified_base (129)..(129): a, c, t, g, unknown or other
  misc_feature (129)..(129): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggngcagtctcccagtatcgggtcctcgtcccaggtgccggctgcgaggtaggtccggcccaaggcttaggtcgaacgttcccttacaaccgcgggtcccctacgtacccctctaaccttgacctacgtcgttcctcggttacgggttacgacccttaccgaacgttcgaaaggttcggggttacggtttccccgtttaaccttaccggtacgggttaaccgtcgggtaaccgtttcccggactacccgggttaccccgggaccccgggaacggaaaacgggggttacccgtaacgggtaagtttaaacggttaccggtttaacggggttaaaccgaaattttcccggtaaaaggtcccggtaccggtaaacggggttacccgggacccgtaccccgttaacgtaccccggttaaacccttaaccccccggttccgtaaaacgaacgggttacgtaccgtcgtaaaccgactaccgtactaggtaccgacggtaccgaactcccgtaccaagtacctaacgtcccgtacctcggaacgtacggtacgtaagttacgtacgtacggtccccacgaccgacgtaaccggccgggttaaccgtaccgtttacttaccggtagtacggaccggtaaacggtaaggttaccggttaacggtttaacgtttacccggtacttaccggtaacgttttaaaccggtaaacccgttacccggttaacggttaccggttccggttaacggccggttaccgggtaccggggtaaccgggtaacccgggaacccggttaacccggg

SEQ ID NO: 247305 - DNA, 836 bp, Homo sapiens
  misc_feature: GYAE6OF02II0CO.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccgaggtgcggctgacgaggacgtccgggcccaggactagtgaacgtccttcacgacggtccctgtccctcacctgacactcgtctctggtcgcctccatcgaggtacggttcggttccgttacctacgtcggacctcggaacgtcccggcgtacggttccccggaccgggacgtaaacggggtacctaggggtaagtttacttaaggtttacgggaaaccgttaaattccgttagtacggtaaccgtaacggggtccgggaacccctccgtaacgttaaccctaaccccgtaacccccgttacccctaagaaaacgggtcgttcggtaaacgttccgaacgtactaacgtcgtaactacggtaccgaacgtacccggtaacccaacggtaaaccctcgtttccctcctaaggtacacggttaagtacgtttaagtctacccggaaccgtccgacgtaaccggtaccgtacccgggtcgttaacgttacttacggtcgtaacgggctaaaacgggtcggttaccggtttaacccggttttaagtttaaccgggaccttaacggttaaaccgttttaaaccggttaaaaccccgttccgttaaaccggttaccgggttgttaaccgggttacgggtcccgggtaacgggggaacccgggttaaccgggacccggttaaacccgg

SEQ ID NO: 247306 - DNA, 871 bp, Homo sapiens
  misc_feature: GYAE6OF02GBCNZ.9.70.G04.1.454.CMB.1.raw
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtgcagctcccagatgggtcctgtcccaggtgcgctgcaggagtccggccaggactagtagaacgtccttcacgacggtccctcgtccctcaccgttgcacttgtctcgtggtctacctcctatccgaaggtacggttcggttaccgttaccgttaaccgttcggaacccgttagggtaccgttacccgggacgtaacccggtccccgggaccggaccggtaaacggggtaccgttagggtaacgttagtacgttagggaaccgtaattcctaagtcgaccgtagggtaccgggtaccgtaccacgtttaccgtaaaccccgtaccccggttaccctaacgtaacggtacgttaccggtaacgtacgaacggtaccttacggtacgttaaccgaacggtcccgtaaccgaacccgttacccgaaacggtaaacccttaccgtttaccccgtaccctaagggtaacctaacgggttaacgttaacggttaacgttacgttaaccgggacccgtaaccgacgaacccgtaaccggtaccggttaccgttaacgtaccttttacggaacgttacggaccggtaacgggtaacgttaaccggggtttaacctttttacggttaaaccgaccgttaccgttaaacggttaaaccgttaaaaccgtcccggttaaacgttccggttacggttaacgggaaccgttaccggggtaaccggggaccggttaaccggggacttaaacccggg

SEQ ID NO: 247307 - DNA, 724 bp, Homo sapiens
  misc_feature: GYAE6OF02GR0L2.9.70.G04.1.454.CMB.1.raw
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (347)..(347): a, c, t, g, unknown or other
  misc_feature (347)..(347): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcgntgcaggngtcggccaggactagtgaagccttcacacggccctgtccctcacctgcactgtctctggtnactcatcagnggtcgtcgttccacgtggacctggactccggctacggtccgccggacgaagggtactgggagttacttagttacggacaatctagtcgccgtagggtcgggacccncgtaactaccgtaaccgtaaccccgttccaacgtaaaggtacggtcgtagttaccacggtctaagttcgtacgacgtaccgaacgtacccgtcccgtaaacggtaaccttacgttccctaccctagtaaccgttaacggtttaacgttaactacgttaccggacccgtcccggtacgaacggtaccggacgggtaccgttacgtttacgtaacgttcggtcggtacggtacgggtaacggttacgggttaccttttaacgggtttacggtaccgtacgttacgtttaaacggttaaaacccttccgtttaaaccgtcggttacgttacggtaccggtttaccggcgggtaccggaacgggtaacctaccgggttacc

SEQ ID NO: 247308 - DNA, 558 bp, Homo sapiens
  misc_feature: GYAE6OF02H3SKN.9.70.G04.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (492)..(492): a, c, t, g, unknown or other
  misc_feature (492)..(492): n is a, c, g, or t
tcagtgatacgtctcacgaccggtgctcgatttagtgtagtgtgaagggaaagggcctgtgaaggcttcacaggccctgtccctcacctgcactgtctctggtgactccatcagaggtggtcgttcctactggacctggatccggcagtccgccggcaagggctggagtatagttggacgaatctatgccaggtgggaccnccatcctaacaaccccgtccctanaagngtcagtcagcatgtcagtcgacaccgtccaagaaccagttctccctgacagtgagttatatgaccgccgcagcacggccgtgtatactgtgcgagagaggtccgttattttaggacagcttagttaaaactctaactacggtctggacgtcgtgggccgaggggaccaaggtcaccgtctccctcacgtccacaccgaaggcccagtccgtcttccccnggtccnccgtcgcctccgaggacgccaccgtcgacgacgccacncgcggcccgtggctcgcgtggtcgaacggtcctacgtccagtccgtatccacgtgcggtcggtacg

SEQ ID NO: 247309 - DNA, 777 bp, Homo sapiens
  misc_feature: GYAE6OF02FIDZJ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagagtgggtcctgtcccaggtgcggctgcaggagtcgggcccaggactagtgaagccttacacaggccctgtccctcgacctcgcactgtcctcgtggctactccatcgagaggtcggttcgtcctactggacctggactccggcaggtccgccggcgaaacggctggagtatagtggactaatctagtcgaccaggttccgggaccgtacctacgtaccgtaaccctaacccccgtcccctaagtaaacggtacggtaccggtaacggtcgtaacggcgtaacttcggttaaccgcggttaccgaacctaacccggtccccaaaagggtaaaccccttacggttacccccttacccggtaacgtaacgtaacgggtttagaaacgtttacgtaacgtacccgggacccgtacccgtacgaaccgggaccgtacccgggttacgtacggttaaacgtttcgtaacgggttccggggaacgtaacgggtagacccgggttttaccgttttaagtttaccggggaccctaagggttaccctttaaaaggttaaaaccccgtccgttaaacggacccggttttcacggggtttacccgacggggttacccgggggaccgttccggggaaaacccgttcggg

SEQ ID NO: 247310 - DNA, 721 bp, Homo sapiens
  misc_feature: GYAE6OF02JR03K.9.70.G04.1.454.CMB.1.raw
  modified_base (281)..(281): a, c, t, g, unknown or other
  misc_feature (281)..(281): n is a, c, g, or t
  modified_base (338)..(338): a, c, t, g, unknown or other
  misc_feature (338)..(338): n is a, c, g, or t
  modified_base (572)..(572): a, c, t, g, unknown or other
  misc_feature (572)..(572): n is a, c, g, or t
  modified_base (632)..(632): a, c, t, g, unknown or other
  misc_feature (632)..(632): n is a, c, g, or t
tcagtgatacgtctcacgaccggtgctcgatttagtgtagtgtgaagggaaagggcctgtgaaggcttcactagtcctggacctcctgtgcaagaacatcgaaacatctgtggttcatcctcctccgtggtagcgacgcctaccgagtagtcgggtcctcggtacccgagggtcgccggtctgacagggaggtccgggccaaggtactagtagacgtccttcgagaccggtcctcgtccctaacaccgtgaccacgtcgtcctcgtacgggtcgacccttnacgttacgacgggtaggttcggtaccgtttccaacggttccggtacgtacgggtacnccggcgtaccggtccggcggcgtaaggccgttaggactagtttcgacgtacgacgtcagtacgcgtaggtccggaccacgtataccgtaccgaacccgtccgtaagagttctacggtaggctaacgcgtaattcgggcttaaccggagttcccgaaccgtacctaacggtaacccttggttccctaaccgtcgtaaaccgtgttactaacggttactaacggtccgtaaacccncggttacacccgtacggtaacccgtcgtaaacggtttccttagccgttaaagcgttacgnggttaaccgtactttagtccgatacgtacgtaataaccttcaaccggttcgtgttaccggcgtacggtccgggaacgtcggtactacgg

SEQ ID NO: 247311 - DNA, 782 bp, Homo sapiens
  misc_feature: GYAE6OF02JUPXV.9.70.G04.1.454.CMB.1.raw
  modified_base (168)..(168): a, c, t, g, unknown or other
  misc_feature (168)..(168): n is a, c, g, or t
  modified_base (311)..(311): a, c, t, g, unknown or other
  misc_feature (311)..(311): n is a, c, g, or t
  modified_base (444)..(444): a, c, t, g, unknown or other
  misc_feature (444)..(444): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctctggtgcagctccagatgggtcctgtcccagggtgcggctgcaggngtccggcccaggactagtgaagccttcacgacggcccttgtccctacacctgcctacgttgtcctgtcggtgacctccagttacgaggtacgggttcggttaccgtttccctacgttcgggaacccgtggtaccttcccgggngaccggttcccggacccgggagaaaacggggtcgttagggaattacgttacggttcggaacgtaacttcgtatcggaccggtaggtcgggaaccctcctaacttaccgtaaaccccgaaccccgttcccgaanaaacgggttcgtaaccgaagttccgaaagccgtagttcggtacccgtaaggttcccgaacctacccggttacccgaaacgtaaacccgttacgtttccccgtacccgtagtaacgtacggttaggtaacgtttacgacgttccggaacccgtacgaccgacgtaaccgaccggtacgttacgttagttaccgtggtcgaccggtaagtacggaccggttttttttaaccgagtttaaccaccgtaagtttaccgtaaaccgttaaaaccttccgtaacgtaaccggttgttaccgggtacgttccgggtacggtaccgggacggtaacccgtaacggg

SEQ ID NO: 247312 - DNA, 756 bp, Homo sapiens
  misc_feature: GYAE6OF02IU3FX.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccagttgcggctgcaggacgtcgggcccaggactagtgaagccttcacacggccctgtccctcacctgctactgtctcgtggtcactccatcaggaggttcggtccttcctacgtcggaccttggacgtccggctacggtcccgaccggacaacgggactggaacgttattacggttgggaacgtaacttcgtacgtcgaccgtaagggtacgggacccgctacttaccgaacccgtaacccccgttcctaacgaaagtccgttaacggacgtccaagtacctagttcgtaacgtacggtaccgaacctaccgtacccgaaacgtaaccgtacgtttaccctacccggtagtaccgtagggttacttaacggttactaacgtccggaacccgtaccgaccggaaaccgaccggtaccgggtaccgttacgtttaacttaccgtggtaccgggacgtagggtaaccgtaacgggtttaccgttttaaggtttacgaacccgtaacggttaacgtttaaaccgtttaaaacctccgttaaccgttaacggttaccgtacgggtaccggttacgggtaccgggtaccggaccggggtacctaacggg

SEQ ID NO: 247313 - DNA, 707 bp, Homo sapiens
  misc_feature: GYAE6OF02JLLBP.9.70.G04.1.454.CMB.1.raw
  modified_base (133)..(133): a, c, t, g, unknown or other
  misc_feature (133)..(133): n is a, c, g, or t
  modified_base (267)..(267): a, c, t, g, unknown or other
  misc_feature (267)..(267): n is a, c, g, or t
  modified_base (468)..(468): a, c, t, g, unknown or other
  misc_feature (468)..(468): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcactcctcctcctggtggnagctccagatgggtcctggtccctaggtcgcggctgcgtaggaggtccggggccagggactaggtgaacgtccttcacaggccctcgtccctcacctgcctacgtgtactcgtagggtcgacctcactcaaggnggttcgttccgttacctacgtcgaccgtaggtacgccggtctacggtaccggccgaggaacgggtataggagttataggtcggaatatactcgtacgcgttacggacggggccctacgaccgtaccgtaacccgtaaccccgttaccgtaactaacggttaggtaccgacgtacgaacgctactcgtacgagtccgaaccncccggtccaaacgacctacggttcctcgtacggactagttgtacgttaacgtacgttacggacccgtaccggtcgaacgtaccgaccgggcgttagtaacgttcgtcgtacgggtagaacggtcgggtaacggttacgttaagttaaccggaacgttcggtaactttaaacgtaaacttcgtaacggtccggtacggtacggtccggtaaccgggcggaaccggtacggaccgtaccgg

SEQ ID NO: 247314 - DNA, 740 bp, Homo sapiens
  misc_feature: GYAE6OF02F313P.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggagtccgggcccaggactaggtgaagccttacacaggccctgtccctcacctgcactgtcctcgtggtcgactccataccgaggagggtgttccttaccgtacgtcggacctggaactcccgggcacgtcccgccggtacgtaaggactgggactatagttggactaatcgtagtcgacgtaggtcgggaaccgctactcgtaacccgaaccccgttcctacaacggtaggtacgaacggtacaaggtcaacgttcggtaccaaacggttccgaaaccctaccggtacccgaacgtaaaccgtcgttaaccctaccctacgacgtaagggttacgaagtttactaacgttgaaccccggtcgaccgaaacgaccggtaccggtaccggttagttaacgtttaccgcgttacggacggagacgggtaaccgggttacttttaacggttcggtaacccgtaacggacgtttaaaaccggttaaaacccgtccggttaacccgttaacggttcggttaacggggacccgttaccggggtaccggggtaccggtaccgggggtaacctaacggg

SEQ ID NO: 247315 - DNA, 710 bp, Homo sapiens
  misc_feature: GYAE6OF02GZACS.9.70.G04.1.454.CMB.1.raw
  modified_base (171)..(171): a, c, t, g, unknown or other
  misc_feature (171)..(171): n is a, c, g, or t
  modified_base (512)..(512): a, c, t, g, unknown or other
  misc_feature (512)..(512): n is a, c, g, or t
  modified_base (586)..(586): a, c, t, g, unknown or other
  misc_feature (586)..(586): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggngtccgggccaggactagtgaacgccttcacacggtccctcgtccctcaccgtgcctacgttcgtctcgtggtcacctccatacgagtaggtcgttccgtttcctacgtcggtacctggtacgtcccggctacggtcccggaccggacgtaacggggcgtagggtacgtaagttagttaggaacgtattctagtcgaccgtacgggtccggacccgactacgttaccaacccgtaaccccttccctaacgaacgtacgtaccggaacgtacgagtaccgtaacgtcgtaccgtacggtaccgaaccgtacccgacccaacggtaaccctacggttttacccnccgtagacgtagttggtaacttactaggtcgacccgccgtaagacggtaccctacggtcttaagttacgttacnggttaggccgtaaggtacggcgttaacgtttagtaccgacgagttaacgttaactttaaaccgcttaaccggtacgtcgttacgggtccgtacggtcgggaacccggtagggacccgttaacgg

SEQ ID NO: 247316 - DNA, 769 bp, Homo sapiens
  misc_feature: GYAE6OF02GR7FF.9.70.G04.1.454.CMB.1.raw
  modified_base (205)..(205): a, c, t, g, unknown or other
  misc_feature (205)..(205): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctctcctggtggcagctcccagactgggtcctgtcccaggtcgcggctgcgaggagtcgggcccaggactagtgaagtccttcaacncggtccctcggtcccctaccaccgttgcctacgttgtcctacgtcgggtcacctccacgttcgaggtacggttcggttccgtttacctacggtcgtaccgtgggactccggacacggtcccggcggacgaagggctggagttatagttacgggactaactgttagcgccgtaagggtcgggtacccgtacctacgttccgtaacccaacccccggttcctaacgaaacgtcgtacgggtactaccggagctagttccacgtacggtaccaaccgtacccgtacccgaacgtaccttaacggttcctaccgtaccgacgtacggtacgttacgttacgtacgtacccgtaccggccgtacgacgacccggtaccggtaccgttacgttaacttacggtcggttacggtacggacgggtaaacggtccggttaacgtttacgttacgggtacccgtaacggtaacggtttaacctaaaaccgttcccgttaacggttaccggtaacggttacggttaaccgggtccgggttacccggggaccggtacccgggtaccgtaacccggg

SEQ ID NO: 247317 - DNA, 606 bp, Homo sapiens
  misc_feature: GYAE6OF02JAQ3I.9.70.G04.1.454.CMB.1.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (403)..(403): a, c, t, g, unknown or other
  misc_feature (403)..(403): n is a, c, g, or t
  modified_base (511)..(511): a, c, t, g, unknown or other
  misc_feature (511)..(511): n is a, c, g, or t
  modified_base (529)..(529): a, c, t, g, unknown or other
  misc_feature (529)..(529): n is a, c, g, or t
tcagtgatacgtctcacgaccggtgctcgatttagtgtagtgtgaagggaaagggcctgtgaaggcttcacaggccctgtccctcacctgcactgtctctggtgactccatcagaggtggtcgttcctactggacctggatccggcagtccgccggcaagggactggagtatattggacgaatctatgccaggtgggaccgccatctaccaacccgtccctcgaagngtcgagtcagcatgtcagtcacncctcccgagaaccagttcctccctgaccagtgagttatagtcggacccgcgccacggaccgacggccgttgtacttactggtgcgagaggacggtccgttaagtttacggaccagtactacgttaaaacctctaactacggtctggacgtcgngggaccgaggggaccgtaagccaccggtcctccgtcactccctccgacgaacggccagtcccgttccttccccgtcgccgccctgcctccgagcgccacctccgacgngccgacgcggccgtccgnggtccgtcgccgtcggtcgtaaccgtacgttaccctaccgaggtacctactcctacggtcgacgggtccgggtacgg

SEQ ID NO: 247318 - DNA, 803 bp, Homo sapiens
  misc_feature: GYAE6OF02IRHSD.9.70.G04.1.454.CMB.1.raw
  modified_base (105)..(105): a, c, t, g, unknown or other
  misc_feature (105)..(105): n is a, c, g, or t
  modified_base (132)..(132): a, c, t, g, unknown or other
  misc_feature (132)..(132): n is a, c, g, or t
tcagtgatacgtctcacgaccggtgctcgatttagtgtagtgtgaagggaaagggcctgtgaaggcttcactagtcctggacctcctgtgcaagaacatgaaacntctgtggttcatcctcctcctggcgcngctcccagatcggtcctgtcccaggtgcgctgcaggagtcgggcccaggactaggtagacgccttacacgacggtcccctgtcccctctacctgctcttcgttcctcgtggtacgaccttccactcgtagggacggtttcggttaccgttccgtaacgtcggtaccgtggtacgtcccggacgacggttcccgccggggaacgtaaccggggaccggttagggaacgttacgtttaaggtttggtaaaacggtacgttcgttaacgtccggtacgtaagggttcggacccgacctataaccctaccgtaaccccgttccgacgaaggtacgtcgaacgtcaagtacgaatcgtaccgacgtacaccgttaccgaccgaaccgtaacctacgttccccgtaacgtcgaacgtggtaacggttagttacgacgttacgacgtaccgaccgacgtaccgtaccgtacggttacgttaattaccggtcgtacgtacgggaacgttaaacggtaccggtttaacgttttaacggttttaccgaccggttaaagtttaaccggtttaaaaaccgtttaaacccggttaccggtttaaaccgtaccggttaccggtaaccgttaccgggttccggttaaccggggggaaccgtaaacccgggggtaacctaacccggg

SEQ ID NO: 247319 - DNA, 723 bp, Homo sapiens
  misc_feature: GYAE6OF02IOVE1.9.70.G04.1.454.CMB.1.raw
  modified_base (247)..(247): a, c, t, g, unknown or other
  misc_feature (247)..(247): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtcgacctcatcgagnggtcgttccgttcctacgtcggtaccgtggacgtccgcgacggtcccgccggacgtaagggtcgtcgggaagttaacgttagttacgggaacgtaagttcctaagtcgtaccgtaggtccgggacccacgtactacccgtaacctaacccccgttacctaacgaagtcggttacgacgttacacgactagtagtacgcgtaccaccgtacgacccaacgaaccttacgtcctcccgtaagaccgaagttgaacgttactagtaccgacccggtaccacgaacgaccgtccggtacgttaacgttacgttacgtgacggacggtagtacggtacggtttaacccgttttaaggtttacccggaaccgtaggttaacccttaaaggtttaaaaccccgtccttttaacggtacgtttacccggtacggttccggttacgggtaacccggggaccgggtaccgggacccggttaaccgg

SEQ ID NO: 247320 - DNA, 853 bp, Homo sapiens
  misc_feature: GYAE6OF02JZW32.9.70.G04.1.454.CMB.1.raw
  modified_base (307)..(307): a, c, t, g, unknown or other
  misc_feature (307)..(307): n is a, c, g, or t
  modified_base (392)..(392): a, c, t, g, unknown or other
  misc_feature (392)..(392): n is a, c, g, or t
tcagtgatacgtctcacgaccggtgctcgatttagtgtagtgtgaagggaaagggcctgtgaaggcttcactagtcctggacctcctgtgccaagaacatgaaacatctgtgttcatcctcctcctggtcggacagctcccagatcgggtcctgtcccaggtgcggctgctaggacgtcgggcccaggactagtcgaacgtccttacaccgacggccctgtcccctcgaccctggccacgttcgtctcgtaggtcgacctcctaacgtcgaaggcggtttacgtccggttaccacgtcggtaaccgngggtacgtcccggacttacggtcccggacgggaacctaaacgggcctagggaacgttacttaaggttcggaacgtactcggtaancggtacccgagtccgggacctctaacgtccgtaccaaccccgttccgaacgaacggtacgttacggaacgcacggtactacgttacgtacgaacggtaccaacgtaacccggtacccgtaaacgtaacccgtacggttaccctacccgtacgtaaccgtacggttacgtaacgttacgtaacgttaccggaccgtacccgttacgacggttaaaccggaaccggttacggttaccggttaacgttaaccgttacggttacggtaaccgggaaccgggttaacggtaccggttaaccggttttaacggtttaccggtaccgttaccggtaaccggtttaacgttaaaacccgtttacccgttaaccccgtttaaccggtttaaccggttaaccgggtttaacccgtacggggtttacccgggaacccggggttaacccgggtaacccggttaaaccccgggg

SEQ ID NO: 247321 - DNA, 818 bp, Homo sapiens
  misc_feature: GYAE6OF02HYWVV.9.70.G04.1.454.CMB.1.raw
  modified_base (708)..(708): a, c, t, g, unknown or other
  misc_feature (708)..(708): n is a, c, g, or t
tcagtgatacgtctcacgaccggtgctcgatttagtgtagtgtgaagggaaagggcctgtgaaggcttcactagtcctggacctcctgtgacaagaacatgaaacatctgtggttcatcctcctctggtgcagcctcccaggatgggtcctcgtcccaggtgcggctgcgaggacggtccggcccaaggactagtacgaacgtcccttacaccgacggtcccttcgtcccctctacccgtgcctacttcgtccttcgtggtacctaacctcacgtcgaagggtacggtttcggttaccgtttcccgttaacggtccggtaccgtcggtaaccgtcccggaccgtaccggttccccggaccgggaacggaaacggggttactacggggtaatttaacgttaagggtttacggaacggtttaaacttccgttacgtccggtaaccgtaacggggtacccgggtaccctaacgttaccttaaccgtaacccccggtaaaccccgttaccgtaacgtaacggtacggtacggtacgtaaccgagtacgtacgttcgacgtaccggtacccgaccgtaaccgtacccgaacgttacccgtacgttccaccgtagacgtacgtagttacgtactaccggtccgaccgccgacgacgtaccggacgttccgtagttacgttcgcgtagacggtagtacggtccgttaacgtttanaccggtacctacggtttaaccttaaacgttaaacccgtccgttaaccggttcgtaccggtacgggtaccgttaccggggtacggtaaacggtacccgggtacgtaaccgg

SEQ ID NO: 247322 - DNA, 700 bp, Homo sapiens
  misc_feature: GYAE6OF02FMO0F.9.70.G04.1.454.CMB.1.raw
  modified_base (571)..(571): a, c, t, g, unknown or other
  misc_feature (571)..(571): n is a, c, g, or t
  modified_base (600)..(600): a, c, t, g, unknown or other
  misc_feature (600)..(600): n is a, c, g, or t
  modified_base (609)..(609): a, c, t, g, unknown or other
  misc_feature (609)..(609): n is a, c, g, or t
  modified_base (685)..(685): a, c, t, g, unknown or other
  misc_feature (685)..(685): n is a, c, g, or t
tcagtgatacgtctcacgaccggtgctcgatttagtgtagtgtgaagggaaagggtcctgtgaaggcttcactagtcctggacctcctgtgacaagaacatgaaacatctgtgtcatcctcctcctggtgcagctcccagatcggtcctgtacccaggtgcggctcgacgaggacgtcgggaccctaggtacgtacgtgaacgtccttcacgacggtccctcgtaccctcacctcgccacttcgtcttcgtcggtcacctcctagtcaggtacggttcggtaccttaccgtacgtacgaccgttggaccttccggacctacggtcccgacggaccgtaagggaccgtaggtacttacgttagtaccggagtaactcttaaggtcgaccgtggtacggacccgcctaacgttacccgtaaccccgtaccccgttcccgtaagaaccgtacggttacgaacggttacacggtctaaagttcgtacgacgttacccgaacgtacccgttaccgaaacgtaccgttcgttacccttccgacgtacgtaggtagtaacttacgtataccggtaccnccgtacgaacgtccgaacggtcgtttaanaccgtttancggtagaccgaggtacgtacgttacgttacggtcacgacttacgttaacgtaaccctgtacgtctagtcgtcgcgnggtaccgaggactcg

SEQ ID NO: 247323 - DNA, 787 bp, Homo sapiens
  misc_feature: GYAE6OF02H6S4Z.9.70.G04.1.454.CMB.1.raw
  modified_base (260)..(260): a, c, t, g, unknown or other
  misc_feature (260)..(260): n is a, c, g, or t
tcagtgatacgtctcacgaccggtgctcgatttagtgtagtgtgaaggaaagggcctgtgaaggcttcactagtcctggacctcctgtgcaagaacatgaaacatctgtggttcatcctcctcctggtgcagctcccagtatgggtcctgtcccaggtcgcggctgcgaggcggtccggccgaggtactagtgaacgccttcacgacggccctcgtaccctctaccgtgcctacgttcgtcctcgtggtcgacctccgtncgaggtaggtcgttccttctaacgtcggtaccgtggactccggctaccggtccggccggacggaggacgtaggattacgtagttacggacgtatcgtacgtcgcgtacgggaccggtaccgtcctaaccgttacaaccccgtacccgttacccgagtaacggtacgtcgtaagtaccagtcgtagtcgacgtacgtaccggtaccgtaccgtaccctaacgtaaaccgttccgttacccgtaccgtcgtacgtaacgttacgggtaacgtttacgtaacgtcccggaccggtacccgtacgtaaaccgggtaccggtaaccgggtacttaggttaaccgtttcggcggttacggacggttaagttaacccgggtaccggtttaaccgggttttaacgtaacccgggaaccttcgaaaccgttttaacccggttaaaaccctacgggttaacccggtacccgtttacggtaccggggttaccgttcggggtaaccgggtaccgggtaacggggtaacccttacccggg

SEQ ID NO: 247324 - DNA, 768 bp, Homo sapiens
  misc_feature: GYAE6OF02FTMK5.9.70.G04.1.454.CMB.1.raw
  modified_base (171)..(171): a, c, t, g, unknown or other
  misc_feature (171)..(171): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggngtcgggcccaggactagtgaagccttcacacggccctcgtccctcacctgcctacgtgtctctggtcacctccatcgaggtacggtggttccgttcctacgtcggaccgtggacgtcccggctacggtcccggccggacgaaagggcgtagggtaacgttattacggttagggaacctaacttcgtaagtcgaccgtaggggtaccgggccccgtactaacttacccgtaaccgtaacccccggtaccctaccgaaaggtccggttaccggaacggttccgaacggtactagttccggtacgaggtacccgaccgtacccgtacccgtaaccgtaacccttacgttccctcccggttacgtaaccgtacgttacgtaacgttacgtagtaccggtaaccccgtcgaccgtaacggaccgtaccgggtacgttcgtaacgtttaccgtggtaccggacgacggtaacgggtacggtaaccgttttaacgttaaccggtaccgttaagtaaccgttaaacgttaaaaccgtccgttaaccgttaccgttcggtcggttaccggtcgggtaccgggtaaccggtaccgggacgtaaccgg

SEQ ID NO: 247325 - DNA, 753 bp, Homo sapiens
  misc_feature: GYAE6OF02GQF4W.9.70.G04.1.454.CMB.1.raw
  modified_base (467)..(467): a, c, t, g, unknown or other
  misc_feature (467)..(467): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgagggacggtccgggcccagggtactaggtgaacgtccttcacgaggtccccttcgtacccctcacctgccacttcgtcctacgtggtacgacctccaagtcaaggtcgggttcggttcccgttcctacgtacggtaccgtgggtacctccggtacctaccggtcccggccgggtacgaaggggtcgtagggagttaacgttaggttacggaacgtactctagtccgacgtacgggtcgggaccctactacgtaccttaacccgtaccccgtccgaagaacggttcggtacgacgtcganacgtacgtcgtccgaggtacccaacgtcccggtaccccaacggtaaccttaccgtttccctcccgtacgtaaacgtacggttagtaactttacgtacggtaccgacccgtccggacgtaaccgccggtaccgtcggtttagtacgttcgtggacggtacgaagtacggtacggttcgtttaacgttaccggactaggtacgtttaaacgtaaacccttccggtacgttacccggtagttacgggtccggtccgggtacggggacggttaccgggacggttaaccgg

SEQ ID NO: 247326 - DNA, 713 bp, Homo sapiens
  misc_feature: GYAE6OF02JP96A.9.70.G04.1.454.CMB.1.raw
  modified_base (478)..(478): a, c, t, g, unknown or other
  misc_feature (478)..(478): n is a, c, g, or t
  modified_base (555)..(555): a, c, t, g, unknown or other
  misc_feature (555)..(555): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtgcagctccagtatggtcctgtcccaggtgcggctgcaggtcgtccgggacccaggacctagtgaacgtccttcgacgtacggccctgtacccctcacctggcctaacgttcgtccttcggtacggtcgtaacctccaacgttacgaagggtacgggttccggttaccgtttacccgtacggtaccggtaccgttagggacctccggacgtacggtcccggaccggtagtaaacgggcgttacgggtacttaagttaggttcggaaacctaagttcctaaggcgtaaccggtggtacgggaccccgtctacggtaacctaccgtacccgtcctagaacgtgtcgactcganctagtcgctacgtcaccgtacgccgagtacctacgttccgaacctgaacgtagttcgattacgtctacggccgtacncgaacgaccgtcgtacgttcgtacttgtacgacggtgtaacggtcgtaacggtttccttaagttaccggctaagttacgttaaacgttaacctccggtaaagttcccgtaggttacccggcgtttcgggaccgggtaccggtagggtaccgtaacccg

SEQ ID NO: 247327 - DNA, 704 bp, Homo sapiens
  misc_feature: GYAE6OF02J2G26.9.70.G04.1.454.CMB.1.raw
  modified_base (195)..(195): a, c, t, g, unknown or other
  misc_feature (195)..(195): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctctcctggtggcagctccagatgggtcctgtccaggtgcggctgcaggagtcggccaggactagtgaacgcttcanaggtccctgtccctgacctgcactgtcctctagggtcactccgatccgagcggttcgtcgttaccacgtggacgtggactccgggctaccggtccggcccggtagaacgggtacttcgggatatacgttaggaacgtaatctaagtcgccgtaggtccgggaaccctcgtactaccgtaacccaacccggtccttaacaagggcgttcggaagttccaaggcctattcgggtacctaggggtaccaaccgtaccgtacccgaacgtaaacccgtacgtttccctacccgtagaaccgtagttagtaacggttactacgttacgtacccgcgaccgaggaaccgtccggtacgttacggttactacggttacggtacgacgttaagtcgggtacgttaaccgtttacgttaaccggacgtacgttaaccgtaacgtttaaaacctcgttaaccggttaccgttcgtacggtaccggttcggtaccgggtaccgacgggtaccgtaaccgg

SEQ ID NO: 247328 - DNA, 910 bp, Homo sapiens
  misc_feature: GYAE6OF02FZ39T.9.70.G04.1.454.CMB.1.raw
tcagtgatacgtctcacgaccggtgctcgatttagtgtagtgtgaagggaaagggcctcgtgaaggcttcactagtcctggacctcctggtgccaagaacgactgaaacgatctgtggttcatcctcctcctggtggcagctccgagatgggttcctgtcccaggtgcggctgactaggagtccgggcccaggactagtgaacgccttacacacggccctgtccctcaccgtgacactgtccttcgtggtctacctccgaatacgaggtacgggttcggttccgttaccctacgtcggacccgttagggaaccgttccggacgtacgtccccggtaccggacggtaacggggtcgttaagggtaacggttagtttacggttacgggaaaccgtaagttaccgtacgtacggacccggtagggtaccggggaacccctacgtaccgtttaaccctaacccgttaacccccgttccctaaacgaaacggtaccggttacggacgtacgtacgtaccgtacgtttaccgtacgtaaccgggtaccctaaacccgtacccgttaacccgaaccggttaaaccgtttacgttacccccgtacgttaacgaaaccggtttaggttacccgtaaacgttttagttacccgtaacccgggacccgacccggtaaggtaacccgggtaacccggtaccccgggttcgtttaaacgggttaccctttaccgggtggtaaccgggaccggtaaacggttacggtacccgggttttaacgttttaaacgggttcccgaaccttagggtttaacccgtttaaaaccggtaaaccctttcccgtaaaaccggtttcggtacccgttaccggggtacgttccggggtaccgggaaacccggtacccggggaacgtttaacccggg

SEQ ID NO: 247329 - DNA, 756 bp, Homo sapiens
  misc_feature: GYAE6OF02JU5XO.9.70.G04.1.454.CMB.1.raw
  modified_base (173)..(173): a, c, t, g, unknown or other
  misc_feature (173)..(173): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggtctgacaggngtcggcccaggactagtgaagccttcacaggtccctgtcccctcacctgctacgtcgtctacgtggtcactacctatcgaggtaggttcggttccgttccgtaacgtcggtaccgtggtaactccggccgtagtccccggccggactaacggggtctacgggaagttaacgtacgtttacggaacggtaaactttccgtaacgtcggtaccgtacgggtacgggggtacccacccgtatacccgtaacccgtaacccccgtacccttacgaaaaccgggtcgtacggaacggttaccacggtaccgtaagttcggtaaacctcgtacgggacctaacccggttacccaacgtacccgttacttacccgtaccctagaaccgtaacgttacggaacttagtcgtaccgtaccgaccgtcgacgtaccgtacggacctagttaccttacggtcgtaggtccgaagtacgggtacgttacggttaactttaacggacctacggtaccgtttaaacgtaaaccttaccggtaacgtacggttacgttacggaccggttacggtcggggacctacgggaacgtaaccg

SEQ ID NO: 247330 - DNA, 812 bp, Homo sapiens
  misc_feature: GYAE6OF02H0ZMM.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccaatcagtaggtggtccgttctactggtacctggactccggacacgttcccgcggtacgaaagggctgggaattagtagttggaacgtaaatccgttaagtcgacctaggtaggggaccccacgtaacttcctaacccgaaacccggttccccttaagaaacgtacgtcggtaaacgttcaacggtacctattacggtaccgtaacggtaccgaactaccccggtacccgaacggtaaaccctaggttttacccgtaccccgtaggtaacctagggttacggtaacggtttaagttaacgttacggaacccggtacccggaacgtaaaccggtaacccggtaaccgggtacccggtttaaggttaaccgtttaaaccggtggttaccggtaccgggaaacggtacgggtaaccgggttaccgtttttaacgtttttaaccgggaaccgttacggtaccgtttaaaacgttttaaaaaaccctcccgttaaaccggttaccggttacggttacgggtaccggtttaccggtaaccgggggaacccggttaaccggggggaaccgttaaacccgggg

SEQ ID NO: 247331 - DNA, 804 bp, Homo sapiens
  misc_feature: GYAE6OF02H749L.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaaacatctgtggttcatccctcctcctggtggcagtctcccagatgggtcctgtcccaggtgcggctgcaggacgtccgggcccaggactagtgaacgtccttcaccgacggtcccctcgtcccctacaccgtgcctacgttcgttccttcgtcgggtactacctcctaagttacgaagggtaacgggtttcggtttcccgtttacccgtacggtaccgggtaaccgttacggggtaaccgtccccgggtacgtaacccgggtccccgggacccggggaacggtaaacgggggtaccgttagggtaaagttaacgttaacggttacggtaaaccgttaaactttccgttaacgtccggtacccggaaggggttacccgggtacccctacctacgttaccccgtaaacccgtacccccgttccctaagaaacgtccgtacgaacgtcaacgctagtcgacgtacgaccgacctacccggtaccaacggtaacccttaccgttcccaccgtagtaaccgtgggtaacgtacgttaactcggaacccgacccgtacgacgaacggtaccggtaccggtcgttattaacgtcgtagggtacgacgagtacggttacgttacgtttaagtacgacgtattaccgttaaattaacctcgaagttccggtataccggtacgtcggaaccgggtacacgggtactaccgg

SEQ ID NO: 247332 - DNA, 754 bp, Homo sapiens
  misc_feature: GYAE6OF02HAPVZ.9.70.G04.1.454.CMB.1.raw
  modified_base (103)..(103): a, c, t, g, unknown or other
  misc_feature (103)..(103): n is a, c, g, or t
  modified_base (211)..(211): a, c, t, g, unknown or other
  misc_feature (211)..(211): n is a, c, g, or t
  modified_base (602)..(602): a, c, t, g, unknown or other
  misc_feature (602)..(602): n is a, c, g, or t
tcagtgatacgtctcacgaccggtgctcgatttagtgtagtgtgaagggaaagggcctgtgaaggcttcacaggccctgtcctcacctgcactgtctctggtnactccatcagtaggtcggtccgttcctactggacctggactcccggcacgtccgcggcaagggtactggagtatattaggacaatctatcgccgtaggtcgggacccncctagtccctaaccaaccccggtccctagaaagtcggtacgacgttcagcctatcgtcacgtcgacctacgtcccaagtaacctacgttcctcctagacgtagtgaagtttatagtcggaccgccgacacgtaccgaccgggtccgttaggtaacttccggtggtgacggaggtacgtacgggtaccgttttaaggtttaaccggacctagtacgtttaaacgttaaaaccttcgtaacgttacccggttgttacggacggttcggtcggggaccgtacggggtaccaacgggtccgtaaccgtcccttcctaccgtacgtccccgtaccgaaacccggttaccggacctacgtcccgggtcccttccccgttaacggcccgtcccgtacnccctacggaccgcgtacccgtcgtaccggagtacgtccgaaaccgcggtaccccggtccggtggtacccttacggtccggttacgtacggtaccgtaacgttaccgtaccggacgttaacgtcgtacgtcggaaccggtcgggaccgtacgg

SEQ ID NO: 247333 - DNA, 641 bp, Homo sapiens
  misc_feature: GYAE6OF02JGVGP.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctacgtggacctggactccggcagtcccgccggcaagggactggatatagtggacgatctatcgccagtcggaccgcatctacacccgtcacaagcgtcgagtcagcagtgtcagtccgacgtaccgtccaagaacccgtagtttcctcccttaggacgtacgttaggtacgttatacgtacgacccgccgaccacggtacctacgggtccgttacgttaacgtttaccgtagggttccgacggtacggtacggtaaacggttccggttttacgtttaacgggacctacgtaccgttaaacggtttaaaacctccgttaaccgtaccggttacgttacgggtaccggttccggtacggggtaccggtacggggtaccgtaaccggg

SEQ ID NO: 247334 - DNA, 671 bp, Homo sapiens
  misc_feature: GYAE6OF02I5SXS.9.70.G04.1.454.CMB.1.raw
  modified_base (200)..(200): a, c, t, g, unknown or other
  misc_feature (200)..(200): n is a, c, g, or t
tcagtgatacgtctcacgaccggtgctcgatttagtgtagtgtgaagggaagggcctgtgaaggcttcactagtcctggacctcctgtgcaaagaacatgaaacatctgtggttcatcctcctctggtggcagctcccagatgggtcctgtcccaggtgcggctgccaggacgtcgggcccaggactagtgaacgccttnacaggtcccttggtccctgacctgcaccttgtctctggtagactccatcaggtacgtggtcgttcctatggtacctgacgtcgcagtccgacggcgaagggctggacgttatagttcggacgtatcgattcgccgtaagttacgggtaccacgtaactcgtaacaaaccccggtcctaacgaacgtagtaccgtaaggtcctaacgtacgaagttacctacgtaacgtccgtaaccacccggttaccaacgtaaactaccggtttcctcccgttagacgtaaggttaccgaaggttactaaggtacgaccctcggactacgaacaccgggtaccggtttcttaagttacgcggtcgtaacgacgaagggttaccgtaccgtttaacgttagggacctaaggtacgttaaacgtaacctacggtaacttacggtcgtagtacggtcggttacggcgtacgggaccggtaacg

SEQ ID NO: 247335 - DNA, 591 bp, Homo sapiens
  misc_feature: GYAE6OF02FXJ0H.9.70.G04.1.454.CMB.1.raw
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
tcagtgatacgtctcacgaccggtgctcgatttagtgtagtgtgaagggaaaggtcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcttcctactggacctggactccggcacgtccgccggcaagggctggagtatagttggacaatctatcgccagtcgggaccnccanctaccgaaccccgtccctanaagtacgtcgaagtcgaagcagtcgtacagtccgaacaccgtacccaacgaaccctagttccctccctgactagtgtattatatcgaccgccgacacgacaccggccgtgtacttacgtgtcgcgagacgaggttccgtttagtttacggaccacggtacttaacgtaaaccttacctaaccgttacggtacgtcggtacgttccggtaggggacccgtacggggtactaaccggg

SEQ ID NO: 247336 - DNA, 785 bp, Homo sapiens
  misc_feature: GYAE6OF02FKSM2.9.70.G04.1.454.CMB.1.raw
  modified_base (164)..(164): a, c, t, g, unknown or other
  misc_feature (164)..(164): n is a, c, g, or t
  modified_base (198)..(198): a, c, t, g, unknown or other
  misc_feature (198)..(198): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggntgcaggagtcgggcccaggactagtgaagccttnacaggccctgtccctcacctcgcactgtctcgtggtgacctccatccaggacgggttggtccgttcctactcggacccgtggaacgttcccgggctacggtcccggcccggtaccgaaaggggtacccgttaggggtaacgttaacgtaagtttacgggaaccgtaaacgtcttaaacgttacggaccccgaaaggttccgggggaacccgtcccgtaacttaccgtaaccaaacccccggttccctaccgaaacgaccggttaccgaaggttcccaaggtccaagttacggtccgtaacggttccgaactacccggtacccgtaacgaaacccgtacgttccgtaccccgttagaccgtaggtacgtaacggttaatagttacgacccggacccggtcaacggacgacccgggaaccgtacgtagtttacgttaaccttacggtcgtaaccggtagtacggaccggttaccgtttacgtttacggacccgtaggtaccgtaacgttaaaaacccgtccgttaacgttaccgggtaccgttacgggaccggtttacgggacggggacccggtacggggtaaacccgg

SEQ ID NO: 247337 - DNA, 789 bp, Homo sapiens
  misc_feature: GYAE6OF02H28AO.9.70.G04.1.454.CMB.1.raw
  modified_base (176)..(176): a, c, t, g, unknown or other
  misc_feature (176)..(176): n is a, c, g, or t
  modified_base (400)..(400): a, c, t, g, unknown or other
  misc_feature (400)..(400): n is a, c, g, or t
  modified_base (627)..(627): a, c, t, g, unknown or other
  misc_feature (627)..(627): n is a, c, g, or t
  modified_base (654)..(654): a, c, t, g, unknown or other
  misc_feature (654)..(654): n is a, c, g, or t
  modified_base (662)..(662): a, c, t, g, unknown or other
  misc_feature (662)..(662): n is a, c, g, or t
tcagtgatacgtctcacgaccggtgctcgatttagtgtagtgtgaagggaaagggcctgtgaaggcttcactagtcctggacctctgtgacaagaacatagaaacatctgtggttcactcctcctccgtggtggccagctcccagactcgggtcctcgtcccagggtggccggtcngacgagggcggtccgggaccccgagggtaacttaggtcggtaagtcccttacgaaccgcggtcccgttccggttacccctcaccgtggcctaacgttcgttcctcgttacgggtcacctaccgacgtcgtacggttaaggggttcgttccgtttaccgttacggtaccggtaccgttggaccgtcccggcgtcgtacccgggaccggacgtaacggggtaccgnggtacgttagttaacggttacggaactaacgttgaaggtccgacggtacggggtacgaacccgtcctaacgtacctaacccgtaaacccggtcctaacggaacgtacgttaccggaacgttcaacggtctaggtaccgacgtcggttacgaccgtacgtacgaccgtaaccgttacgtccctacgtacgccgtaggtgtagttacttccggcgtacccacggtaccncgacgtaccggtacttcgttaacgtcncggttacncggtaacgtgtacggtaacgttttacggtaacgacgtacgttaccgtaaacgtaaccgtttaccgtcgttaaccggtcggtaccgtacggggtccgtaccggggtaacggtaccggtacgtaaccgg

SEQ ID NO: 247338 - DNA, 943 bp, Homo sapiens
  misc_feature: GYAE6OF02JENRJ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcacttcctcctcctggtggcagctcccagatgggtcctgtcccgaggtgcggctgcgaggaggtcgggaccaggtactaggtgaactccttcgactcggaccctgtccctacaccgtgactacgtgtctacgtcgtgacctcatacgagtggttcgtccgttactcgtacgtaccgtaggactccggcgtacgtccggacggacggtacggacgtgggtaactagttacggtggacgaattcgtaacgtcgacgtacgggtcggacctacaccttaacacccggtaccctccgtaacgaaacgttcggtaccgttacgacgttaccgacgttacgttacgacggtaccgtaaccgccggtacccgtaacccggaaccctttaaaaccgggttccggtttcccccgtaaccggttacgttaaacccgggtagttaaaccgttaacgggtttaaaccgttaccgggtaaccccgtaccggggtaaccccggtacgttaaaaccggggtaaccccccgggtaaaccgggtttcccggttaaaagttttaaacccgttaccggggtttcgggtaaaccccgggttaacgggggttaaaaccgggttaaccgggttttaaacccgggtttttaacccggggttttaaacgggtttaaacccgggtaccgttaacccgggtttaaaacccgttttaaaaccgggttaaaaccccgttttaaccggggtaacccgttttaccggggttaaccgggttaccggggttaaccggtttccggggggaaacccggggttttaccccggggaaaggtttaaccccgggtttaacccccggg

SEQ ID NO: 247339 - DNA, 824 bp, Homo sapiens
  misc_feature: GYAE6OF02HO7KN.9.70.G04.1.454.CMB.1.raw
tcagtgatacgtctcacgaccggtgctcgatttagtgtagtgtgaagggaaagggccctgtgaaggcttcactagtcctggaccctcctgtgcaagaacatgaaacatctgtggttcatcctcctcctggtggcagctcccagatgggtcctgtcccagttcgcggctgcgaggagtccgggcccagggactagtgaagtccttacacgacggtccctcggtcccctcgacctgccacgttcgttcctacgttgtcgacctccatcgaggtacggttggttaccgttaccgtagttacggtccttagggacttcccgggtactacggtacccggacccgggtacggaaacggggtacgttacgggtaaggttaattaacggttacgggaacttaacgtcttaacggtcgtaccggtaggttccgggaacccgtaccctaagttaccctaaccgaaccccgttcccgtaaggaaacggtacgttaccggtaaagttcccgaagtaccgttaaggtaccgtacgacggtttacccgaacgtaccccggtacccgaaccgtaaacccgtacgtttcccctaaccgtcggtaacgttaggtacgttaacgttacgtccggtaaccggacccgtaccgtacgaaccgtaccggtccggtacgttacgttaccgttacgtcgtacggtacgtaacgtacggtaccggttaacgttttacgttaccggaccgttaacgtaaccgttaacgttaaacctccggttaaccgtacggttacgttaccgggtacggttaccggtacgggacccggtacgggtaaccgtaaccggg

SEQ ID NO: 247340 - DNA, 856 bp, Homo sapiens
  misc_feature: GYAE6OF02H5CY2.9.70.G04.1.454.CMB.1.raw
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
tcagtgatacgtctcacgaccggtgctcgatttagtgtagtgtgaagggaaaggcctgtgaaggcttcactagtcctggacctctgtgcaagaacatgaaacatctgtgttcatcctcctcctggtcggctagctccagatgggtcctgtcccaggtgcggctgcaggagccgggccaggactagtgaagtccttcactaggcccttgtacccctntaccctgactactgtctcgtgggtnacctccatcgaaggtggtcggtcgttactactcggtacctggactccggacacggtccggccggtacgaaagggtccgtaggaacgttaagttacggtttacggaacttaaacgtacttagtaccgtccggtaaacggttcggggaacccgtacctaacggttacctaaacccggttaacccccggttaccccgttaagaaaaacggttccggtaacgtaaccggtaccgaaggtaccgtaaggttaccgtaaccgttaaggaccgtaacctaacccggtaccgtaaacgaacgtttaccgttaccgttaccctaccggaagttaacgtacggttaacgtttaaacgttaaccgttccggtaaacccgtaccggaaccgttacgggaaacccggtacccgggttaaccggtttaacggtaacgtttaaaccgttcggttaaacgggaccgggtaaacgtaacgggtaccgggtttaaaccttttaacggttttaacggacccgttaacgtaacgtttaaaccggtaaaacctttccgtaagttaacccgttccggttacgggtaacccggtacgggtaaccgggtacccgggtacggggtaacccttaacccggg

SEQ ID NO: 247341 - DNA, 796 bp, Homo sapiens
  misc_feature: GYAE6OF02JSAYG.9.70.G04.1.454.CMB.1.raw
  modified_base (173)..(173): a, c, t, g, unknown or other
  misc_feature (173)..(173): n is a, c, g, or t
  modified_base (192)..(192): a, c, t, g, unknown or other
  misc_feature (192)..(192): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctcgtcccaggtgcggctgcgaggnggtccgggccaggactagngagccttcacacggccctgtccctcacctgcactgtctcgtgtcgacctccatcgaggaggtcgttcgttaccctacgtcggaccgtaggtaccgtcccggccgtacggtccccggccgggtacggaaacgggtccggtaggggtagtacgttagtaggtaaaccgtaatccgtagtccggaccggtaacgggttccgggacccgtacctaacttacccgtaacccgtaaccccgttcccgtaacgaagggacgttccggtacgtacccgaaggtcgtacgttcgtacgaaccggtaccgaccgtaacccgtccccaaacggtacccttaccgttcccgtaacccgtacgaaaccgttgtaggtaaacctttgtaacgtcccgggaccaccgggaccgaaaccggaccggttaccggtaacccggttttaggttaacccttagggttcggtaacggaccgggtaagggtaccggtaaaccggttacccgttttaaggttaccgacgtaacggtaacctttaaaccggttaaaccttcccggtaacgttacggtccggtacgggtaccgtgggtaacccggggagtacccgggaacgtaacccgg

SEQ ID NO: 247342 - DNA, 830 bp, Homo sapiens
  misc_feature: GYAE6OF02HW4MQ.9.70.G04.1.454.CMB.1.raw
  modified_base (229)..(229): a, c, t, g, unknown or other
  misc_feature (229)..(229): n is a, c, g, or t
  modified_base (314)..(314): a, c, t, g, unknown or other
  misc_feature (314)..(314): n is a, c, g, or t
  modified_base (423)..(423): a, c, t, g, unknown or other
  misc_feature (423)..(423): n is a, c, g, or t
tcagtgatacgtctcacgaccggtgctcgatttagtgtagtgtgaagggaaagggcctgtgaaggcctcactagtcctggacctcctgtgcaagaacatgaaacatctgtgttcatcctcctcctggtggctagctcccagatcgggtcctgtcccaggtgcggctgcgaaggagtccgggaccaggtacctagtgaacgtccttacacgacgggtccctacggtcccnctaccgttgcctaacttcggtcttcgtgtaacgacctccatcgaaggtgggttcgtcttaccacgtcgaccttggacctccggtnacgtccggacgactaaaggctagggataacttggttggacctaaatccgtacgtcggactaagggtccgggacccctcgtaactcctaaccgttaacccgtcccgtaanaacggttagccgttaagacgaccgttacgtacgttccggtagaaaccgggttcccaaccgttaaccgtaccccaaacgtaacccgttaaccgggttacccctaccgttaacggaacgttaaacggtcgggttttaaaccgttaaaatcgggttaaccgggaaccctaccccgggtaaataccgaacccgttaacggggttaccttacggtttaaaacttcgggtacgtacgacgggtaaacgtaaccgggttaacgggttacttttaccggtaaaccgaccctttaaggtaaaccggttttaaacccgtaaaaaccctttcccggttaacgggtacccggtttcggtaacgggttccggtacccgggtaccgggtaaaccggggtaccccggtaaaccgtaaccggg

SEQ ID NO: 247343 - DNA, 782 bp, Homo sapiens
  misc_feature: GYAE6OF02IFEPW.9.70.G04.1.454.CMB.1.raw
  modified_base (228)..(228): a, c, t, g, unknown or other
  misc_feature (228)..(228): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcactcctcctctggtggcagctacccatagtgggtcctggtcccagggtcgcggctgcagggacgtcgggccctaggactagtcgaagtccttcaacgacggtccctgtccccntacctagccatgtcctagtgtacgactccaatgaacgtcgggttgttacccgttaccgttagtaccgggtaaccgtacgggtaactccccgggtaccttacggtaccccgggtacccggaaacggtaaacggggtaccgtaggggtaaccgtttaaagttaggtaacggaaccgtaacttcgtaacgttccggacgtaggtcccgggaaccttcaacgttaacccgaccgaacccccgtttccaaagtaaacgggcgaaccgttgcgtaaaccgaccttaagtcgtaaccgtaggtaaacccgtcgtaacccgtacccgtaaacgtaaccgtaccgttaaccgtccgtacgtaagacgttacgttaacgtacttaacggccgtaccgtaccgagtacgaaccgcggttaccgagttacgtacgtgtaacgagacgtcgaaaccggttcttacggttaccggactaaccggttacgttaaccgttaaacgtaccgttaacgaccgtttaacgttcggtacgtaccggtacggaaccggacgggtaccctaacggg

SEQ ID NO: 247344 - DNA, 893 bp, Homo sapiens
  misc_feature: GYAE6OF02HCSHC.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctctctggtggcccccccccagctcccagatgggtcctgtcccaggtgcggctgcaggagtcgggcccaggactagtgaagccttcacacggccctcgtaccctcaccgtgccactcgtctcgtggtacgacctccatcaggtagggttcggtccgtttacccgtaacgtgggtacccgtgggtacgttcccgggacgtaacggttccccggcccgggtaccgaaaacgggggtaccttggggtaagttaacgtttaagtttacggggaaacccggttaaaattcccgttacgttacgggcccgagggttcgggggaccccgtacccgaactttccctaaaccccggttaacccccgttaccccgttacgaaaacggtacgggttaccggaaacggttccgaaaggtcctaacgttcgggtaccgtaacggttacccgaaccggttaacccggttaaccccaaacgggtaaacccccgttaacgttttccccgtacccgtttaccggaaactacgggttacggtaaggtttacccttaagtacccgggaacccggttcccgaccgacggtaaccgggtaccgggtccggtttattacgtttacgtccgggtggtaacggacggtaaggttaccgggttaccgttttaacggttttacggaccccgtaaggtaccgtttaaagttaaaaccccttccgttaaaccggttaccggttacggtcgggtaaccggtttccggtacggggggtaaccgtaccggggtacccggtaaccgg

SEQ ID NO: 247345 - DNA, 776 bp, Homo sapiens
  misc_feature: GYAE6OF02GRVLZ.9.70.G04.1.454.CMB.1.raw
  modified_base (229)..(229): a, c, t, g, unknown or other
  misc_feature (229)..(229): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcactcctcctcctggtgcagctcccagactgggtcctgtcccgaggtcgcggctaggctaggagtccgggcccaggactaggtacgacgtccgttcacgacggccctcgtccccnctacctcgtactacgtcgtcgtacctggtcgaacctccagtcgaggtacggtcggttccgttcctacgtcggtacctggaccgtccggcaccggtcccggtccggacggtaacgggccgtaggtacgttacgttagttacgggacgttaaactcgttagtacggtaccgaacgggttcggggacccacgttaaccgtacgtaaaccccaacccggttacccgtaacctaacggtcggtacgtacgtcggaacgtcctagtacgtctaacggtcgtaacccgtacgtaccccgaacggaccttcggttcccgtaaccaggaacccttgggttaactacgtttaaaccggtagttcccgacccggtaccggtaactaccgggtaaacccgtccgggttacccgttagttaacctggttaccggtaggacccttagggaacgttccggttaacgtttgtacgaccctggtaaccgttaacttaaaccgttaccggtgtacccggttaagtcgggtaccttcgggacgggtccgtaaccggcccgtaccgg

SEQ ID NO: 247346 - DNA, 766 bp, Homo sapiens
  misc_feature: GYAE6OF02J16KQ.9.70.G04.1.454.CMB.1.raw
  modified_base (147)..(147): a, c, t, g, unknown or other
  misc_feature (147)..(147): n is a, c, g, or t
  modified_base (170)..(170): a, c, t, g, unknown or other
  misc_feature (170)..(170): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (323)..(323): a, c, t, g, unknown or other
  misc_feature (323)..(323): n is a, c, g, or t
tcagtgatacgtctcacgaccggtgctcgatttagtgtagtgtgaagggaagggcctgtgaaggcttcactagtcctggacctcctgtgcaagaacagtgaaacatctgtggttcatccctcctcctgggtcggacacgctcccagngtcgggtcctgtccaggtgcgcngcaggcgtcggcctagactcgtagacgtccttcacgtcggcccttgtacccctcacgtnactactgtctcgnggntacctcctntacgtggaggttcgtccttctagtccggtacgtggactcggacgtccggacccgtcggacgacggacgnggtacgtacgtagttcggaacgtattactacgtagaccggtaggtaccgggtccctctaaacggtccctaaccgtaacccccgtttcgaaccggtagtaccggttacggacgttacggaactccggtaacgtacggttacccgtaacggtaccgtaaccccgtaccggtaccgtaaacccgtacccgtttaacgttaccccgtaacccgtacggttaaccgtaggggtttaacgtaaccgtttaacgtcggtccccggtacccgaccgttacggaaaccgtcggtaacccgggttcgttacttaacgttcgtacgttaacgcgtaaaggacgggttacgttaacgtttagtccgtacgttcgtacgtaaacttcccggtagtacccggttgtaacgggttcctaccgggttcgagggaaccgggtcccggtagttaacccggg

SEQ ID NO: 247347 - DNA, 636 bp, Homo sapiens
  misc_feature: GYAE6OF02JC9CT.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacagccctgtccctcaccctgccacttcgtctctggtcgacctccatcagaggtgtcgttcctactggacctggactccggctacggtccgccgggtacaaggggacctgggaagtatagtttacggacgtaatctatcgccgtaggtcgggacccgcctatcctaaccgaaccccgtccctacgaaggcgttccgagtcagcactggtcacgtcgaacctaccgtaccaacgtaacctacgttccctaccctacggactagttacgtacggttatacgtacgtacccgaccgacgtacgaccgaccggtccgtagttaattacgtgtacgcggagacggtacggtccgtttaagtttacggactacggtacttaacgttaaacctccttaacgtacgtcgtacggtcgtcgtcggggaccgtacgggacctaaccgg

SEQ ID NO: 247348 - DNA, 810 bp, Homo sapiens
  misc_feature: GYAE6OF02HO92E.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctccagatgggtcctcgtcccgaggtgcggctgcgaggacggtccgggacccaggactaggtagaacgtccttacacgacggccctcgtccctacaccgtgactactcgtcgttcgtggtcaccgtccaatcgaggtacggtcggttaccgttaccgtacgttacggaccgtaggtaacgtcccggacgtacggtacccggtaccggacggtaaacggggtactacgggtaagttaagttaacggttacggaacgtaacttacgtacgtacgtaccggtacgggtaccggaacccgactaccgttaaccgtaaacccgtaaccccgttcccgtaacgaaacggtacgtacggtaacgtacgaacgtacgtaacgttacgacgtacgacgaccgtaccgtaaccgaacgtaacccgtaacgtttccctaccgtagaaccgtaggttacgtaagttaacgtacggtacgacccggtacgaccgaacgtacccgaaccggttacgttagttaacgttaccgtaggtcggtaacggtaggtaaccgggtaacgttacgtttaacgtttaaccggaccgttacgtaaccgtttaaaacgttaaacccgttccgttaaaccggttacccggttcggtacggttaccggtaccggttacggggaccgtacgggaccgtaaccgg

SEQ ID NO: 247349 - DNA, 825 bp, Homo sapiens
  misc_feature: GYAE6OF02IV1S1.9.70.G04.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctcccagagtgggtacctgtcccaggtgcggctgcaggagtcgggcccaggacttagtgaagtccttcaacgcggtccctgtcccctcgacctgcactgttcncttaggtnacctccatacgaggtagggtcggttaccttcccgtaacgtcggtaactacggtactccggcgtaaccggtcccgggaccggacgtaacggggacgtacggtaagttacgtaagttcggaacgtaacttcgtaagtccggtaccgaggtacgggaacccttcaacgttaccttaaacccggtaacccccgttcccgtaaaccgtaaggtaccggttacgaacgtaccggaacgcctaagtttaccggtacctaacggttaccggaacctaaccggttaccccgaaagtaaccgtaaccgtttacccgttaaccgtcgtaacgtagttacgacgtttacgtaacgtaccggaccgttacccgaacgtaccggtaaacgtccggtaaccggttacgtttacgtttaccgacggtttaccgaggaaaccgggtaacggtccgggtttaacgtttaccggttttaacggaacccgttaagttacgttttaaaaccggtaaacccttaaaccgttcgtttaaacccggttcggttacggaaccggttttaccggacgggtacccggtaaccgggacgttaacccggg

SEQ ID NO: 247350 - DNA, 730 bp, Homo sapiens
  misc_feature: GYAE6OF02IQ4ZP.9.70.G04.1.454.CMB.1.raw
  modified_base (401)..(401): a, c, t, g, unknown or other
  misc_feature (401)..(401): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccagatgggtcctgtcccagggtgcggctgcaggagtccgggccaggactagtagaacgtccttacacacggcccttagtcccctccacccgtgacctacgttgtccttctgggttacaccttacccatccgaggtacgggttcggttacgtttcccaattcgggaacctgggtaccgttccgggacaacggtcccggacggtacgaaaggggtcttgggaacgttatagttaggaacgtaatcctatcgccgagtcgggtaccnctatacctaccgacccgtcctacaaggtacncgagtcancgatgtacaggtacactaccgtaccaagtaacctacggttcctaccgtagaacgtacggtacgtaattacgtacgtacgtacccgaccggtacgtaacgaccgtaccgggtacgttacgttacgtttacgtacggtacgacggtaacgacggtacggtttaaaccgttttcgtttaaacggcctaacggttacttaaacccggttttaaaacctcccgttaaacgtacccggttagttacgggtacccgttacggtaccggggtaaccggtacgggtaccctaaaccggg

SEQ ID NO: 247351 - DNA, 844 bp, Homo sapiens
  misc_feature: GYAE6OF02J1KGV.9.70.G04.1.454.CMB.1.raw
  modified_base (446)..(446): a, c, t, g, unknown or other
  misc_feature (446)..(446): n is a, c, g, or t
tcagtgatacgtctcacgaccggtgctcgatttagtgtagtgtgaaggggaaagggcctgtgaaggcttcactagtcctggacctcctgtgcaagaacatgaaacatctgtgttcactccctcctccgtgggtcggcagcctaccccagacgtcgggttccctcgtcccccgagggtggccggtctgcgaggacggtccgggacccgagtacgtaggtagaaccgtccttcacgacgtccctcgtaccctccaccgtcgactaccttcgttcctacgtcggtacgacccttaccagtacgtaggtacgggttccgttcccgttacctacggtacggtacccgttacggaccgttcccggaccgtcccggtcccggcccgggacggaacggtcgtagggtacgttaacgttaggtacgaaccgtactttacgtacgaccgtaccggngggtaccggcccgacctacgaccctaaccccgaccccggtctaacgaacgtacggttccgtagaccgtcaacgttacgtcgtaaccgtaccggccgtaaccgtacccgacccgaaccgtaccgttacgtaccccgtacccgtagtaaccggttacttacggttaacgttaccgaaccggtttcccggacccgttaccggcctaaccgtacccggtaccgttaaccggttattaacccgttggacggttcggaacggtaacggtacgggttaccgtttaaccgtttaggtaccgaccggttacgtaaacgtttaaccttaacggtacccttaacggttaccggtacgtaccggtcggtacggggttaacccggacgggttaaccggtaccgtaaccggg

SEQ ID NO: 247352 - DNA, 762 bp, Homo sapiens
  misc_feature: GYAE6OF02INO0F.9.70.G04.1.454.CMB.1.raw
  modified_base (470)..(470): a, c, t, g, unknown or other
  misc_feature (470)..(470): n is a, c, g, or t
  modified_base (654)..(654): a, c, t, g, unknown or other
  misc_feature (654)..(654): n is a, c, g, or t
tcagtgatacgtctcacgaccggtgctcgatttagtgtagtgtgaagggaaagggcctgtgaaggcttcactagtcctggacctcctgtgcaagaacatagaaacatctgtggttcatcctcctcctggtggcagctcccagatgggtcctgtcccaggtgcggctgcaggagtcgggacccaggactagtgaagccttcacacggccctgtccctcacctgcactgtctctggtcacctccatcgagtaggttcgtccttacctagtcggtacctgggtactccggcacggtccggccggtacgaaacggggtacctgggtaagttattaacgggtttagggaaccgttaaattcccgttaagtaccggtaccgtaaaggggtccggggaaccccgtaccctaacttacccgttaaaccccgaaccccccggtttccctaaacggaaggtaccggtcgtaacccgttanaacgggtcaacggttcgtacgtaaccggttaccgaaccgtaacccgtacccgaaacggtaacccgttacgtttacccgtaccccgtagaaacgtacgtagtaacgtttaacgtacgtaccggacccggaccgtaccgacggaccgaccgggtcgttacgttacttacgtagtacgcgtaacggngtaacgtccgtttaagttacggactaagtaccttaacgttaaacctccgttaacgtacggttacgtcggtaccggtccggtacggggaccgtacgggaaccgtaccgg

SEQ ID NO: 247353 - DNA, 822 bp, Homo sapiens
  misc_feature: GYAE6OF02JIIJH.9.70.G04.1.454.CMB.1.raw
  modified_base (171)..(171): a, c, t, g, unknown or other
  misc_feature (171)..(171): n is a, c, g, or t
  modified_base (216)..(216): a, c, t, g, unknown or other
  misc_feature (216)..(216): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggngtcgggcccaggactagtgaagtccttcacgaggccctgtccctnacctgcactgtctcgtggtcgacctccatcgaaggtacgggttcggttaccgttacctacgtacggacccgttaggtacctcccgggtactaccggtcccggacccgggtaacggaaaaccggggtcgttaggggtaacgttaaagtttacggtttacgggaaacccgtaatttccgtaagtccgggacccgtaggggttacggggacccctactacgttaacctaacccggtaacccccgtcccgtacgtaaaggacgttaccgggaacgttccgaaggttacaacgttacgttccgaacgttcggaaaccgtacccgtacccgtaaggaaccctacgggtttaccctcccgtaggacgtacggttagtaaacgtttacgtaacgtacggaccccggtcgaaccgaccggtaacccggaccggttccggttaacggttacctttaacggtcggtacggtaaccggtaacggtaacgggtaacgggttttaccgtttaacggtttaacgggaccctaagtccgtttaaaacgttaaaccttcgtaaccgttacggttcgtaacggtaccggttcgggaccggtaaccgggacggtacctaacgggg

SEQ ID NO: 247354 - DNA, 702 bp, Homo sapiens
  misc_feature: GYAE6OF02GMF6U.9.70.G04.1.454.CMB.1.raw
  modified_base (400)..(400): a, c, t, g, unknown or other
  misc_feature (400)..(400): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtagaagccttcacacggccctgtccctcacctgccactgtccttctggtcgactccatccagtggtacggttcgttcctactcggaccgtcggactccggacacgtcccggccggcgaagggtacgtacgggagtaacgttagttacggaacgtaactacttacgtcgacgacggtacgggaccgaccctatcctacctaacccgtccctanaagtacgtcgagttacgacgtcagttacgtacgagtaccgtaccgaccgtaccgacgaaccctcgttcctcctcgaactgggtactacgttagtacgtacgaccgaccgtgaacgaaccgtcgggtacccttaggttaacttacggttcgtaacggtccgaagggtcgtaacgggttaacccgtttaagtttaccgggacttacgacggtttaacgttaaaacccgttcgttaaccggttacgttaccggtacgtacgggttcccggacggggtaaccgggtaccgggaaccgtaacccggg

SEQ ID NO: 247355 - DNA, 155 bp, Homo sapiens
  misc_feature: GYAE6OF01C3D9Y.5.25.C03.1.454.CMB.1.raw
  modified_base (155)..(155): a, c, t, g, unknown or other
  misc_feature (155)..(155): n is a, c, g, or t
tcagatcagacacgcacgaccggtgctcgatttagtagtgtagatttgggtttgggggaagaggaagactgacggtcctgccacagcggccctgggctgcctggtcaaggactacttccattactctatctgagcgggctggcaaggcgcatagn

SEQ ID NO: 247356 - DNA, 155 bp, Homo sapiens
  misc_feature: GYAE6OF01A2S5X.5.25.C03.1.454.CMB.1.raw
  modified_base (155)..(155): a, c, t, g, unknown or other
  misc_feature (155)..(155): n is a, c, g, or t
tcagatcagacacgcacgaccggtgctcgatttagtagtgtagatttgggtttgggggaagaggaagactgacggtcctgccacagcggccctgggctgcctggtcaaggactacttccagtactctatctgagcgggctggcaaggcgcatagn

SEQ ID NO: 247357 - DNA, 155 bp, Homo sapiens; identical to SEQ ID NO: 247356
  misc_feature: GYAE6OF02HK5LE.5.25.C03.1.454.CMB.1.raw
  modified_base (155)..(155): a, c, t, g, unknown or other
  misc_feature (155)..(155): n is a, c, g, or t

SEQ ID NO: 247358 - DNA, 156 bp, Homo sapiens
  misc_feature: GYAE6OF02IX10S.5.25.C03.1.454.CMB.1.raw
  modified_base (155)..(156): a, c, t, g, unknown or other
  misc_feature (155)..(156): n is a, c, g, or t
tcagatcagacacgcacgaccggtgctcgatttagtagtgtagatttgggtttgggggaagaggaagactgacggtcctgccacagcggccctgggctgcctggtcaaggactacttccagtactctatctgagcgggctggcaaggcgcatagnn

SEQ ID NO: 247359 - DNA, 156 bp, Homo sapiens; identical to SEQ ID NO: 247358
  misc_feature: GYAE6OF02IHVI5.5.25.C03.1.454.CMB.1.raw
  modified_base (155)..(156): a, c, t, g, unknown or other
  misc_feature (155)..(156): n is a, c, g, or t

SEQ ID NO: 247360 - DNA, 155 bp, Homo sapiens; identical to SEQ ID NO: 247356
  misc_feature: GYAE6OF02I44BS.5.25.C03.1.454.CMB.1.raw
  modified_base (155)..(155): a, c, t, g, unknown or other
  misc_feature (155)..(155): n is a, c, g, or t

SEQ ID NO: 247361 - DNA, 157 bp, Homo sapiens
  misc_feature: GYAE6OF02G93AH.5.25.C03.1.454.CMB.1.raw
  modified_base (155)..(157): a, c, t, g, unknown or other
  misc_feature (155)..(157): n is a, c, g, or t
tcagatcagacacgcacgaccggtgctcgatttagtagtgtagatttgggtttgggggaagaggaagactgacggtcctgccacagcggccctgggctgcctggtcaaggactacttccagtactctatctgagcgggctggcaaggcgcatagnnn

SEQ ID NO: 247362 - DNA, 124 bp, Homo sapiens
  misc_feature: GYAE6OF02IUTDS.5.25.C03.1.454.CMB.1.raw
tcagatcagacacgcacgaccggtgctcgatttagtagtgtagatttgggtttgggggaagaggaagactgacggtcctgccacagcggccctgggctgcctggtcaaggactacttccagtac

SEQ ID NO: 247363 - DNA, 156 bp, Homo sapiens
  misc_feature: GYAE6OF02GM5MW.5.25.C03.1.454.CMB.1.raw
  modified_base (156)..(156): a, c, t, g, unknown or other
  misc_feature (156)..(156): n is a, c, g, or t
tcagatcagacacgcacgaccggtgctcgatttagtagtgtagatttgggtttggggggaagaggaagactgacggtcctgccacagcggccctgggctgcctggtcaaggactacttccagtactctatctgagcgggctggcaaggcgcatagn

SEQ ID NO: 247364 - DNA, 168 bp, Homo sapiens
  misc_feature: GYAE6OF02FS5Q7.5.25.C03.1.454.CMB.1.raw
  modified_base (158)..(168): a, c, t, g, unknown or other
  misc_feature (158)..(168): n is a, c, g, or t
tcagatcagacacgcacgaccggtgctcgatttagtagtgtagatttggggtttgggggggaagaggaagactgacggtcctgccacagcggccctgggctgcctggtcaaggactacttccagtactctatctgagcgggctggcaaggcgcatagnnnnnnnnnnn

SEQ ID NO: 247365 - DNA, 256 bp, Homo sapiens
  misc_feature: GYAE6OF01DDZAB.1.39.D06.1.454.CMB.1.raw
  modified_base (251)..(256): a, c, t, g, unknown or other
  misc_feature (251)..(256): n is a, c, g, or t
tcagacgagtgcgtcacgaccggtgctcgatttagtgacatctcgtcgcgggtcagggacagatttcacactgaaaatcagccgggtggaggctgaggatgttggggtttattactgcatgcaaagtatccagcttcgaacgttcggccaagggaccaaggtggaattcagacgaactgtggctgcaccatctgtcttcatcttccgccatctgaacgcactcgtctgagcgggctggcaaggcgcatagnnnnnn

SEQ ID NO: 247366 - DNA, 281 bp, Homo sapiens
  misc_feature: GYAE6OF01D5QHD.1.39.D06.1.454.CMB.1.raw
  modified_base (259)..(281): a, c, t, g, unknown or other
  misc_feature (259)..(281): n is a, c, g, or t
tcagacgagtgcgtcacgaccggtgctcgatttagtgacatctcgtcggtcggggtcagggacagatttcacacctgaaaatcagccgggtggacggctgaggatgttgggtttattactgcatgcaaagtatccagcttcgaacgttcggccaaagggaccaaggtggaattcagacgaactgtggctgcaccatctgtcttcgaatcttcccaccctcctcacgcactcgtctgagcgggctggcaaggcgcatagnnnnnnnnnnnnnnnnnnnnnnn

SEQ ID NO: 247367 - DNA, 254 bp, Homo sapiens
  misc_feature: GYAE6OF01D11SQ.1.39.D06.1.454.CMB.1.raw
  modified_base (250)..(254): a, c, t, g, unknown or other
  misc_feature (250)..(254): n is a, c, g, or t
tcagacgagtgcgtcacgaccggtgctcgatttagtgacatctcgtcgcgggtcagggacagatttcacactgaaatcagccgggtggaggctgaggatgttggggtttattactgcatgcaaagtatccagcttcgaacgttcggccaagggaccaaggtggaattcagacgaactgtggctgcaccatctgtcttcatcttcccgccatctgaacgcactcgtctgagcggctggcaaggcgcatagnnnnn

SEQ ID NO: 247368 - DNA, 302 bp, Homo sapiens
  misc_feature: GYAE6OF01CJ7E2.1.39.D06.1.454.CMB.1.raw
  modified_base (293)..(302): a, c, t, g, unknown or other
  misc_feature (293)..(302): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagattttgccacttactactgtcaacagagtttcgatgcctggacgtggacgttcggccaagggaccagggtggatatcaaaacgactgtggctgcaccatctgtcttcatcttcccgcatctgaacgcactcgtctgagcgggctggcaaggcgcatagnnnnnnnnnn

SEQ ID NO: 247369 - DNA, 259 bp, Homo sapiens
  misc_feature: GYAE6OF01EPK2W.1.39.D06.1.454.CMB.1.raw
  modified_base (250)..(259): a, c, t, g, unknown or other
  misc_feature (250)..(259): n is a, c, g, or t
tcagacgagtgcgtcacgaccggtgctcgatttagtgacatctcgtcgcgggtcagggacagatttcacactgaaaatcagccgggtggaggctgaggatgttggggtttattactgcatgcaaagtatccagcttcgaacgttcggccaagggaccaaggtggaattcagacgaactgtggctgcaccatctgtcttcatcttccgcatctgaacgcactcgtctgagcgggctggcaaggcgcatagnnnnnnnnnn

SEQ ID NO: 247370 - DNA, 234 bp, Homo sapiens
  misc_feature: GYAE6OF01BI1KB.1.39.D06.1.454.CMB.1.raw
  modified_base (226)..(234): a, c, t, g, unknown or other
  misc_feature (226)..(234): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagattttgccacttactactgtcaacagagtttcgatgcctggtcaaggactacttccacgcactcgtctgagcgggctggcaaggcgcatagnnnnnnnnn

SEQ ID NO: 247371 - DNA, 350 bp, Homo sapiens
  misc_feature: GYAE6OF01AQP6T.1.39.D06.1.454.CMB.1.raw
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (300)..(302): a, c, t, g, unknown or other
  misc_feature (300)..(302): n is a, c, g, or t
  modified_base (304)..(309): a, c, t, g, unknown or other
  misc_feature (304)..(309): n is a, c, g, or t
  modified_base (311)..(311): a, c, t, g, unknown or other
  misc_feature (311)..(311): n is a, c, g, or t
  modified_base (313)..(314): a, c, t, g, unknown or other
  misc_feature (313)..(314): n is a, c, g, or t
  modified_base (316)..(316): a, c, t, g, unknown or other
  misc_feature (316)..(316): n is a, c, g, or t
  modified_base (318)..(350): a, c, t, g, unknown or other
  misc_feature (318)..(350): n is a, c, g, or t
tcagacgagtgcgtcacgaccggtgctcgatttagtgacatctcgcaggttctttgggatagaagttattcagcaggcacacaacagaggcagttacagatttcactctcaccatcagcagtctgcaacctgaagattttaccacttactactgtcaacagtagttcgatgcctggacgtggacgttcggccaggggaccaaggtggaagtcaacgatgtggcgtgcacatctgtctcatcttccgccatctgaacgctactcgtctgagcggctcggcgaacggcgcactaggngncgnnngnnnnnngngnnanannnnnnnnnnnnnnnnnnnnnnnnnnnnnnnnn

SEQ ID NO: 247372 - DNA, 258 bp, Homo sapiens
  misc_feature: GYAE6OF01BS4BM.1.39.D06.1.454.CMB.1.raw
  modified_base (252)..(258): a, c, t, g, unknown or other
  misc_feature (252)..(258): n is a, c, g, or t
tcagacgagtgcgtcacgaccggtgctcgatttagtgacatctcgtcgcgggtcagggacagatttcacactgaaaatcagccgggtggaggctgaggatgttggggtttattactgcatgcaaagtatccagcttcgaacgttcggccaagggaccaaggtggaattcagacgaactgtggctgcaccatctgtcttcatcttcccgccatctgaacgcactcgtctgagcgggctggcaaggcgcatagnnnnnnn

SEQ ID NO: 247373 - DNA, 257 bp, Homo sapiens
  misc_feature: GYAE6OF01DXKSF.1.39.D06.1.454.CMB.1.raw
  modified_base (251)..(257): a, c, t, g, unknown or other
  misc_feature (251)..(257): n is a, c, g, or t
tcagacgagtgcgtcacgaccggtgctcgatttagtgacatctcgtcgcgggtcagggacagatttcacactgaaaatcagccgggtggaggctgaggatgttggggtttattactgcatgcaaagtatccagcttcgaacgttcggccaagggaccaaggtggaattcagacgaactgtggctgcaccatctgtcttcatcttcccgcatctgaacgcactcgtctgagcgggctggcaaggcgcatagnnnnnnn

SEQ ID NO: 247374 - DNA, 301 bp, Homo sapiens
  misc_feature: GYAE6OF01A446K.1.39.D06.1.454.CMB.1.raw
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
  modified_base (296)..(301): a, c, t, g, unknown or other
  misc_feature (296)..(301): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagtattttgccacttactactgtcaacagtagtttcgatgcctggacgtggacgttcggccgaagggaccagggtggatatacaaacgactgtggctgcaccatctgtctcatcttcncgccatctgaacncactcgtctgagcgggctggcaaggcncatagnnnnnn

SEQ ID NO: 247375 - DNA, 316 bp, Homo sapiens
  misc_feature: GYAE6OF01CQ56V.1.39.D06.1.454.CMB.1.raw
  modified_base (308)..(316): a, c, t, g, unknown or other
  misc_feature (308)..(316): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagtattttgcctacttactactgtacaacagagtttcgatgcctggacgtggacgttcggcaagggccagggtgatatacaaacgactgtggctgcaccatctgtcttcattccttcccgcattctgaacgcacgtcgtctggacggccgggctagggccaagggcctacgatagnnnnnnnnn

SEQ ID NO: 247376 - DNA, 285 bp, Homo sapiens
  misc_feature: GYAE6OF01CBOLH.1.39.D06.1.454.CMB.1.raw
  modified_base (219)..(219): a, c, t, g, unknown or other
  misc_feature (219)..(219): n is a, c, g, or t
  modified_base (266)..(285): a, c, t, g, unknown or other
  misc_feature (266)..(285): n is a, c, g, or t
tcagacgagtgcgtcacgaccggtgctcgatttagtgacatctcgtcgcgggtcagggacagatttcacactgaaaatcagccgggtggaggctgaggatggttggggtttattactgcatgacaaagtatccagcttcgaacgttcggcaagggaccaaggtgaattcagacgaactgtggctgcaccatctgtcttcatcctccgccatcagaaccncacttcgtctggacggcggggctgggacaaggcgacaagttaagcgnnnnnnnnnnnnnnnnnnnn

SEQ ID NO: 247377 - DNA, 301 bp, Homo sapiens
  misc_feature: GYAE6OF01ER4DD.1.39.D06.1.454.CMB.1.raw
  modified_base (284)..(284): a, c, t, g, unknown or other
  misc_feature (284)..(284): n is a, c, g, or t
  modified_base (290)..(291): a, c, t, g, unknown or other
  misc_feature (290)..(291): n is a, c, g, or t
  modified_base (293)..(301): a, c, t, g, unknown or other
  misc_feature (293)..(301): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagattttgccacttactactgtcaacagtagtttcgatgcctggacgtggacgttcggccaagggaccagggtgatatcaaacgactgtggctgcaccatctgtcttcatcttcccacctcctcacgcactcgctgagcggctggcaaggcncatagnncnnnnnnnnn

SEQ ID NO: 247378 - DNA, 252 bp, Homo sapiens
  misc_feature: GYAE6OF02IG1BP.1.39.D06.1.454.CMB.1.raw
  modified_base (252)..(252): a, c, t, g, unknown or other
  misc_feature (252)..(252): n is a, c, g, or t
tcagacgagtgcgtcacgaccggtgctcgatttagtgacatctcgtcgcgggtcagggacagatttcacactgaaaatcagccgggtggaggctgaggatgttggggtttattactgcatgcaaagtatccagcttcgaacgttcggccaagggaccaaggtggaattcagacgaactgtggctgcaccatctgtcttcatcttcccgccctcctcacgcactcgtctgagcgggctggcaaggcgcatagn

SEQ ID NO: 247379 - DNA, 254 bp, Homo sapiens
  misc_feature: GYAE6OF02FP1GG.1.39.D06.1.454.CMB.1.raw
  modified_base (251)..(254): a, c, t, g, unknown or other
  misc_feature (251)..(254): n is a, c, g, or t
tcagacgagtgcgtcacgaccggtgctcgatttagtgacatctcgtcgcgggtcagggacagatttcacactgaaaatcagccgggtggaggctgaggatgttggggtttattactgcatgcaaagtatccagcttcgaacgttcggccaagggaccaaggtggaattcagacgaactgtggctgcaccatctgtcttcatcttcccgcctcctcacgcactcgtctgagcgggctggcaaggcgcatagnnnn

SEQ ID NO: 247380 - DNA, 299 bp, Homo sapiens
  misc_feature: GYAE6OF02HVLV3.1.39.D06.1.454.CMB.1.raw
  modified_base (293)..(299): a, c, t, g, unknown or other
  misc_feature (293)..(299): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagattttgccacttactactgtcaacagagtttcgatgcctggacgtggacgttcggccaagggaccagggtggatatcaaacgaactgtggctgcaccatctgtcttcatcttcccgcatctgaacgcactcgtctgagcgggctggcaaggcgcatagnnnnnnn

SEQ ID NO: 247381 - DNA, 257 bp, Homo sapiens
  misc_feature: GYAE6OF02GJERE.1.39.D06.1.454.CMB.1.raw
  modified_base (252)..(257): a, c, t, g, unknown or other
  misc_feature (252)..(257): n is a, c, g, or t
tcagacgagtgcgtcacgaccggtgctcgatttagtgacatctcgtcgcgggtcagggacagatttcacactgaaaatcagccgggtggaggctgaggatgttggggtttattactgcatgcaaagtatccagcttcgaacgttcggccaagggaccaaggtggaattcagacgaactgtggctgcaccatctgtcttcatcttcccgccatctgaacgcactcgtctgagcgggctggcaaggcgcatagnnnnnn

SEQ ID NO: 247382 - DNA, 258 bp, Homo sapiens
  misc_feature: GYAE6OF02HBXGA.1.39.D06.1.454.CMB.1.raw
  modified_base (250)..(258): a, c, t, g, unknown or other
  misc_feature (250)..(258): n is a, c, g, or t
tcagacgagtgcgtcacgaccggtgctcgatttagtgacatctcgtcgcgggtcagggacagatttcacactgaaaatcagccgggtggaggctgaggatgttggggtttattactgcatgcaaagtatccagcttcgaacgttcggccaagggaccaaggtggaattcagacgaactgtggctgcaccatctgtcttcatcttcccgcatctgaacgcactcgtctgagcggctggcaaggcgcatagnnnnnnnnn

SEQ ID NO: 247383 - DNA, 255 bp, Homo sapiens
  misc_feature: GYAE6OF02GT2SB.1.39.D06.1.454.CMB.1.raw
  modified_base (252)..(255): a, c, t, g, unknown or other
  misc_feature (252)..(255): n is a, c, g, or t
tcagacgagtgcgtcacgaccggtgctcgatttagtgacatctcgtcgcgggtcagggacagatttcacactgaaaatcagccgggtggaggctgaggatgttggggtttattagtgcatgcaaagtatccagcttcgaacgttcggccaagggaccaaggtggaattcagacgaactgtggctgcaccatctgtcttcatcttcccgccatctgaacgcactcgtctgagcgggctggcaaggcgcatagnnnn

SEQ ID NO: 247384 - DNA, 298 bp, Homo sapiens
  misc_feature: GYAE6OF02FL4KT.1.39.D06.1.454.CMB.1.raw
  modified_base (266)..(266): a, c, t, g, unknown or other
  misc_feature (266)..(266): n is a, c, g, or t
  modified_base (291)..(298): a, c, t, g, unknown or other
  misc_feature (291)..(298): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagattttgccacttactactgtcaacagagtttcgatgcctggacgtggacgttcggccaagggaccagggtggatatcaaacgactgtggctgcaccatctgtctcatcttccgccatctgaacgcactcgtntgagcggctggcaaggcgcataggnnnnnnnn

SEQ ID NO: 247385 - DNA, 307 bp, Homo sapiens
  misc_feature: GYAE6OF02G5BFF.1.39.D06.1.454.CMB.1.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (297)..(307): a, c, t, g, unknown or other
  misc_feature (297)..(307): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagattttgccacttactactgtcaacagagtttcgatgcctggacgtggacgttcggccaagggaccagggtggatatcaaacgactgtggctgcaccatctgtcttcattccttcccgcatcngaacgcnctcgtctgacggcggctgggcaaggcgcagtagnnnnnnnnnnn

SEQ ID NO: 247386 - DNA, 314 bp, Homo sapiens
  misc_feature: GYAE6OF02FQKX3.1.39.D06.1.454.CMB.1.raw
  modified_base (263)..(263): a, c, t, g, unknown or other
  misc_feature (263)..(263): n is a, c, g, or t
  modified_base (296)..(314): a, c, t, g, unknown or other
  misc_feature (296)..(314): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagattttgccacttactactgtcaacagagtttcgatgcctggacgtggacgttcggccaagggaccagggtgatagtcaaacgaactgtggctgcaccatctgtcttcattccttcccgctatctgaacncactcgtctgagcggctgggcaaggcgcatagnnnnnnnnnnnnnnnnnnn

SEQ ID NO: 247387 - DNA, 319 bp, Homo sapiens
  misc_feature: GYAE6OF02H548Q.1.39.D06.1.454.CMB.1.raw
  modified_base (251)..(251): a, c, t, g, unknown or other
  misc_feature (251)..(251): n is a, c, g, or t
  modified_base (310)..(319): a, c, t, g, unknown or other
  misc_feature (310)..(319): n is a, c, g, or t
tcagacgagtgcgtcacgaccggtgctcgatttagtgacatctcgcagttctttgggatagaagttattcagcaggcacacaacagaggcagttacagatttcactctcaccatcagcagtctgcaacctgaagtattttgcctacttactactgtcaacagtagtttcgatgccgttggacgtggacgttccggaccaaagggaccaggggtggaatatacaaacgaactggtggctgcacatctgtctnatccttcccgcattctcgaacgccaccgtctaggagccggctggcgaaggcgacagagnnnnnnnnnn

SEQ ID NO: 247388 - DNA, 813 bp, Homo sapiens
  misc_feature: GYAE6OF01DH7LQ.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactcctctgtgcacgtcccgtaccggtacctttccccttactaggttagtttagttaggtagtcgtacggttcgggtcccgccgacgtaccgtaccggaagggggaacggggtcgtaggggtagggttggggtcggaccaaacgtaaagtaaacgacgaaagagtacggtaacgtcggaccggtttaacggtttttacgggtacgggtaccgttcgttagggtacgggtaaacggggttcccgtttacccgaacccgtacttcccgttaccgaacggaacgaaacccgaaacccgaacccgtaaaagttaacttacctaaacgttagttaacttaccctaaaccaaacgttaacgaaaccaccgtcccgtaagggaacggtacgtccgacgaaccgaacccggaccgggtcccggttagttaacgtttacgtgggtacgacggtaagtacgttaggggtaaaacggtaaaaagtttaggtcgggtacgttggttttaggttttacggggtccggggtaccggaaaggggtcccttacccgggtcgggtaccccgttaaccccgg

SEQ ID NO: 247389 - DNA, 584 bp, Homo sapiens
  misc_feature: GYAE6OF01D3JH9.17.28.C06.1.454.CMB.1.raw
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgaggggaagggctggagtgggtggccaanataaagcaaagatggaactgccgtagttttacgnggactctgtgaagggtccgtttcaccatctccagagacaacgccaagattcaactgtatctaacaactgaacagcctagagagtcgcagaccacggccgtagtattactgtgcgaagatggtaaggaaaaaagttagtagggcttggttaggttttaagttcgggggaccctaagggggacgccccggttgggtccctaccccggg

SEQ ID NO: 247390 - DNA, 599 bp, Homo sapiens
  misc_feature: GYAE6OF01APBKP.17.28.C06.1.454.CMB.1.raw
  modified_base (448)..(448): a, c, t, g, unknown or other
  misc_feature (448)..(448): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgaggggaaggggctggagtgggtggcccaacataaagcaagatggaactgccgtagtttacgtggactctgtgaaggtccgtttcaccatctccagagacaacgccaagattcactgtatctacaactgaacngcctgagagtcgcagacacggccgtagtattactggtacgcggtagagtaggtaagggaaaaaagttagtgggtacttgggttaggtttttaacggttcggggggtaacccgtagggggtaacgtcccccgttggggttcccctaacccgg

SEQ ID NO: 247391 - DNA, 547 bp, Homo sapiens
  misc_feature: GYAE6OF01A07J5.17.28.C06.1.454.CMB.1.raw
  modified_base (376)..(376): a, c, t, g, unknown or other
  misc_feature (376)..(376): n is a, c, g, or t
  modified_base (500)..(500): a, c, t, g, unknown or other
  misc_feature (500)..(500): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtcccgccagactccaggggaaggggctggagtgggtggccaacataaagcaagatggaactgccgtagtttacgnggactctgtgaaggccgtttcaccatctccagagacaacgccaagattcactgtatctacaactgaacagcctgagagtcgcagacacggccgtgtattactgtgcgagatgtaggaaaaagtntggcttggttagtttagtggggacctagggacgcccgtggcctaccg

SEQ ID NO: 247392 - DNA, 595 bp, Homo sapiens
  misc_feature: GYAE6OF01CYZD4.17.28.C06.1.454.CMB.1.raw
  modified_base (277)..(277): a, c, t, g, unknown or other
  misc_feature (277)..(277): n is a, c, g, or t
  modified_base (382)..(382): a, c, t, g, unknown or other
  misc_feature (382)..(382): n is a, c, g, or t
  modified_base (448)..(448): a, c, t, g, unknown or other
  misc_feature (448)..(448): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcctgggggtccctgagactctcctgtgcagcctccggattcccccttnagtagttattggatgacgttgggtccgccagactccgaggggaaggggctgggagtggggtggccaacaataaaagcaaagataggaactgccgtagttttacgnggactctgtgaagggtccgtttcacctatctccagagaacaacgccaagaattcactgtatctaanaactgaacagcctagagagtacgaagaccacggtccgtagtattacgtgtcgcgaagtagtaggtaaaggtaaaagtaagtgggacttggttagttttaggtgggggacctagggggaactccccggttggtccgtcccggttcccg

SEQ ID NO: 247393 - DNA, 561 bp, Homo sapiens
  misc_feature: GYAE6OF01CWCLI.17.28.C06.1.454.CMB.1.raw
  modified_base (377)..(377): a, c, t, g, unknown or other
  misc_feature (377)..(377): n is a, c, g, or t
  modified_base (544)..(544): a, c, t, g, unknown or other
  misc_feature (544)..(544): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgagggaaggggctggagtgggtggccaacataaagcaagatggaactgccgtagttttacgnggactctgtgaagggtcctttcaccatctccagagacaacgcaagaattcactgtatctacaactgaacagcctgagagtcgacacgacacggccgtgtacttactgtgcgagatggtaggaaaaagtagtaggcttggttggtttagttgggggtcctaggggacncccgtggtccgtacccg

SEQ ID NO: 247394 - DNA, 563 bp, Homo sapiens
  misc_feature: GYAE6OF01ER2OZ.17.28.C06.1.454.CMB.1.raw
  modified_base (380)..(380): a, c, t, g, unknown or other
  misc_feature (380)..(380): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (487)..(487): a, c, t, g, unknown or other
  misc_feature (487)..(487): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatgggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtcccgccagactccaggggaaggggctgggagtgggtggcccaacataaagcaagatggaactgccgagttttacgnggactctgtgaagggccgtttcacctatctccagagacaacgccaagaattcactgtatctaacaactnaacagcctganagtcgcagacaccggccgtgtattacngtcgcgagatgtaaggaaaaagtagtggacttggttggtttagtcgggggcaggggagccccgtggcctaacccgg

SEQ ID NO: 247395 - DNA, 607 bp, Homo sapiens
  misc_feature: GYAE6OF01AZI1W.17.28.C06.1.454.CMB.1.raw
  modified_base (475)..(475): a, c, t, g, unknown or other
  misc_feature (475)..(475): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggacttccccttcagttagttattggatgacgttgggtccgccagactccgaggggaaggggctgggagtgggtggccaacataaagcaagataggaactgaccgtagttttacgtggacttcgtggtaggaagggtcccgtttcacctatcctaccagacgaccaacgaccaaagaacttcaactgtatactaacaactgaacngcctagagagtcgcaagacaccggcgtagttattactgtgcgaagtatggtaaggaaaaagtagtggtacttggttaggttttagttcggggggacccaagggggtacgtccccgttgggtcccgtacccgg

SEQ ID NO: 247396 - DNA, 543 bp, Homo sapiens
  misc_feature: GYAE6OF01EID1K.17.28.C06.1.454.CMB.1.raw
  modified_base (377)..(377): a, c, t, g, unknown or other
  misc_feature (377)..(377): n is a, c, g, or t
  modified_base (529)..(529): a, c, t, g, unknown or other
  misc_feature (529)..(529): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccaggggaaggggctgggagtgggtggccaacataaagcaagatggaactgccgagttttacgnggactctgtgaagggccgtttcaccatctccagagacaacgccaagattcactgtatctacaactgaacagcctgagagtcgcagacacggccgtgtattactgtgcgagatggtaggaaaaagtatggctgtgtttatggggccagggganccctggtctaccgg

SEQ ID NO: 247397 - DNA, 957 bp, Homo sapiens
  misc_feature: GYAE6OF01CS6FW.17.28.C06.1.454.CMB.1.raw
  modified_base (114)..(114): a, c, t, g, unknown or other
  misc_feature (114)..(114): n is a, c, g, or t
tcagcgtagactagcacgaccggtgctcgatttagagctcacgtattgggtttggggaggtctcagagaggaggcttagccctggactccaaggcctttccacttggtgatcgnactgagcacagaggacgtcaccactaggtaggttaggggttcgggtcgtaacgttacgggttttttccggtttttcgttttggttcgtcgtttttaggtttaaagggtaggttccgtacgtggttggtagggtaccgtcgtttagggtttgggtacggtaccggggggtacggggccgtccggttccgacgccggttcggggggttccgggtctaggactccttcctcgtgccgacgccgtcccggtacgttacccctttccctagtagtttagtttagtgggtatacgttcgggttccggcccagacgtcccgtaacgggggaagggggtacgtggtagggtgggttcggggacccaaacctaaagttaaaacgaacgaacgtaagtagggtaaaccggtcgaccggttaacggtttttaacggttacgggtaaccgttcgtttcggtaagggtaaaccggggtacccggtttttccctaaccccaaactttccgtaccctaaacggaaggtaaaccaaaccccgaacccgtaaacggtaaaacttttaactaacccgttaacggttacttaaccttaaacccgaaacgttaaacgtaaaccgaaacccgttacccgtacgttaagggaaccgtttaccggacccgaacggaaaccgtacccgggtacccgggttagtttaagtttaaccgtttggtcgggacgaacgggtaaagttaggttaaaggggtaaaaaaacggtaaagtttcgggtacgttaggtttgggttttttaaacgggttcggggggcccgaaaccggggtaaggttcccccgttacggtccggttaaccccggttcccc

SEQ ID NO: 247398 - DNA, 547 bp, Homo sapiens
  misc_feature: GYAE6OF01AFXWJ.17.28.C06.1.454.CMB.1.raw
  modified_base (374)..(374): a, c, t, g, unknown or other
  misc_feature (374)..(374): n is a, c, g, or t
  modified_base (467)..(467): a, c, t, g, unknown or other
  misc_feature (467)..(467): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (532)..(532): a, c, t, g, unknown or other
  misc_feature (532)..(532): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattcccctcagtagttattggatgacgttgggccgccagactccgaggggagggctggaggtgggtggccaacataaagcaagatggaactgcgtagtttacgngactctgtgaaggccgtttcaccatctaccagacacaacgccaagacttcactgtactctaacactagaacagcctagacgagtcgacagacncggctagtatagtgtgnganatggaaggaaagtntggnttgttggttagtcggggactagggacnccgtggtcctacccg

SEQ ID NO: 247399 - DNA, 538 bp, Homo sapiens
  misc_feature: GYAE6OF01EP1O4.17.28.C06.1.454.CMB.1.raw
  modified_base (375)..(375): a, c, t, g, unknown or other
  misc_feature (375)..(375): n is a, c, g, or t
  modified_base (525)..(525): a, c, t, g, unknown or other
  misc_feature (525)..(525): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccaggggaagggctggagtgggtggccaacataaagcaagatggaactgccgagttttacgnggactctgtgaagggccgtttcaccatctccagagacaacgccaagaattcactgtatctaacactgaacagcctgagagtcgcagacacggccgtgtattactgtgcgagatgtaggaaaaagtatggctgtgttagtggggccagggncccgtggctaccg

SEQ ID NO: 247400 - DNA, 563 bp, Homo sapiens
  misc_feature: GYAE6OF01EPB69.17.28.C06.1.454.CMB.1.raw
  modified_base (381)..(381): a, c, t, g, unknown or other
  misc_feature (381)..(381): n is a, c, g, or t
  modified_base (488)..(488): a, c, t, g, unknown or other
  misc_feature (488)..(488): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagttagttattggatgacttgggtccgccagactccgaggggaaggggctgggagtgggtggccaacataaagcaaagatggaactgccgtagttttacgnggactctgtgaaggtcctttcaccatctcagacgacaacgccaagaattcactgtatctaacaactagaacagcctgagagtcgacagacacggccgttgtattacngtgcgagatggtaaggaaaaagtatgggcttggttagtttagttggggaccaggggacgcccgtggtcctacccg

SEQ ID NO: 247401 - DNA, 576 bp, Homo sapiens
  misc_feature: GYAE6OF01CNND1.17.28.C06.1.454.CMB.1.raw
  modified_base (376)..(376): a, c, t, g, unknown or other
  misc_feature (376)..(376): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccctcagtagttattggatgacttgggtccgcagactccgaggggaagggctggagtgggtggccaacataaagcaagatggaactgccgtagttttacgnggactcgtgtgaaggtcctttcaccatctccagagacaacgccaagaacttcactgtatctaacactagaacagcctagagagtcgcaagacacggccgtagtattacgtgtcgcgtaagagtggtaggaaaaagttagtgggtcttggttggtttaagttcgggggaccaggggacgccccgttgggtccctaacccgg

SEQ ID NO: 247402 - DNA, 563 bp, Homo sapiens
  misc_feature: GYAE6OF01DDHQJ.17.28.C06.1.454.CMB.1.raw
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
tcagcgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaactattttgctggtaccagcaattcccaggactccggccccccactcctcatctatagaaatgatcatccggcccctccggggtcctgaccgattctctggctccatgtctggcacctcacgccctccctgaccatcgagtcgggccttccgggtccgaggntggaggctgtattattacngtgcaccggtggatgacntcctgaagttcgggtccggttggttcggcgggacggaccgaggcgtcgaccgtccgtagtccgaacgcccaaggcctcgccccctcggtccaccgttccttcgttcccccgcccttccccg

SEQ ID NO: 247403 - DNA, 575 bp, Homo sapiens
  misc_feature: GYAE6OF01DK229.17.28.C06.1.454.CMB.1.raw
  modified_base (386)..(386): a, c, t, g, unknown or other
  misc_feature (386)..(386): n is a, c, g, or t
  modified_base (558)..(558): a, c, t, g, unknown or other
  misc_feature (558)..(558): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggattccccttcagtagttattggatgacttgggtccgccagactccgaggggaaggggctgggagtggggtggccaaacgataaagcaaagatggaactgaccgtagttttacgnggactcgtgtgaagggtcctttcaccatctccagacgacaacgaccaagaattcactgtatctaacaactgaacagcctagagagtcgacagacacggccgtagtacttactgtgcgagatggtaaggaaaaagttagtggattggttagtttagttcggggacaggggacncccgtggtcctacccgg

SEQ ID NO: 247404 - DNA, 555 bp, Homo sapiens
  misc_feature: GYAE6OF01BJ29A.17.28.C06.1.454.CMB.1.raw
  modified_base (379)..(379): a, c, t, g, unknown or other
  misc_feature (379)..(379): n is a, c, g, or t
  modified_base (483)..(483): a, c, t, g, unknown or other
  misc_feature (483)..(483): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgaggggaaggggctggagtgggtggccaacataaagcaagatggaactgaccgtagttttacgnggactctgtgaaggccgtttcaccatctccagagacaacgccaagaattcactgtatctaacaactgaacagcctgagagtcgcagacacggccgtgtattacngtgcgagatggtaggaaaaagtagtggcttggttgtttagtggggccaggggacgcccgtggtcctacccgg

SEQ ID NO: 247405 - DNA, 672 bp, Homo sapiens
  misc_feature: GYAE6OF01DDPN8.17.28.C06.1.454.CMB.1.raw
  modified_base (302)..(302): a, c, t, g, unknown or other
  misc_feature (302)..(302): n is a, c, g, or t
tcagcgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctgggacccccggcagaggtcacatatcttgttctggaaacagctccggcatctcaaactaaactattttgctggtaccagctaattcccaggtactccggccccccgactcctcactctaanaagaaatgatcacgtccggccccgttccggggtccctgacccgtattcctcgtcggcctcctatcgttcgtcggccacctcaccgcctccctacgaccacttcgaggtcggcctccgggtaccgaggtataggcgtcttagtaatttacttacgtgtacgtcggtaccggtaggattcgactacttccgtaggtaagtcgggttccggttgggttccgggacgggaacgggtacccgtagggccttaccgggtaccctaccgggttaatcccggaaccgacccggtaacgggtcccgtacccccggccccgtttaccggtacccgttaccttacccggttcccgtttccccccgccccgttttacccccg

SEQ ID NO: 247406 - DNA, 523 bp, Homo sapiens
  misc_feature: GYAE6OF01CN9M4.17.28.C06.1.454.CMB.1.raw
  modified_base (331)..(331): a, c, t, g, unknown or other
  misc_feature (331)..(331): n is a, c, g, or t
  modified_base (433)..(433): a, c, t, g, unknown or other
  misc_feature (433)..(433): n is a, c, g, or t
  modified_base (460)..(460): a, c, t, g, unknown or other
  misc_feature (460)..(460): n is a, c, g, or t
tcagcgtagactagcacgaccggtgctcgatttagagctcacgtattgggtttgggggaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacagctccggcatctacaactaaactattttgctggtaccagcaattccaggactccggcccccgatcctcatctatagaaatgaatcagtccggcccgtccggggtcctgaccgattcnctgctccatcgtctggcactcacgccctcctagaccatcgagtcgggctccggtcgaggatggagctagtacttatacgtgtcgcgacgtggatgactatcngaagtggtccggtgtcggcggaggccnggctgaccgtcagtcacgccaggctcgccccgtgccactcgtcctcccgcctctctgtctacg

SEQ ID NO: 247407 - DNA, 866 bp, Homo sapiens
  misc_feature: GYAE6OF01AMYLV.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggtgaggtccggggagccgtggtccagccggtcgggggtcctgagactctcctgtgcacgcctccggtaccttccccttagacgttagttagttggatggtacgttcgggcccgccagaccgtccggaagggggaacgggcgtgggacggtggggtacggaccaaacgaagtaaacggacgtaaaggagtacgggaaaccgtcggacccggtttaaggttttaaccggtacgggtaccttcgttagggtaagggtaaccggggttcccgttttaccaaacccgttacgttcccgtacccggaaacggtaaccggtaaaccgtaaacccggaacccgtaaaacggttaactttacccgtaaacgtttacggttaactaacccgttaaacctaaaccgttaacgtaaacccgtaaccgtaccgtacggaacggtacggtaccccgaacggaaccggtaacccggacccgggttaccggttagtttaaaccgttacggttacgggtacgaccgggtaagtacggttaaggggtaaaaaggttaaaaacgggttacggttagggttacggttcgggtttttaacggggttttacgggttaccgggggacccggttttaacggggacccgtttccccgggttacgggtacccccgtttacccccgggg

SEQ ID NO: 247408 - DNA, 570 bp, Homo sapiens
  misc_feature: GYAE6OF01ET1H5.17.28.C06.1.454.CMB.1.raw
  modified_base (386)..(386): a, c, t, g, unknown or other
  misc_feature (386)..(386): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggattccccttcagtagttattggatgacttgggtccgccagacctccgaggggaaggggcgtggaggtggggtggccaacataaagcaagatggaactgaccgtagttttacgnggtactcgtgtgaacgggtccgtttacacctatctcagacgacaacgacaagaacttcactgtatctaacaactagaacagcctgagagtcgcagacgacggccgttagtattactgtgcgagatggtaaggaaaagtagtggctgttgtttagtcggggcagggagtcccgtggtctacccgg

SEQ ID NO: 247409 - DNA, 554 bp, Homo sapiens
  misc_feature: GYAE6OF01CGGQ8.17.28.C06.1.454.CMB.1.raw
  modified_base (377)..(377): a, c, t, g, unknown or other
  misc_feature (377)..(377): n is a, c, g, or t
  modified_base (483)..(483): a, c, t, g, unknown or other
  misc_feature (483)..(483): n is a, c, g, or t
  modified_base (535)..(535): a, c, t, g, unknown or other
  misc_feature (535)..(535): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccgagggaaggggctgggagtgggtggccaacataaagcaagatggaactgccgtagttttacgnggactctgtgaagggtcctttcaccatctccagacgacaacgaccaagaattcactgtatctaacactgaacagcctgagagtcgcagacacggccgtgtattacngtgcgagatgtaggaaaagtataggcttggtgtttagtggggaccaggggancccgttgggtcctacccgg

SEQ ID NO: 247410 - DNA, 587 bp, Homo sapiens
  misc_feature: GYAE6OF01DPX6Q.17.28.C06.1.454.CMB.1.raw
  modified_base (385)..(385): a, c, t, g, unknown or other
  misc_feature (385)..(385): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagccctccggacttccccttcagttagttattggatgacttgggtccgccagactccgaggggaaggggctgggagtgggtggccaacaataaagcaagatggaactgccgtagttttacgnggactcgtgtgacgggtccgtttcaccatcctcaagagaacaacgccaaagtattcactgtaactctacaactgaacagcctagagagtcgcaagacgacggtcgtgtacttactgtcgagacgagtggtaaggaaaaagtagtaggtacttggttagtttaggtcggggtacaaggggaccgtcccgtggtccgtacccgg

SEQ ID NO: 247411 - DNA, 681 bp, Homo sapiens
  misc_feature: GYAE6OF01CRQ10.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggtttccttgttgctgttttagaaggtgtccagtgtgaggtccagttggttgaggtccggggaggcctggtccagccgtggggggtccctggagactctcctgtgcacgcctccggacttccccttcagttagttattggatgtacgttgggtccgccagactccgaaggggaagggcgtggaggtggggtggaccaaacaagtaaaacgcaaagagtacggaaactggaccggtagttttacgtggaccttcgtggtacggaacgggtcccgttttacaacccgtatcctacccgaaggaacgaacaaccgacaaagtaacttacacttagtaatacctaacaactagaaacagacccgtagaacgtagtaccgacgaacgaaccgaccggtccgttagtaacttacgtgtaggacgtagtagtaggtaaaggtaaaaaggtaagtaggtacgttggtttaggttttacgggttcggggtaacccggtaaggggtaccgccccggttgggtacccgttaccccgg

SEQ ID NO: 247412 - DNA, 580 bp, Homo sapiens
  misc_feature: GYAE6OF01BQGNT.17.28.C06.1.454.CMB.1.raw
  modified_base (375)..(375): a, c, t, g, unknown or other
  misc_feature (375)..(375): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattccccttcagtagttattggatgacttgggtccgccagactccgaggggaggggctggagtgggtgccaacataaagcaagatggaactgcgtagtttacgngactctgtgaaggtccgtttcacatctccagacgacaacgccaagaacttcactgtatactacaactgaacagcctagagagtcgacacgacacggccgtagttacttacgtgtagcggaagtataggtaaggaaaaagtagtagggacttggttaggttttaagtcgggggacctaggggacgtccccgtgggtcctaacccgg

SEQ ID NO: 247413 - DNA, 844 bp, Homo sapiens
  misc_feature: GYAE6OF01B7ULU.17.28.C06.1.454.CMB.1.raw
  modified_base (304)..(304): a, c, t, g, unknown or other
  misc_feature (304)..(304): n is a, c, g, or t
  modified_base (373)..(373): a, c, t, g, unknown or other
  misc_feature (373)..(373): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcagcctccggattccccttcagtagttattggatgacttgggccnccagctccgaggggaagggctggagtgggtgccaacataaagcaagataggactgccgtagttttacgnggactcgtgtacggaacgggtccgttttacaacctattccgtaccgaagaacgaacctaaaccggcccaaaagggtaacttttcccgaacgtttacggttaacttacccgttaaaccgtaaaccttacgggaaaaccctaacgggtaccccttaagggaaaccggttaacggttaccccgaacgtaaaccggtaaccccggtaacccgggggttaccccgtttaggtttaaaccgtttttaacccgttacgggggtttaccggaaccgggttaaacgggttaagggtttacgggttaaaaaacggggttaaaaaaaacggtttaacggtttcgggggttaaccgttttaggggttttaaaccgggtttttttaaacggggttacccggggggggtaaccccgtaaacggggggggttacccgttacccccccgggttttgggggttaacccccccgtttaaacccccgggg

SEQ ID NO: 247414 - DNA, 556 bp, Homo sapiens
  misc_feature: GYAE6OF01AICCR.17.28.C06.1.454.CMB.1.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (509)..(509): a, c, t, g, unknown or other
  misc_feature (509)..(509): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccctcagtagttattggatgacttgggtccnccagactccgaggggaagggctggaggtgggtggccaacgataaagcaagagtggaactgccgagttttacgnggtactctggtgaagggtcctttcacctatcctcagacgacaacgcaagatcactgtanctanactgaacncgaccngagagtcgacagacacggccgtgtacttcgtgtgacgagatggtaagaaaagtntggctggttgttagtggggcctaggggacgcccgtggtcctacccgg

SEQ ID NO: 247415 - DNA, 764 bp, Homo sapiens
  misc_feature: GYAE6OF01D4F4B.17.28.C06.1.454.CMB.1.raw
  modified_base (236)..(236): a, c, t, g, unknown or other
  misc_feature (236)..(236): n is a, c, g, or t
tcagcgtagactagcacgaccggtgctcgatttagagctcacgtattgggtttggggagcttcagctgtggtagagaagacaggattcaggacaatctccagcatggccggcttcccctctcctcctcaccctcctcactcactgtgcagggtcctgggcccagtctgtgctgactcggccacctcagtgtctgggacccccgggcagagggtcaccatatcttgttctggaaacngctccggcatctcaactaaactatttttgctggtaccagctaacttcccgaggactccggccccccgtactcctcatctatagaaatgatctatccggccccgttccggggtcccctgacccgtattctctggctccatgtcgtcggcacctcacgccctcccgtcgaccacttccgacggttcgggtccgttcccggggtacccggagggtaacgttacgggacgggtcgtttacggttaacttttaacgtttaccgttacggttacggacccggtaacccgggttggggtaacgtttacggtaaccctacggttacccgttagggttaaacgggttccggggtttacccggggtttcgggtttaccgggggaccgggggtacgggggtaacccggtaccgggtaccggtttacccggtaaccccgggtttacccggtaaaaccggtcccggtaaaacccggtacccccggtaaacgggggtaccccttacccccgggtccccccccgggttcggttaaccccccgg

SEQ ID NO: 247416 - DNA, 558 bp, Homo sapiens
  misc_feature: GYAE6OF01B3J03.17.28.C06.1.454.CMB.1.raw
  modified_base (380)..(380): a, c, t, g, unknown or other
  misc_feature (380)..(380): n is a, c, g, or t
  modified_base (492)..(492): a, c, t, g, unknown or other
  misc_feature (492)..(492): n is a, c, g, or t
  modified_base (515)..(515): a, c, t, g, unknown or other
  misc_feature (515)..(515): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgaggggaaggggctgggaggtgggtggccaacataaagcaaagatggaactgccgtagtttacgnggactctgtgaaggtcctttcaccatctccagagacaacgaccaagaacttcactgtatctaacaactgaacagcctgagagtcgcaagacacggcgtagtattactgtcgngagatgtaaggaaaagtagtggnttgttagtttagtcggggccagggacgcccgtggtcctacccg

SEQ ID NO: 247417 - DNA, 599 bp, Homo sapiens
  misc_feature: GYAE6OF01DV8QF.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggacttccccttcagttagttattggatgacgttgggtccgccagactccgaggggaagggctggagtgggtggccaacataaagcaaagatggaactggccgtagttttacggtggactcgtgtaggaacgggtccgtttacaccatcctaccagacgacaacgaccaaagaattcaactgtactctaacaactagaacacgcctagagagtcgacagacgacggccgtagtacttacgtgtgcgagtataggtaaggaaaagtagtaggcgttggttagtttaggtcgggggtaccgtaggggaccgtcccgttggtcccgtacccgg

SEQ ID NO: 247418 - DNA, 669 bp, Homo sapiens
  misc_feature: GYAE6OF01A8WV1.17.28.C06.1.454.CMB.1.raw
  modified_base (215)..(215): a, c, t, g, unknown or other
  misc_feature (215)..(215): n is a, c, g, or t
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgtgctgactcagccaccctcagtgtctcggggacccccgggcaggagggtcaccatatcttgttctggaaacngctccggcatctcaaactaaactatttttgctggtaccagcaacttcccgaggactcccggcccccgactcctcatctataagaaatgatcacgtccggccccgtccggggtccctggaccgtatttccgtcgtggcctccatcgtcgtcggccacctcgacgtccctcctcgaccatcgaggtcgggccttccggtccgaggatcggagtctacgtattacttcgtagtcgcgtaccggtggtatcgaactcgttccgtaggtacgttcggggtccgggttggttccggggacgggtacgggaccgtacgggtcctacggtaacccgttaccgtaacggccgaaccggacccgaacgggtcccgtccccggtcccccgttcgggtaccctacccgttccgttaccccgttaccccctaccccgttcccttacccgttacggttccccgtacgg

SEQ ID NO: 247419 - DNA, 680 bp, Homo sapiens
  misc_feature: GYAE6OF01CAXLD.17.28.C06.1.454.CMB.1.raw
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgtgctgactcagccaccctcagtgtcgtcggggacccccgggcagagggtcaccatatcttgttctggaaacagctccggcatctcaaactaaactatttttgctggtaccagcaaacttcccaggactccggccccccgactcctcatctatagaaatgatcatccggccccgtcccggggtccctggaccgtattcctcgtcggcctcctatgtctggccacctcacgccctccctgacccatcgaggtcgggccgtccggtccgaggtatggacggtcgtagtaatttagttacgtggtcgcgtacggtgggatcgaactacgtccgtagtaacgttcgggttccgggttgggttaccggggacgggtaacggggacccgtagggtccgttacgggtaacccgttaccgtaaacggtccgaaccggaccccgaagggccccgttcccggtcccccccgttcgggttacccctaccgtttcccgttacccgttacccccctaccccttaccctttcccgttacgttcccgtaccgg

SEQ ID NO: 247420 - DNA, 599 bp, Homo sapiens
  misc_feature: GYAE6OF01CO223.17.28.C06.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
  modified_base (418)..(418): a, c, t, g, unknown or other
  misc_feature (418)..(418): n is a, c, g, or t
tcagcgtagactagcacgaccggtgctcgatttagagctcacgtattgggtttggggagcttcagctgtggtagagaagacaggattcaggacaatctccagcatggccgcttccctctcctcctcaccctcctcactcactgtgcagggtcctgggcccagtctgtgctgactcagccaccctcagtgtctcgggacccccgggnagagggtcaccatatcttgttctaggaaacngctccggcatctacaactaaacatttttgctggtaccagcaattcccaggactccggccccccgactccctcatcgtatagaaatgatcatccggccctccgggtccctgaccgacttctctggctccatcgtctggcacctcacgtccctccctgacccatcagtcggctccggtcgagngtgagctgattattacgtgtcgccgtacggtggatcgactacgtaccgtagtaacgtcgggtaccggttcggttcgggacggtacgttacgggacccgtaggtccggtacggtaaccccgttaccgttaaacgttccgaacggaccccgtaaacgggtcccgtcccggttacccccccggg

SEQ ID NO: 247421 - DNA, 615 bp, Homo sapiens
  misc_feature: GYAE6OF01AOACQ.17.28.C06.1.454.CMB.1.raw
  modified_base (383)..(383): a, c, t, g, unknown or other
  misc_feature (383)..(383): n is a, c, g, or t
  modified_base (458)..(458): a, c, t, g, unknown or other
  misc_feature (458)..(458): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttcctgttgctgttttagaaggtgtccagtgtgaggtccagttggttgagtccggggaggcctggtccagcctggggggtccctgagactctcctgtgcagcctccggacttcccctcagtagttattggatgtacgttgggtccgccagaccgtccgaggggaaggggctggaggtgggtggccaacataaagcaaagagtaggaactgacgtagttttacgnggactctgtagaggtccgtttcacctatctccagacgacaaccgaccaagtaacttcactgtatactacaactanaacagcctagagtagtcgacgacgaccgacggccgttagtattacgtgtcgacgagagtaggtaaggtaaaaagttaggtgggtacgttggttaggttttaagggttcgggggtaccgaacgggggtaccgtccccggttcgggtcccgtaccccgg

SEQ ID NO: 247422 - DNA, 684 bp, Homo sapiens
  misc_feature: GYAE6OF01D1M49.17.28.C06.1.454.CMB.1.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
  modified_base (385)..(385): a, c, t, g, unknown or other
  misc_feature (385)..(385): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtccagttggttgaggtccgggggagcctggtccagccgtgggggtccctgagactctcctgtgcagcctccggacttccccttcagttagttattggatgacttgggtccnccagactccgaggggaaggggctggaggtgggtggaccaanaataaagcaagatggaactgccgtagttttacgngactctgtaggaaggtcctttcacctatcctacgaagacgaaccaaccggacccaaagtactttaccacttagtaacttacctaaccaagttacgaaacacgtccctaggagtacgtccgacaaacggaccgaaccgggtcccgttagttaacgtttaacgtggtacgaccggtaagtaacgttagggtaaaagggtaaaaaacgttaggttggggtacgtttagggtttaaggttttaacgggttacggggggaccgtaaggggggtaccctcccccggttgggtccctaacccccgg

SEQ ID NO: 247423 - DNA, 770 bp, Homo sapiens
  misc_feature: GYAE6OF01EAE75.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtccagttggttgaggtccgggggagcctggtccagccgtggggggtccctggacgactctcctgtgcacgccgtccggtacctttccccttacgaaggttagttagttggtactacgtacggtttcgggtcccgaccgtacgaccgtaccggaagggggaacggggtcgtaggggagggttggggtcggaccaaacgaagtaaagacgaaagagtacggaactcggaccgtttagttttacggacggtaccttcgttggtaaggtaaccggggtccctttaccgaactctacctaccgaagtacgaaccgaaccgaccgtaaagtaacttacgtaacgttacgttaacttactaaaccgtaaccgtaaggaaaccctacggtacccgtaggaacgtacggtaccgacgtaacggaccggtaccggtccggttagtttaacttcgtgtacggacgtagtaaggttacggtaaaagggtaaaaagttaggtagggtacgtttacgggttaggttttacgggtaccggggtaccggtaaggggtacccggtacccggttcggtacccgttaccccgg

SEQ ID NO: 247424 - DNA, 660 bp, Homo sapiens
  misc_feature: GYAE6OF01DZ1V7.17.28.C06.1.454.CMB.1.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgccaccctcagtgtctcgggacccccgggcaggagggtcaccatatcttgttctggaaacagctccggcatctacaactaaactatttttgctggtaccagcaacttcccgaggactccggccccccgactcctcatctataagaatgatcacgtccggccccgtccggggtcctcggaccgtattctctggcctccattcgtctcggcctacctcacgccctccctcgaccactcgaggtcggccgtcccggtcggaggtatcggaggtctagtactttattacgtgtcgaccgtaccggtgggtactacgtactacgttccgtaggtaaggttccgggttccgggttcgggttccggggaccggggtacggggacccggtacgggtaccgttaccgggtaacccggttacccggttaaacgtacccggtaacccggaccccggaaccgggtccccgtcccgggtcccccgttaccccggg

SEQ ID NO: 247425 - DNA, 660 bp, Homo sapiens
  misc_feature: GYAE6OF01B1OIU.17.28.C06.1.454.CMB.1.raw
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtcagttggttgaggtccggggaggcctggtccagccgtgggggtccctgagactctcctgtncagcctccggacttcccctnagtacgttattggatgacttcgggtccncagactccgaagggagggctggagtgggtcgaccaaacgataaaagcaaagataggaacttggaccgttagtttacgtggacttcgtgtagacgggtccgtttacaaccatcctaccgagacgacaacgaccaagtaacttacactagtaactactaacgaactacggaaactacgcctaggacgagtaccgacgaagaaccgtacccgggtaccgttagtaacgtttacgtaggtgaccggagtaacgttaggtaaaggaaaaaggttagtacgggttacttggtttacggttttagggttccgggggacctagggggtaaccgtccccggttagggtacccttacccccggg

SEQ ID NO: 247426 - DNA, 621 bp, Homo sapiens
  misc_feature: GYAE6OF01AIVMW.17.28.C06.1.454.CMB.1.raw
  modified_base (379)..(379): a, c, t, g, unknown or other
  misc_feature (379)..(379): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagcctggggggtccctgagactctcctgtgcagcctccggattcccctcagtagttattggatgacttgggtccgccagactccgaggggaagggctggagtgggtggccaacataaagcaaagatggaactgccgtagttttacgnggactctgtgaagggtccgtttcacctatcctcagacgacaacgccaagattcactgtactctacaactgaacagcctgagagtcgcaagaccacggccgttagtacttacgtggtacgcggaagtacgtaggtaagggaaaaaacggttagtacgggtacttgggtttacggtttttaaagggttcggggggtacccgtaggggggtaacggtcccccgttggggtccccgtaaccccggg

SEQ ID NO: 247427 - DNA, 820 bp, Homo sapiens
  misc_feature: GYAE6OF01BVF0V.17.28.C06.1.454.CMB.1.raw
  modified_base (277)..(277): a, c, t, g, unknown or other
  misc_feature (277)..(277): n is a, c, g, or t
  modified_base (388)..(388): a, c, t, g, unknown or other
  misc_feature (388)..(388): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggtttcctgtgctgtttagaggtgtccagtgtgaggtcagttggttgaggtccggggagcctggtccagccgtgggggtccctggagactctcctgtgcacgccgtccggtattcccccttanagttagtttattgggattgacttgggtcccgccagacctccgaggggaacgggctgggagtgggtcggccaaacgagtaaaagctaagatggaactgaccgtagtttacgnggactcgtgtagaaggtcccgtttacacctatcgtaccagacgtaacgaaccgaccaaaggtaacttcaacgttagtaacttacctaaacgtaaaccttaggaaaacctacgggtacccttacgggtaacggaaccggttacccggtaaccgaaaccgggtaacccgtaaccccgggggttacccccgggtttaaggtttaaaccgtttttaacccggtacggggtttacgggaacccgggttaaacgggttaaacgtttaggggtttaaaaaaccggggaaaaaaaaagggttttaggttaacggggttaacccggttttaggggtttaacgggttttttaacgggtttacccgggggggaaccccggttaacggggggttaaacccggtaccccccggtttagggggttaacccccgttaaaccccgggg

SEQ ID NO: 247428 - DNA, 854 bp, Homo sapiens
  misc_feature: GYAE6OF01C0SRT.17.28.C06.1.454.CMB.1.raw
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaacttgggttttccttgttgtcttgttttagaggtgtccagtgtgagtcagttggtgaggtcggggagcctggtccaggccgtgggggtccctgagactctcctgtgcagcccgtccggtacttcccccttnagttagttatggatgtacgttcgggtcccnccgacgaccgtaccgaggggaacggggtcgtagggaggttcggggtacgggacccaaaacgtaagtaaaacggacgaaaggaacgtacgggtaaacgttcgggtaacccggtttaagggttttttaaccgggtacgggttaacccgttcgtttagggttaacgggtaaaccggggtttcccccggttttaacaaacccccgtagtttaccccgtacccgaaacggaaccgggaaacccgtaaacccggaaacccgtaaaacgttaaccgttttaaccctaaacgtttacggtttaaaccttaacccgtaaacctaaaccgttaccggaaaaccgaccgtccgtaaggaacggtacgtaccgacgtaacggaacccgaccgggtacccggtagtttaaccgttcgttacggtagaccggtaagtaagttaacgggtaaaaggtaaaaacggttgttacgggtagtttgggtttaggtttagggttacccggggtaccggtaacggggtacccggtcccggttcggtaccccgttaccccgg

SEQ ID NO: 247429 - DNA, 705 bp, Homo sapiens
  misc_feature: GYAE6OF01B7KH9.17.28.C06.1.454.CMB.1.raw
  modified_base (211)..(211): a, c, t, g, unknown or other
  misc_feature (211)..(211): n is a, c, g, or t
  modified_base (281)..(281): a, c, t, g, unknown or other
  misc_feature (281)..(281): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggaggttggggctgaacttgggttttccttgttgcttgttttagaggtgtcagtgtgaggtccagttggttgnggtcggggagctggtccagccgtgggggtccctgagctctctgtcgcagccctccggtacttccccgttntagttagttagtggatgacgttgggtcccaccagacctccggaaggggaacggggcgtagggaggtggggtacggacccaaagaagtaaaagcaaagacgttaggaacttcggacgttaaggttttacgcggacttcgtaggtacggaacgggttccctttaccactattccacgtaagacgaaccgaacgaccgtaagtaacttccaacgttagtaactaacctaacgtaactacgaaaccgtacgtaccgtaggacgtacgtacaccgaaaggaccgaccgggtaccgttagtaacgtttacgtggtacgacgtaaggtagtaagggtaaaggtaaaacggtagttaggtacgtttggtttaacggtttaggtacggggtaccggtaagggaccggttcccgtcggggtcccgttaccccgg

SEQ ID NO: 247430 - DNA, 598 bp, Homo sapiens
  misc_feature: GYAE6OF01ENWX4.17.28.C06.1.454.CMB.1.raw
  modified_base (281)..(281): a, c, t, g, unknown or other
  misc_feature (281)..(281): n is a, c, g, or t
  modified_base (388)..(388): a, c, t, g, unknown or other
  misc_feature (388)..(388): n is a, c, g, or t
  modified_base (421)..(421): a, c, t, g, unknown or other
  misc_feature (421)..(421): n is a, c, g, or t
  modified_base (462)..(462): a, c, t, g, unknown or other
  misc_feature (462)..(462): n is a, c, g, or t
  modified_base (501)..(501): a, c, t, g, unknown or other
  misc_feature (501)..(501): n is a, c, g, or t
tcagcgtagactagcacgaccggtgctcgatttagagctcacgtattggggtttgggggaggtctcagagaggaggcttagccctggactccaaggcctttccacttggtgatcagcactgagcacagaggactcaccatgggagttggggctgaactgggttttccttgttgctgttttagaggtgtcagtgtgaggtcagttggtgaggtccgggggagcctggtccagccgtggggggtccctgagactctcctgtgcagcctccggacttccccttnagttagttattggatgacgttgggtcccgcagactccgagggggaaggggctgggaggtggggtggaccaacataaagcaaagagtggaactgacgtagttttacgnggactcgtgtggaaggtccgtttacactatccncagacgacaacgccaagacttcatgtaatcaacactgaacngctagagcgtcgcaagaccgacggtcgttagtacttacnggtagcgagtagtaggtaaagggaaaaagttgtgggtcttggttaggttttaaggtcggggaccgtaggggtaccgccccgttgggtcctaccccgg

SEQ ID NO: 247431 - DNA, 575 bp, Homo sapiens
  misc_feature: GYAE6OF01C704Q.17.28.C06.1.454.CMB.1.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (561)..(561): a, c, t, g, unknown or other
  misc_feature (561)..(561): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagctggtccagcctgggggtccctgagactctcctgtgcagcctcggacttccccttnagtagttattggatgacttgggtccncagactccgagggaaggggctggaggtgggtggaccaacataaagcaagatggaactgccgtagttttacgnggacttcgtgtggaacgggtccctttcaccatctaccagagacaacgaccaagtatcacttgtactctaacactnaactgctgagngtcgnaacgacacggtccgtgtattacgtgtgacgaagtataggtaaggaaaaagtagtgggtacttggttagtttaggtcggggaccgtagggcgtcccgnggttccctacccgg

SEQ ID NO: 247432 - DNA, 599 bp, Homo sapiens
  misc_feature: GYAE6OF01ECV1I.17.28.C06.1.454.CMB.1.raw
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (546)..(546): a, c, t, g, unknown or other
  misc_feature (546)..(546): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgaggggaaggggcgtgggaggtggggtggcccgaaacagtaaagcaaagntaggaactggaccgtagttttacgnggtactcgtaggtggaacgggtccgtttacacctatctccaagagaccaacgaccaagaacttcactgtaactctaacaactagaacagccagagngtcncgacgacgacggtccgtagtacttacgtgtgacgaagagtggaaaggaaaagttagnggtacttggttagtttagtcggggacgtagggactcccgtggtccgtacccgg

SEQ ID NO: 247433 - DNA, 694 bp, Homo sapiens
  misc_feature: GYAE6OF01A9RQC.17.28.C06.1.454.CMB.1.raw
  modified_base (412)..(412): a, c, t, g, unknown or other
  misc_feature (412)..(412): n is a, c, g, or t
  modified_base (516)..(516): a, c, t, g, unknown or other
  misc_feature (516)..(516): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggttttcctgttgctgtttagaaggtgtccagtgtgaggtccagttggttgaggtccggggaggcctggtccagccgtgggggtccctgagactctcctgtgcacgccgtccggtactttcccccttcaagttagttattggatgtacgtttgggtccccgccagtaccgtccggaaggggaaggggcgtgggaggtggggtacgaccaacgaagtaaagacaagagtaggaactcggaccggttaggttttaacggnggacttcgtggtaggtaacggtcccgtttccaaccgtactctaccgaagaacgaacaaccgaccaaagtaacttacacgtatactactaacaacgttagaaacncgtccaggagacgtacgacgaacgaccggaccggtaccgtttagtaactttacgtcggtagacggaagtacgttaagggtaaaaggtaaaaaggtataggggttctttagggttaggtttttagggaccgggggtaccgaaaggggttacccgtcccgttcgggtacccgtaccccgg

SEQ ID NO: 247434 - DNA, 720 bp, Homo sapiens
  misc_feature: GYAE6OF01C64B3.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacaggaggactcaccagtggaggttggggctgaacgttgggttttccttgttgcttgtttagaggtgtcagtgtgaggtctaggttggttggaggtccgggggaggccgtggtccacggccggtcggggggtccctggacgtacctccgtccgtgtcgccgacgtcccgtccggtacctttccccttacgtagttagttagttggtatcgtacgttcgggtccgccgacgaccgtaccggaggggaagggcgtgggaggtgggtacggaacccttttaaacgaagtaaagacgaaaggagtacggaacgtcggtaccggttaggttttacggtggtaccgtcgtaggtacggtaacgggtccgtttaccgacctactccgtaccgaagaacgaaccaacgacaacgtaactactactagtactactaactaactagaacacgtacgtagagacgtacgacgaacgaccgacggtacgtagtacgttacgtgtagacgtaagtagtaaggtaaaggtaaaagtagtaggtacgttggtttaggtttacgggtacggggtaccggtacgggtaccggtccggttcggtcccgtaccccgg

SEQ ID NO: 247435 - DNA, 640 bp, Homo sapiens
  misc_feature: GYAE6OF01CM5J2.17.28.C06.1.454.CMB.1.raw
  modified_base (282)..(282): a, c, t, g, unknown or other
  misc_feature (282)..(282): n is a, c, g, or t
  modified_base (381)..(381): a, c, t, g, unknown or other
  misc_feature (381)..(381): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggacttccccttnagtagttattggatgacttgggtcccgccagactccgaggggaagggctgggagtgggtggaccaacataaaagcaagatggaactgcgtagtttacgnggactctgtgaaggtccgttcaccatctcagacgacacgacaagtactcagtgtactactaacaacgtanaaccncgtacgtagagtacgtcgacgaacgaccgaccggtccgttagttaacttacgtggtacgacggaagtaaggttagggtaaaaggtaaaaaggttggttacgggtacgtttgggtttaggttttagggggtaccggggtaccggaaggggtccccgtacccggttcgggttcccgtaacccccgg

SEQ ID NO: 247436 - DNA, 645 bp, Homo sapiens
  misc_feature: GYAE6OF01EQFEK.17.28.C06.1.454.CMB.1.raw
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaacttgggttttccttgttgcttgtttagaaggtgtcagtgtgagtcagttggtgaggtccggggagcctggtccagccgtgggggtcctgagactctcctgtgcacgcctccggactttcccccttcagtaacgtttattggaatgtacgttggggtcccgccaggacctccgaaggggaagggcgtggaggtggggtcggccaaanataaagcaaagatagggaactggccgtaaggttttacgnggtactcgtggtacggaacgggtcctttcacctatcctcaagacgaacaacgaccaaagtaacttcaacttagtactacctaacctaatacgaacacgtccctaggatacggtcgacgtagaacccgacggtccgttagtactttacgtgtgacgagtagttaggtaaaggtaaaaaagttgtagggtacgttgtttaggtttaggtcggggaccgtaggggacccgtccggtcggtccgtaccccgg

SEQ ID NO: 247437 - DNA, 687 bp, Homo sapiens
  misc_feature: GYAE6OF01EHAL5.17.28.C06.1.454.CMB.1.raw
  modified_base (331)..(331): a, c, t, g, unknown or other
  misc_feature (331)..(331): n is a, c, g, or t
tcagcgtagactagcacgaccggtgctcgatttagagctcacgtattgggtttgggggagcttcagctgtggtagagaagacaggattcaggacaatctccagcatggccggcttccctctcctcctcaccctcctcactcactgtgcagggtcctgggcccagtctgtgctgactcagcccaccctcagtcgtcgtcggggacccccgggcaggagggtcaccatatcttgttctaggaaacagctccggcactctacaactaaactattttgctaggtacagacaacttccgaggactcccggcccccgtactcctctactctaataanaaatgactctacgtccggtccccgttccgggtcctacgtaccgtacttccgtcgtcggctcctacgttcgtcgtcggcctaccgtcaccgtccctcccgtacgacctacgtcgtacgggtcgggtcccgttacccgggtaccggtaggtacgtcggacggtcgtagttactttagttacgtcgtacgtccgtacgggtggtactcggtactacgtacgttaggtacggttccgggttccgggttacggttccgggacgggtaacgggacgtacgggtccggtacggtaacccgttaccgtaacggtacccgtaccggaccccggtaacggtcccgttcccggccccggttacccgg

SEQ ID NO: 247438 - DNA, 618 bp, Homo sapiens
  misc_feature: GYAE6OF01BU4SH.17.28.C06.1.454.CMB.1.raw
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgtgctgactcagccaccctcagtgtctcggggacccccgggcaggagggtcaccatatcttgttctggaaacagctccggcatctacaactaaactatttttgctggtaccagcaacttccaggactccggcccccgactcctcatctataagaaatgatcatccggcccgtccggggtccctgaccgtattctctggctccatgtctggcacctcacgtccctccctgacccatcgaggtcgggcctccggtcgaggatgaggctaggtatttattacgtgttcgacgtaccggtgggatcgactacttccgtagtaacgttcgggtccggttggttccggggacggggaacggaccgagggtctacggtacccgttacgtaacgtcgacgacccgtaaggccgtccggtcccccgtggtccctaccgttccgttccgtcccccgtccccttccctcccgttagtcccgtaccgg

SEQ ID NO: 247439 - DNA, 550 bp, Homo sapiens
  misc_feature: GYAE6OF01AJA7P.17.28.C06.1.454.CMB.1.raw
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
  modified_base (485)..(485): a, c, t, g, unknown or other
  misc_feature (485)..(485): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattcccctcagtagttattggatgacttgggtccgccagactccgaggggaagggctggagtgggtggccaacataaagcaagatggaactgccgtagttttacgngactctgtgaaggtccgtttcacatctccaganacaacgccaagtattcatgtaatctacaactgaacagcctgagagtcgcagaccacggcgtgtatagtgtgacgagntgtaaggaaaaagtagtggctgttgtttattcgggggacctaggggacgtccctggtctacccgg

SEQ ID NO: 247440 - DNA, 570 bp, Homo sapiens
  misc_feature: GYAE6OF01E4X9W.17.28.C06.1.454.CMB.1.raw
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattccccttcagtagttattggatgacttggggtcccnccagacctccgaggggaagggctgggagtggggtggccaacataaagcaaagatggaactgaccgtagttttacgnggactctgtgaagggtccgtttcaccatcctccagagacaacgaccaagaatcactgtatctacaactgaacagcctgagagtcgcacgacacggccgtagtattactgtgcgagatggaaggtaaaagtagtggctggttagtttagttcggggacctaggggacgcccgttggcccgtacccg

SEQ ID NO: 247441 - DNA, 674 bp, Homo sapiens
  misc_feature: GYAE6OF01AXR94.17.28.C06.1.454.CMB.1.raw
  modified_base (281)..(281): a, c, t, g, unknown or other
  misc_feature (281)..(281): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaaggtgtccagtgtgaggtccagttggttgaggtccggggaggcctggtccagccgtgggggtccctgagactctcctgtgcagcctccggacttcccccttnagttattattggatgacttgggtcccgccagactccgaggggaaggggcgtggaggtggggtggaccaaacgataaaagcgaaaggtatagggaaacctggacccgtaaggtttttaccgtgggtacttcgtggtagggaacggggttccccgttttaccacctacttccgtacccgaaggacgtaaccaaccgaccaaagtaacttaccgacttagttactacctaacaactagaaaccacgtactagaagcgtcgacaacgaccgacggccgttagtacttacgtggtcgacggaagtacgtagggtaaggtaaaaaagtgtagggtcttaggtttaggtttacggttacgggggcctaaaggggtccgtcccgtgggttaccctacccgg

SEQ ID NO: 247442 - DNA, 617 bp, Homo sapiens
  misc_feature: GYAE6OF01AJ543.17.28.C06.1.454.CMB.1.raw
  modified_base (481)..(481): a, c, t, g, unknown or other
  misc_feature (481)..(481): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcagcctccggacttccccttcagttagttattggatgacgttgggtccgccagacctccgaggggaaggggctgggaggtggggtggacccaaacaataaaggcaaaggatagggaactcggaccgtaggttttacggtggacctcgtggtaggaacggtcccgtttacacctatcctccagacgacaacgccaagattcatgtatctaacaactgaacngcctagagagtcgacaagaccgacggtccgttagtacttacgtgtagacgagtagtaggtaaaggaaaagtgtaggtacttggtttagtttaggtcgggggtacagggggtacctccccgttgggtccctacccgg

SEQ ID NO: 247443 - DNA, 634 bp, Homo sapiens
  misc_feature: GYAE6OF01DOI8T.17.28.C06.1.454.CMB.1.raw
  modified_base (207)..(207): a, c, t, g, unknown or other
  misc_feature (207)..(207): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggnaggagggtcaccatatcttgttctggaacagcctcggcatctacaactaaactatttttgctggtaccagcaattcccaggactccggacccccgactcctcatctaatagaaatgatcatcggccccgtccggggtccctgaccgtattctcgtggcctcatcgtctggcctacctcacgtccctcccgtacgacctagtccgtacgggtcgggtcccgtccccgggtaccgaacgggtactggaacgggtccgttaggtaaacgtttacgtttaacgtggtcgtaccgaccgggtgggaactacggactacgttccgtagtaagttcgggtccggttcggttccggggacgggacgggaccgaggtcgtacggccgttacccgtaaggccgacgaccccgaaggtcccgtcccggtccccgtcgg

SEQ ID NO: 247444 - DNA, 688 bp, Homo sapiens
  misc_feature: GYAE6OF01BPIEB.17.28.C06.1.454.CMB.1.raw
  modified_base (396)..(396): a, c, t, g, unknown or other
  misc_feature (396)..(396): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggcctggtccagccgtgggggtccctgagactctcctgtgcagcctccggacttccccttcagttagttattggatgtacgttgggtccgccagactccgaggggaacggggctgggaggtggggtcggaccaacaataaaaggcaaagagtaggaactggaccgtagttttacgnggactctggtggaacgggtccctttacaccgtattccctaccgaaggaacgaaccaaccgaccgaaagtaacttacactagtactactaacaactacgaacacgtccgtagacgtacgtaccgactaacggacccgtaccgggtcccgttagttacgtttaacgtcggtacgacggaagtagttagggtaaacggtaaaaaaggttagtagggtacgtttggtttagggttttaacgggttacgggggacccgtaggggtaacccggtccccgttagggtcccgttaccccg

SEQ ID NO: 247445 - DNA, 732 bp, Homo sapiens
  misc_feature: GYAE6OF01DLU1A.17.28.C06.1.454.CMB.1.raw
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (269)..(269): a, c, t, g, unknown or other
  misc_feature (269)..(269): n is a, c, g, or t
tcagcgtagactagcacgaccggtgctcgatttagagctcacgtattgggtttggggagcttcagctgtggtagagaagacaggattcaggacaatctccagcatggccggcttccctctcctcctccaccctcctcactcactgtgcagggtcctgggcccagtctgtgctgactcacgcccaccctnagtgtcgtcgggaccccgggnaggagggtccacatatcttgttctaggaaacagcgtccggcatctacaaactaaacttnttttgctggtacagctaacttcccgaggacctccggccccccactcctcactactaataagaatgatcacgtccggtccccgtccgggtccctaggaccgtattcctcgtcggccttccgattcggtcctaggtccacctcgaccgtccctcctacgacctacgtcgtacgggtcgggtcccgttcccgggtacggtaaggtacgtaggaacgggtcttagttaactttaacgttacgtacggtcgtaccgtaaccgggtagggtacgttacgaacctacggttaccgtacgggttaacggttaccggggttccgggttacggggttaccgggaccgggggtaaaccggggaacccggtaacggggttcccggttaaccgggtaccccggttaaccgttaaacgttaccggaaccggttaccccgaaacggggtccccttaccccgggcccccgtttacccgg

SEQ ID NO: 247446 - DNA, 661 bp, Homo sapiens
  misc_feature: GYAE6OF01DYTF8.17.28.C06.1.454.CMB.1.raw
  modified_base (283)..(283): a, c, t, g, unknown or other
  misc_feature (283)..(283): n is a, c, g, or t
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtggggggtccctgagactctccgtgtgcagcctccggacttccccttnagtagttattggatgacttgggtccgccagactccgaggggaagggctggaggtgggtgccaanataagcaagatggaactgccgtagttttacgnggacttcgtggtaggagggtcctttcacctatcctaccgagacgtacaaccgaccaagtaactcctacttgtaactacgtaacaaccgtagaaaccgcgtaccctaggaacgtacggtacgtcgaacgaccgtaccgggtccgttagttaacgtttactaggtcgacgtaaggtaggttaggtaaagggtaaaaaagttagtagggtccttagggtttacgtttacgggttacgggggtacccgtaagggggacgttccccggtgggtacccgtaccccggg

SEQ ID NO: 247447 - DNA, 666 bp, Homo sapiens
  misc_feature: GYAE6OF01CH83D.17.28.C06.1.454.CMB.1.raw
  modified_base (193)..(193): a, c, t, g, unknown or other
  misc_feature (193)..(193): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgngaggtccagttggttgagtccgggggagcctggtccagccgtgggggtccctgagactctcctgtgcagcctccggacttccccttanaggttagttattggatgacgttgggtccnccagctccgaggggaagggctggagtgggtggccaanataaagcaagatggaactgccgtagttttacgnggtactgtggtagaacggtcctttcaccatcctaccaggacgaccaacgaccaagtaacttcgactgtactctaaccaactgaacacgtccgtaggaacgagtaccgacaacggacgtacccgggaccgttgtaacgtttaacgtgggttacgacggtaacgtagttacgggtaaagggaaaaaaacgtttaggtacgggtacgttcgggttttaggttttaagggttccgggggtaacccggtacggggggtaccgtcccccggttgggtccccgtaaccccggg

SEQ ID NO: 247448 - DNA, 882 bp, Homo sapiens
  misc_feature: GYAE6OF01EK2KY.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgcttgttttagaggtgtcagtgtgagtcagttggtgagtcggggagctgtcagcgtggggtcctgagactctcctgtcgcacgcccgtccggtacttcccccttgtagttacgtttattggtaattcggtacgttggggtccccgccaaggtacctccggaagggggaacggggtcgtaggggaggttggggtacgaccaaacgtaagtaaaacggacgaaaggtacgtacgggaacttcggtacccggtttaaggtttttaccggagggtaccttcggttagggttacgggtaacggggttcccgttttaccaccctaacgttcccgttaccgaacggacgtaacccgaaacgtacccgtaaaggtaactttaccgtaacgtttacgttaacttaaccctaaaccgtaaccttacggaaacctacggtacccgtaaggtacggaacgggttccgaaccgtaacgggtaaccgtaccccggggtaccgtttaacggtttaaaccgttttacggttacgggttacggtaaccgggtaagttaaaccgggttaggggttaaaaacgggttaaaaaaacggtttagggttaggggtaccgttttaagggggtttacgggttttttaaacggggttacccggggggtaaccccgggttaagggggttacccccgggtttaccccgggttggggttaaccccccggtttaacccccggg

SEQ ID NO: 247449 - DNA, 979 bp, Homo sapiens
  misc_feature: GYAE6OF01BDWSP.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacaggaggactccaccagtgggtaggttggggctagtaacgtttcgggtttttccttggttgtcgtttgttttaaggaaggttcgtccgtaggttggtggtacggttccgtaggtttgggttaggacggggttccggggggacggtccgttcggtaccgacggtccgggttccggggggtccctaggacgtaccttcctccgtgtcgcgacgtcccgtaccggtacctttccccttagtagtttacgtttagttggtattacggtacggttcgggtccccgaccgaacgtcccgtaccgggaagggggacggggtcggtaggggtagggttggggtaccgaaccgaaaacgtaaacgtaaaacggaacgtaaaggtaacggtaacgggtaaaccgtcgggtaacccggttttaaacggtttttaaccggggtacggttacccgtttagggttacgggttaaacgggtaacccggggtttccccttttaacccgaaccctttaacgtccccgtaaccggaaacgggaaaccggtaaacccgtaaacccggtaaccgtaaaacggtttaaacctttacccgttaaacgtttaaccgttaactttaaacccgtaaactaaacgttaaccggaaacccgtacggtacccgtaacgggtaaacggtaccggtaccgaacgtaacgggaacccggtacccgggttaccggttaagtttacgtttaccggtaggtacggtaacggtaagtaggttaacgggtaaaaaggtaaaaaggttcggtacggttggtttacggtttagggtttaccggggacgggtaccgggtacgggtcccgttaccgttgggtaaccccttcccggg

SEQ ID NO: 247450 - DNA, 732 bp, Homo sapiens
  misc_feature: GYAE6OF01CWYZU.17.28.C06.1.454.CMB.1.raw
  modified_base (323)..(323): a, c, t, g, unknown or other
  misc_feature (323)..(323): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggaggttggggctgaacttggttttccttgttgcttgttttagaggtgtcagtgtgaggtccaggttggtgaggtccggggagcctggtccacgccggtgggggtccctgacgactctccgtgtgcacgccctccggtactttccccttctagttagttagttggtatcgtacgttcgggtcccnccaggtacctaccgggaaggggaacggggcgtagggtagggtggggtacggaaccaaactaaagtaaaacgacgaaagaacgtaggaacttcggtaccgtttaaggttttacggacggtacttacgtacggtacgggaacgggtttcccgtttaccaactacttccctaaccgagtacgaaccaaccgaccgaaagtaacttcaacttgtaactacctaacacgtacgaaacctacgaccgtagaagtacgtaccgacgaacggacccgtaccggtccgttagttaacttacggtggacgacgtaagtagtagggtaaaggtaaaaagttacggtaggttcgttggtttagggttttaacggtcggggaccggtaggggacccgttcccggtggttacccgtaccccgg

SEQ ID NO: 247451 - DNA, 614 bp, Homo sapiens
  misc_feature: GYAE6OF01DTKKD.17.28.C06.1.454.CMB.1.raw
  modified_base (254)..(254): a, c, t, g, unknown or other
  misc_feature (254)..(254): n is a, c, g, or t
  modified_base (276)..(276): a, c, t, g, unknown or other
  misc_feature (276)..(276): n is a, c, g, or t
  modified_base (340)..(340): a, c, t, g, unknown or other
  misc_feature (340)..(340): n is a, c, g, or t
  modified_base (375)..(375): a, c, t, g, unknown or other
  misc_feature (375)..(375): n is a, c, g, or t
  modified_base (463)..(463): a, c, t, g, unknown or other
  misc_feature (463)..(463): n is a, c, g, or t
  modified_base (488)..(488): a, c, t, g, unknown or other
  misc_feature (488)..(488): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgtttagaaggtgtccagtgtgaggtccagttggtgagtccggggagcctgtccagccgtgggggtccctgagactctcctgtncacgcctccggtacttcccctnagttagttattggatgacgttggtccgcagactcgaggggagggctggaggtgggtcgaccaanaagtaaagcaagatggaactgaccgtagtttacgngtactgtgtaggacggtccttcacctatcctcgaacggtacgaacaaccgaccaaagtacttacacttcgtaactacctacaacgtanaacgacgctaggacgtagtaccggnaacgacgtaccggtccgtagttacttcgtgtcgcgaagtatacggtaaaggaaaaacgttgtggtacttggttagttttacggtacgggggtactaacggggacgtcccggtggttcccgtacccg

SEQ ID NO: 247452 - DNA, 601 bp, Homo sapiens
  misc_feature: GYAE6OF01C8XA5.17.28.C06.1.454.CMB.1.raw
  modified_base (273)..(273): a, c, t, g, unknown or other
  misc_feature (273)..(273): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (469)..(469): a, c, t, g, unknown or other
  misc_feature (469)..(469): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttcctgttgctgttttagaaggtgtcagtgtgaggtcagttggtgagtcggggagcctggtccagccgtgggggtccctgagactctcctgtcgcacgcctcggacttcccctnagtagttatggatgacttggtccgccagacctccgaggggaagggctgggacgtgggtggaccaacaagtaaagacaagagtggaactgccgtagtttacgnggactcgtgtcgaacgggtccttnaaccnttccacagagaacaacgaccaaagtatcatgtaatactacaactgaacagcctagagtacgcganaacgaccgacggccgttgtaacttacgtgtgcgaaggtacgtaggtaaaggtaaaaaggttagaggttacttggttaggtttaacgggttggggacccgttaagggacctcccgggtggttcccgtacccgg

SEQ ID NO: 247453 - DNA, 676 bp, Homo sapiens
  misc_feature: GYAE6OF01CRSNS.17.28.C06.1.454.CMB.1.raw
  modified_base (208)..(208): a, c, t, g, unknown or other
  misc_feature (208)..(208): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccgggnagagggtcaccatatcttgttctaggaaacagcctccggcatctacaaactaaactatttttgctaggtaccagactaacttcccaggactcccggccccccgtactcctcactactaataagaaatgactacacgtccggtcccgtccggggtccctagaccgtacttcctcgtcggtcctacattcgtctcggcctacctcgacgtccctacccgtcgaaccctagtccgtacgggttcgggtacccgtcccgggtaccggaagggtactaggtacggtactaggttaactttacgttacgtcgtacgaccgtacgggtaggactacgaactcgtaccgttaggtaacgttcgggttccgggttgggttaccgggacggggtacggaccgtacgggtccgtaccggtaccgttaccgtacgaccgtaccggaccccgtaggtccccgtcccggtcccccgttacgg

SEQ ID NO: 247454 - DNA, 647 bp, Homo sapiens
  misc_feature: GYAE6OF01B9WO5.17.28.C06.1.454.CMB.1.raw
tcagcgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtcgtcgggacccccgggcaggagggtcaccatatcttgttctggaaacagctccggcatctacaaactaaactatttttgctggtaccagcaattcccaggactcccggcccccgactcctcatctatagaaatgatcatccggcccgtccggggtcctgaccgtattctctggctcatcgtcgtggccacctcacgtccctccctagaccatcgaggtcgggccttccgggtccgaggtacgtggacggtctagtatttacttacgtgtcgtcgtacggtggatcgactacttccgtagtaacggttcgggttacccggttcgggtttaccggggacgggtacgggtaccgagggtccgtacggtacccgttccgtaacgtccgacggtaccccgaacgggtccctacccggtccccccgttacggtccctacccgttccgttcccggttcccccctccccttccccg

SEQ ID NO: 247455 - DNA, 805 bp, Homo sapiens
  misc_feature: GYAE6OF01DLYW5.17.28.C06.1.454.CMB.1.raw
  modified_base (187)..(187): a, c, t, g, unknown or other
  misc_feature (187)..(187): n is a, c, g, or t
  modified_base (792)..(792): a, c, t, g, unknown or other
  misc_feature (792)..(792): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggaggttggggctgaacttgggttttccttgttgcttgttttagaggtntccagtgtgaggtcagttggttgaggtccggggagccgtggtccacggccgttcggggggtccctggacgtaccgtctccgtgtcgcacgtcccgtccggtactttccccgttactagttagtttagttggtattcggtacgtttcgggtccccgacccgtaacggtaccctaccgggaaggggggaacgggggtccgttagggggacggggttcgggggttacggacccgaaaacgtaaagttaaaacggacgtaaaaggacggttacgggtaaaccgttcggtaaccccggtttaaggttttttaccggcgggttaaccttcggttaggtacgggtaaccggggttccgttttacccaacctacgttcccgtaccgaaggaaccggaaccaaccgaaccaaagttaacttacctaaccttagttaactacctaaactaacctaagaaccgtacgacgttagaacgtagtccgactaacgaccggtaccggccgggtttattacgttacgtggtacgagaggttagtaggtaaaaggtaaaagttgtacgggttatttgggtttacggtttagggtaccggggaccgtaggggaccttcccggnggttccctacccg

SEQ ID NO: 247456 - DNA, 706 bp, Homo sapiens
  misc_feature: GYAE6OF01BUQR8.17.28.C06.1.454.CMB.1.raw
  modified_base (418)..(418): a, c, t, g, unknown or other
  misc_feature (418)..(418): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtcagtgtgaggtcagttggttgagtcggggagcctggtccagccgtgggggtccctgagctctcctgtcgcacgcccgtccggtacctttcccccttcaggttagtttagttggattggtacgttcggggtcccgccagacctccgaagggggaagggcgtggaggttggggtcgaccaaacgtaagtaaacgcgaaagagtaggaactcggaccggttaagttttacggngtacctgtggtacggaacgggtcccgtttacacctattcctaccgaagacgacgaaccgaccaaagtacttacacttgtaactacctaacaacgtagaaccacgcctaggacgagtccgacaacggaccgtaccgggtccgttagttaacctttacgtggtacccgaggtaagtacggttaaggttaaacgggtaaaaaggttgtagggtacgtttgggtttacggtttaaggggtttcggggacccgttaaggggacccgttccccggttgggttccccgtacccgg

SEQ ID NO: 247457 - DNA, 656 bp, Homo sapiens
  misc_feature: GYAE6OF01DWGPX.17.28.C06.1.454.CMB.1.raw
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaacttgggttttccttgttgcttgttttagaggtgtccagtgtgagtcagttggttgaggtccgggggaggcctggtccagccgtggggggtccctgagactctcctgtgcagcctccggacttcccctnagttagttattggatggtacttgggtccgccagactccgaaggggaaggggcgtgggaggtgggtcggaccaacaataaaagcaagatggaactgcgtagtttacgnggactctggtagaacgggtcctttacacctatcctccgaagacgaaccgaaccgaccaaagtaattacaacttgtaatacctaacaactagaacagtcctagacgagtaccgacgaacgaccgaaccgggtccgtagttacgttacgttggtacgacggtaagtacgtagggtaaggtaaaaaacgtaggtaggtcgtttaggttagggttttaggttacgggggtaccgtaacggggaccgtaccccggttggtcccgtaccccgg

SEQ ID NO: 247458 - DNA, 755 bp, Homo sapiens
  misc_feature: GYAE6OF01CYDFH.17.28.C06.1.454.CMB.1.raw
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtntccagtgtgnggtccagttggttgaggtccggggaggcctggtccaggccgtgggggtccctgacgactctcctgtgcagccctccggtactttcccccttcacgttagtttaattggtatggtaccgttggggtcccgccagaccctccggaaggggaacggggccgtgggagggtcgggggtcggaccaaaacgaaagtaaaggaccaaaggaagttcgggaaaccttcggaccggttaaggtttttacggtagggtaccttcgttggtaacggacggggttaccctttccgaaacctacgttcctaccgaaggacgaaccgaaacccgaccctaaaagtaactttaccaacgtttacgttaacgttaacctaaccgtaaaccgttacggaaacctaggtacccgttaggaacggtacgtccggaccgaaggacccgacggtcccgttagttacgttacgttgtagacgtaagtacgtaggtaaagggtaaaagtaggtaggtacgttaggtttacggtttaggttcgggaccggtaggggtacccgtccggtcgggtccctacccg

SEQ ID NO: 247459 - DNA, 743 bp, Homo sapiens
  misc_feature: GYAE6OF01EWFGQ.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtcagtgtgaggtcagttggtgaggtccggggagcctggtccagccgtgggggtccctgagctctcctgtgcacgcctccggacttccccttcagttagttagttggatgtacgttgggtcccgccagacctccggaggggaacggggcgtggggaggttcggggtacggaccaaacgtaagtaaaacggacgaaaggacgtaacgggaaccttcggtacccggtttaaggttttttaaccggtacgggtaaccttcggttacggtacggggtaaaccgggttcccgtttaccaaccgttactccgtaccgaagaacgtaaccgaaaccgacccgtaaagtaacttaccgaacttacgtaacttaccgtaaacctaactacggaaaccacggtaccctaggaacgtacgtccgacaacggaaccgaccgggtcgttagttacgttaccgtggtacgacgtaagtagtaagggtaaaggtaaaagttcgtaggtacgtttggttacggtttaggacggggaccgtaggggtacccgtcccggttggtcccgtaccccgg

SEQ ID NO: 247460 - DNA, 813 bp, Homo sapiens
  misc_feature: GYAE6OF01BJLDU.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgcttgtttagagtgtcagtgtgaggtctagttggtgaggtcggggagcctggtccagccgtgggggtccctgacgactctcctgtgcacgccgtccggtacctttccccgttactaggttagtttagttggattcgtaccggttcgggtccccgaccgtaggtacccgtaccggaaggggaacggggtcgtggggacggttggggtacggaccaaacgtaaagtaaagaccgaaggagtacgggaacttcggtacggttaagttttaccggtggtaccttcggtacggttacgggtaacgggttcccgtttaccaacccttacgtacccgttaccgaacggaaacgtaaacccgaaaccggtaacctaaagtaacgtttaaccgaacgttacgttaacgttaacctaaacccgtaaacgtaccggtaaaaccgacgtacccgtaaggtaaacggtcgtacccggacaaacggtaaccggttaccggaccggttacgtttaagtttacccggtgttaccggacggaaacgttacggtaaaggttaaaacgggtaaaaagttcggtaggttacgttggggtttacgttttacgggtacggggtaccggttaacgggtacgtcccgttccggggtccttaaccccggg

SEQ ID NO: 247461 - DNA, 688 bp, Homo sapiens
  misc_feature: GYAE6OF01BJBZV.17.28.C06.1.454.CMB.1.raw
  modified_base (274)..(274): a, c, t, g, unknown or other
  misc_feature (274)..(274): n is a, c, g, or t
  modified_base (396)..(396): a, c, t, g, unknown or other
  misc_feature (396)..(396): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgaggtcagttggttgaggtcggggagctggtccagccgtgggggtccctgagactctcctgtgcagcctccggtattcccctnacgttagttattggatgtacgttcgggtccgacagtacgtccgaggggaacgggcgtggaggtggggtacggaccaaagaagtaaacgcgaagagtaggaactggaccggttagtttacggngtaacttcgtggtaggaacgggtccctttacacctattccaccaaggacaacgaaccgacaaagtacttaccactagtacttacaacaactgaaaccagtacctagaacgtcgtaccgacgtaggaccgtaccggtacgttagttaacgttcggtgtaccggacggtaacgtaggttaacgggttaaaagggaaaaaggtttcggtagtacggtttggtttaaggttttacgggtccggggggtacccgaagggggttcctaccccggtttcggggtaccttaacccccggg

SEQ ID NO: 247462 - DNA, 709 bp, Homo sapiens
  misc_feature: GYAE6OF01DV7AC.17.28.C06.1.454.CMB.1.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagaaggtgtccagtgtgaggtcagttggttgagtccggggagcctggtccagccgtgggggtccctgagactctcctgtgcagcctccggacttccccttnagttagttattggatgtacgttgggtccnccagactccgaaggggaaggggctgggaggtgggtggaccaacaataaagcaagataggactgccgtagtttacgngactctggtagaacgggtccttcgacctatctaccgaagtacgaacgaaaccgtaccgaaagtacttacacttacgtaacttaccgtaacaacgttacgtaaaccgacgtaccctaggagtaacggtccgaacgacggaaccgtaacccgggtaccggttaggtttaactttaacggttacgtcggaccgaaaggttaaggttaacgggttaaagggtaaaaaaaccggtagttacgggtacggtttgggtttaacgtttaacgggtttcgggggacccgtaaacgggggtccgtacccccgttaggggttccccctaaaccccggg

SEQ ID NO: 247463 - DNA, 688 bp, Homo sapiens
  misc_feature: GYAE6OF01E18NE.17.28.C06.1.454.CMB.1.raw
  modified_base (397)..(397): a, c, t, g, unknown or other
  misc_feature (397)..(397): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcacgcctccggacttccccttcagttacgttattggatgacgttgggtccgccacgactccgagggggaacgggcgtgggaggtggggtcggaccgaacaataaagcgaagagtggaactgaccgtaagttttacggnggtactcttggtaggtaacgggtccgttttccacctactcctaccgagacgaaccaaccggaccaaagtaattcctacttacgtactacctaaccaaactacgaaacctacggccctaggaacgtacggtccgacgaaggaaccggaccgggtccggttacgttaacgtttaaccgtggtacggacggtaacgtagtagggtaaaggtaaaaagttaggtagggtacttggttaggttttagggttacggggtaccggtacggggaccgccccgttaggtcccgtaacccg

SEQ ID NO: 247464 - DNA, 772 bp, Homo sapiens
  misc_feature: GYAE6OF01DLEXN.17.28.C06.1.454.CMB.1.raw
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgcccaccctcagtcgtccgtcggggacccccggnaggagggtcaccattatcttgttctaggaacngctccggcatctacaactaaactattttgctacggtaccagactaacttcccgaaggtaccgtcccccggaccccccgtacttccctactaacgttaccttaaagtaagaaacgtcgtactaccgtaacggtcccccgggtccccggttaccccgggggtccctaccgggtaaccgttacgtttccgtcggtacggtcccttaccgtaggttccgttacccgtcggtaccctaccccgttaccgaccgtcccccttacccgtaccggaacccttacggtaccggtacgggtccgggttacccggttaccccgggtaacggtacggtaagttcgggaacgttcgtaagttactttaacgttacgtcggttccgacgtacggtagtactacggtacctaacgttccgtaggtacggttccgggttcggttacggtaccggggacgggtaaggaccggtcggtacgttaccggtaccgtacgtacggtacccgtacggtacccgaacgtcccgtccggtcccccgttacgg

SEQ ID NO: 247465 - DNA, 638 bp, Homo sapiens
  misc_feature: GYAE6OF01CFDQ7.17.28.C06.1.454.CMB.1.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtccgggggaggcctggtccagccgtgggggtccctgagactctcctgtgcagcccgtccggtacttccccttcagttagtttattggatgtacgttgggtcccncgagacctccgagggagggctgggagtgggtcggaccaaanagtaaagcaaagagtggaaaccttggcccgttaaggttttacggtaggacttcgtgtaggtaacgggtcccgtttcaacctatcctaccgagtagaaccaacgtaccaaagtaacttcaactagtactactacaactgaacacgtctagaggagtcgacacgaaccgacggtccgttagtattactggtagcgtagtatacggtaaggaaaagtagttagggtacttggttacgtttagggttcgggacggttacgggacgtcccgtggtcccgtacccg

SEQ ID NO: 247466 - DNA, 889 bp, Homo sapiens
  misc_feature: GYAE6OF01EFBB7.17.28.C06.1.454.CMB.1.raw
  modified_base (738)..(738): a, c, t, g, unknown or other
  misc_feature (738)..(738): n is a, c, g, or t
  modified_base (791)..(791): a, c, t, g, unknown or other
  misc_feature (791)..(791): n is a, c, g, or t
tcagcgtagactagcacgaccggtgctcgatttagagctcacgtattggggttggggagggtctccagacgaggaggacgttaggcccgtggtacctcctaagggcctttccacttggtgaatcaagcactgacgcaaccagaggacttcgacctagtaggtaggtttcgggcttgaacttgggtttttacctggttcgtctagttttagaaggtagtccagtgtggtaggtccgtaggttggggttggacggttccgggggacgccgtcggtccgaggtcccgtacggggggtaccctggaacgtcctccgtccgtgtcgacgaccgtcccgttaccgggttactttccccccgttagtaaggtttacggttacgttacgggaacttacggtaaccggttttccggggtaccccggtacccggtaacccggtaaccccgttaaccccggaaacggggggggtaaaccgggggtccggtaaggggggtaacgggtttccgggggggtacggtaaccccgggtaaaacgtaaacgttaaaaagggttcccgttaaaaggtaacggtttacgggtaaaaccggtcggggtacccggtttaaagggttttttaccgggtacgggtaaccgtttcggttaggtacggtaacgggttcccgtttaccgaccgtagtaccgtccaagtaccgacaaccgtccaaatacttcaacgtcgtaactcgtaaacacgtagtaaaccgngtacccgtggaagaccgtcgactaacggccgaacggtccgttagttaacgttnaggtacgcgaaaggtacgtgggtaaaacgggaaatcggttggacgtttaggtaggtttacggtcggggtcacggggtccctcggttggcccgtacccg

SEQ ID NO: 247467 - DNA, 765 bp, Homo sapiens
  misc_feature: GYAE6OF01DY1SH.17.28.C06.1.454.CMB.1.raw
  modified_base (289)..(289): a, c, t, g, unknown or other
  misc_feature (289)..(289): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggaggttggggctgaacttgggttttccttgttgcttgttttagaaggtgtcagtgtgagtctagttggttgaggtccgggggagccgtggtccaggccggtgggggtccctgacgctctcctgtcgcacgcctccggtaccttccccttnagttagttgttaggattggtacgttcgggccgccaggtaccgtaccggaggggaacggggtcgtgggtacgggtggggtacggaaccaaaacgaagtaaaacggctaaaaggtacgtaacgggtaacgtcggtacccggtttaaggtttttaaccgcggtaccgtttcgtttacgggtacgggtaaccggggtttccccgtttaaccgaaccctaacgttcccgtaaccgaggaaaccgtaaccgtaaccgaaaccgtaaacgtacgtttacctaaacgttacgttaacctaaccttaaaccgtaactacggaaacctacggtaccgtagtaacggtacgtaccgacgtaagacccgtaccgggtaccgttagttacttcgtgtacggtgaagtagtaggtaaaagtaaaaggtgtaggttacgttgtttacggtttaggtcgggtacgacgggtaccgttccgtggtcccgtccg

SEQ ID NO: 247468 - DNA, 692 bp, Homo sapiens
  misc_feature: GYAE6OF01DX7JH.17.28.C06.1.454.CMB.1.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagagtgtcagtgtgaggtcagttggttgagtccgggggaggcctggtccagccgtggggggtccctgagactcctcctgtgcacgcctccggtactttcccccttnagttagttacttggatgacttgggtccnccagactccgaggggagggctgggagtgggtcggaccaacgaataaagcaaagagtggaaactggtccgtaagtttttacggnggtaaccttcgtggtaggaacggggtcccgtttcaaccgtatcctaccgaagtagaacccgtaaacgcccaaaggtaactttcaacgttgtaacttaccgtaacaacttagaaaccacgtaccctagaaggactaccggacaaggaccaccggggtaccgttgttaacttacgtggtacggacggaagtaacgttgggtaaaacgggtaaaaagttaacgtgggtacgtttggtttagggtttttaggtacggggggtacctaacgggggtaccgtccccgtgggttccctaaccccgg

SEQ ID NO: 247469 - DNA, 832 bp, Homo sapiens
  misc_feature: GYAE6OF01DN72J.17.28.C06.1.454.CMB.1.raw
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggttttcctgttgcttgtttagaggtntcagtgtgagtcngttggtgaggtcggggagcctggtcagccgtcggggtcctgacgctctcctgtgcacgccgttccgacttccccttcagttaagtttagttggaacttggtacgtttcgggtcccgaccgacgtaccgtccggaaggggtaacgggggccgttggggaaggttcgggggtacggaccccctaaaaagtaacgtaaaaacggaccgaaagggtaacggttaacgggtaaacccgttcggggtaacccggtttaagggttttttaaccggtaggggttaaccctttcggtttaaggtttacggggtaaaaccggggtttcccccgtttttaacccgaaaccctacggttacccgtaacccgaaaggtaaccgaacccgaaaaccggaacccgtaaagtaaccttaccgtaacttaacgttacgtaaacccgttaaccaaaccgtaacgaacccgacgtacccgttacggaacggtacgttacgaccgaacgtaaccgtaccggaccgttagttacttaacgttcggacgtcgtaagtaacggtaaggtaaaacgggtaaaagtacgttaggtcgttaggttaggtttaacggccggggtaaccgaagggtaccctcccggtttacgccccgttaacccgg

SEQ ID NO: 247470 - DNA, 866 bp, Homo sapiens
  misc_feature: GYAE6OF01A9RPE.17.28.C06.1.454.CMB.1.raw
  modified_base (425)..(425): a, c, t, g, unknown or other
  misc_feature (425)..(425): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggttttccttgttgcttgtttagaggtgtcagtgtgagtcagttggtgaggtccggggagcctggtccagccgtggggtcctgagactctcctgtgcagccgtccggtactttccccttatagttagttattggtatgtacgttcgggtacccgcagaccgtcggaaggggaacggggtcgtaggggtaggtggggtacggaccaaacgtaagtaaaacggacgtaaagagtacgggaacctacggtaccggttaacggtttttaaccggnggtaaccttcgttacggttacgggtaaacggggtttccccttttaccgtaaacccgtaacgttaccccgtaccgtaaaggaaccgtaacccgtaaacccgtaacccgaaagttaaaccgtttccgtaaaccgttagttaacctttaaacccgtaaacctaaaccgtacgaaaaccgtaccgtacccgtaaggaacggtacgtccgaacgtaaccggaaccggtacccgggtacgtttaacgtttaacgttaacgtcggaaccgtacgggtaaagttaacggttaaggtaaaaaacggggttaaaaacgttacgggtttacgggttaacgtttttcgggtttaaaccggggttttttaagggtaccccggggggtaaacccggtaacggggggtttaacccgcccccggggttttaacgggacccccgttttaacccccggg

SEQ ID NO: 247471 - DNA, 669 bp, Homo sapiens
  misc_feature: GYAE6OF01EQ8XH.17.28.C06.1.454.CMB.1.raw
  modified_base (347)..(347): a, c, t, g, unknown or other
  misc_feature (347)..(347): n is a, c, g, or t
  modified_base (383)..(383): a, c, t, g, unknown or other
  misc_feature (383)..(383): n is a, c, g, or t
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggtttccttgttgctgtttagaaggtgtcagtgtgaggtccagttggtgagtccggggagcctggtccagccgtgggggtccctgagactctcctgtgcgagtcctccggacttccccttcagttagttattggaatgacgttgggtccgccagactccgaggggaagggctgggaggtgggtggccaanataaggcaaggatggaactggaccgtagttttacgnggactcgtgtggaacgggtcctttacgacctatcctcaaggacaacaacgccaaagaacttcgactgtactctaacaactgaaactacgcctagaacgtacgtcgacgtaagaaccgacgggtacccgttagtttaaccttacgtggtcggtaccggtaaggtagttacgggtaaagggtaaaaaacgttggtacgggtacctttgggtttagggttttaacggttaccggggggaaccgtaacgggggaacccggttccccggtagggttccccgtaaccccggg

SEQ ID NO: 247472 - DNA, 696 bp, Homo sapiens
  misc_feature: GYAE6OF01CXWA1.17.28.C06.1.454.CMB.1.raw
  modified_base (183)..(183): a, c, t, g, unknown or other
  misc_feature (183)..(183): n is a, c, g, or t
  modified_base (287)..(287): a, c, t, g, unknown or other
  misc_feature (287)..(287): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggtttctgtgctgtttagagtgtcagtgngagtcagttgtgagtcggggagctgtcagcgtggggtcctgagctctcctgtgcagccgtccggacttccccttgagttagttattggatgacgttgggtcccncagacctccggagggaagggctaggaggtgggtagacccaaatagtaaaagcaaaggagtacggaactcggtaccgttaagttttacggcggtacttcgtaggtacggaacgggttccgtttacaaccgtatacccgtaccgaaggtaccgaaccgaaccgacccgaaaggtaacctttacgaacgttacgttaactaccgtaaaccaacgttacgaaaccgacgtacctaggaacgtacgtaccgacgacgaacccgaccggtaccggttagttaacgttacgtcggtaggacggtaacgtagtacgggttaaaaggtaaaaacggtagttaggtacggttaggtttacggttttaggtcgggggtaccgaacgggtaccggttcccggttgggtacccgtaccccgg

SEQ ID NO: 247473 - DNA, 798 bp, Homo sapiens
  misc_feature: GYAE6OF01CBY01.17.28.C06.1.454.CMB.1.raw
  modified_base (280)..(280): a, c, t, g, unknown or other
  misc_feature (280)..(280): n is a, c, g, or t
  modified_base (417)..(417): a, c, t, g, unknown or other
  misc_feature (417)..(417): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtcagttggttgaggtccggggagcctggtccagccgtgggggtccctgagactctcctgtgcagcctcggacttccccttnagttagttattggatgtacgtttgggtcccgccaggacctaccggaagggggaacggggcgtgggaggtggggtcggaccaaacaagtaaaacggacaaaggacgtaggaacttcggaccggttaagtttttacggnggtacgttcgtggtaggtaacggggtcccgtttacacctattccgtacccgtaaggaacgtaaccgaaaccggacccaaagtaactttccgaacgttagtaacgtacctaaactaacgtacgaaacctacgtaccgtagacggaacgtccgacgtaacggaacccgtaccggggtacccgtttagttaaccgttttacgtacgggtggaccggtaaaggttaagttacgggttaaaaagggtaaaaaaacggtttaggttagggttacggttttaggggttttacggtttttttaaggggttacccggggggggttaaccggtaaacggggggtaccccggttaccccgggtttacgggttaccccggttaaacccccggg

SEQ ID NO: 247474 - DNA, 750 bp, Homo sapiens
  misc_feature: GYAE6OF01BT85Z.17.28.C06.1.454.CMB.1.raw
  modified_base (321)..(321): a, c, t, g, unknown or other
  misc_feature (321)..(321): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagcccaccctcagtgtctcggggacccccggcaggagggtcaccatatcttgttctggaaacagctccggcatctacaactaactgtttttgctggtaccagcaacttcccgaggactcccggccccccactcctcatctaatanaaatgatcgacgtccggaccccgttccggggtccctacggtaccgtacttcgtcgtcgggctccattcgtctcggccctaccgtaccgacgtacccttccccgtagtaaccctagttcccgacgggttccgggttacccgttccccggggtaccgggaagggtacgtcgggtaacgggtccgttaggtaacttttaacgttaccgtggtcgtaccgtaccgggtgggtaacttacggtaaccgtacgttaccgttaaggtaacggtttccggggttacccgggttacgggttaccggggtaccggggtaaccgggggtaccgtaccggggttcccgtaccgggtacccccgtttaacccggtaacggttacccggaaccggtacccccgggaaccgggttccccgtccccgggtacccccgttcccggg

SEQ ID NO: 247475 - DNA, 615 bp, Homo sapiens
  misc_feature: GYAE6OF01AQ8ZJ.17.28.C06.1.454.CMB.1.raw
  modified_base (281)..(281): a, c, t, g, unknown or other
  misc_feature (281)..(281): n is a, c, g, or t
  modified_base (387)..(387): a, c, t, g, unknown or other
  misc_feature (387)..(387): n is a, c, g, or t
  modified_base (432)..(432): a, c, t, g, unknown or other
  misc_feature (432)..(432): n is a, c, g, or t
  modified_base (463)..(463): a, c, t, g, unknown or other
  misc_feature (463)..(463): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgtgctgttttagaagtgtccagtgtgaggtccagttggttgaggtccgggggaggcctggtccagccgtggggggtccctgagactctcctgtgcagcctccggattccccttnagtagttattggatgacttgggtcccgccagacctccgaggggaaggggctgggagtggggtggaccaacagtaaagcaagatggaactggaccgtagttttacgnggacttcgtggtagaacgggtccgtttacacctatcctcgagganacacgcaagattcatgtatcaacactgaacngcctagacgagtccgacgagaaccgacggtcccgttagttacgttactggtacgacgtaggtatcgggtaaaggaaaaacgttagtcgggacttggttgtttaacggttcgggggacctaggggtacctcccgttagggtccctaacccggg

SEQ ID NO: 247476 - DNA, 794 bp, Homo sapiens
  misc_feature: GYAE6OF01C61S8.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacgaggaggactcacagtggaggttggggctagtaacgttgggttttccttgttgtcgtttagttttaggaaggttcgtacctaggtgtgacggttccgtaggtttggttggacgggtccgggggacggtccgttcgggtaccgacggtcccgggttcgggggggtccctaggacgtcctcctccgtgtcgcacgtccgtacgtaccttccctagacggttattagtgtatgtacgttcggtccgacacgacgtccggaagggtacgggtcgtagggtaggtcgggtacgaaccaagtaaagtaaacgagtaacgagtacggaacgtcggtaccggtttaagttttaccggacggttcgtcggtacggttaacgggtaaccggttcccgtttacgaacccttacgtccctaacgaacggtaaccgaaccgaaaccgtaaccgtaaaggtaacttaacctacgttacgttaactaaccgtaaacgtaaccgttaacgaaaccggtacgtacgtacggaacggttacgaccgacgaaaccggtaccggtaccggtaacgttagtacgttacgtgggtacgtacgtagttagtaaagggtaaagtaaaaggttcgtaggtcggttaggttaggttaggtacgggacggtacggaccgttccgtcggtcctcccgg

SEQ ID NO: 247477 - DNA, 621 bp, Homo sapiens
  misc_feature: GYAE6OF01ALLE9.17.28.C06.1.454.CMB.1.raw
  modified_base (382)..(382): a, c, t, g, unknown or other
  misc_feature (382)..(382): n is a, c, g, or t
  modified_base (495)..(495): a, c, t, g, unknown or other
  misc_feature (495)..(495): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggcctggtccagcctgggggtccctgagactctcctgtgcagcctccggacttccccttcagttagttattggatgacttgggtccgccagactccgaggggaagggctggaggtgggtggccaaacataaagcaagataggaactgccgtagttttacgnggactcgtgtgaagggtccgtttcacctactctcccgagacgaccgaaccgaccaaagaacttcacttgtactactacaactagaacagtcctagagtacgtcgcaacgaacnccgggtccgtagttacttactgcggacgaggtactagggtaaggtaaaaagtagtgggacgttggtttaggttttaaggttcgggggacccgtagggggacgtccccggttgggtcccgtacccgg

SEQ ID NO: 247478 - DNA, 654 bp, Homo sapiens
  misc_feature: GYAE6OF01DRYDY.17.28.C06.1.454.CMB.1.raw
  modified_base (252)..(252): a, c, t, g, unknown or other
  misc_feature (252)..(252): n is a, c, g, or t
tcagcgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtcgtcgggacccccgggcagacgggtcaccatatcttgttctggaaacagctccggcatctacaaactaaactnttttgctggtaccagactaattcccgaggactccggcccccgactcctcatctatagaaatgatcacgtccggcccgtccgggtcctcgaccgtacttctcgtcggctccagtcgtctcggcctacctcgacgtccctcctacgacctctacgaggtcgggccgtccgggtacgaggtacgtggacgtcttagtatttacgttacgtcggtcgaccgtacggtggatacgactagtccgtagtaacgttcgggttccggtggtcgggacgggacggaccgaggtaccgtcggtaacccgttacgttaacggaccgaccggacccgtaagggtcccctaccggtccccccttacggtacccttaccgttcccgttacccggttcccccgtcccctttaccccg

SEQ ID NO: 247479 - DNA, 708 bp, Homo sapiens
  misc_feature: GYAE6OF01DIWC3.17.28.C06.1.454.CMB.1.raw
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaacttgggttttccttgttgcttgtttagaagtgtcagtgtgaggtcagttggttgaggtccggggagcctggtccagccggtcgggggtccctgacgactctccgtgtgcacgtcccgtccggtactttccccttacgagttagtttagttggatcgtacgttcgggtcccacgagtaccgtccggaagggggaacgggtcgtagggaggttgggtacggacctaaacgtaagtaaaagcgtaaaggagttacggaacttcggaccgttaagtttttacggcggtacttcgtaggtacggaacgggttcccgtttacaaccgtattccgtaccgaagacgaacaacgacaagtaacttcacttagtactactaacacgtagaactacgcctagacgtacgtcgacgaacgtaccgacggtcgttacgtacttacgtggtagacgtagtacgttagggtaaacggtaaaaagttgtacgggttacgttaggtttacggtttaggttaccggggaccggtaacgggacccgttcccgttgggtacccttaaccccgg

SEQ ID NO: 247480 - DNA, 874 bp, Homo sapiens
  misc_feature: GYAE6OF01BUNU6.17.28.C06.1.454.CMB.1.raw
  modified_base (731)..(731): a, c, t, g, unknown or other
  misc_feature (731)..(731): n is a, c, g, or t
tcagcgtagactagcacgaccggtgctcgatttagagctcacgtattgggtttggggaggtctcagagaggaggcttagccctggactccaaggtccctttccacgttggtgatcagcactgagcacagaggactcaccagtggaggttggggctgtaacgtttgggttttccttgttgtcgtttaggttttagtaaggtcgtccgtagtggtggaggtccgtaggtttggttggacgggttccgggggagtccgtcggtccgacggcccggtcgggggtccctaggacgtaccgttccgtccgtggtcgccgacggtcccgttccggtaccctttccccgttacgtaaggttagttaagttggtagttcggttacggttcggggtcccgaccgtaacggtaccggtaccgggaagggggaacgggtcgttaggggtagggtcggggtaccgaacctaaaacgtaagtaaacgacgtaaaggtagtacgggtaacctcggtaccggttaaggttttaccggacggtacgttacgtgggtacggtaaccggggttcccttacgtacctacgtacccgaccgtaaggaacgaaccgaaccgtaccgaaagttacgttacccgtagttacgttaaacttaccgtaaaccaaccgttagaaaaccgtcgttaccgaggtaacgtccggtaccgaacgaacgtccgggtaaccgtcgttaacgttagtttaccggnggttaacggacgttaacggagtttaacggtaaaaaacgggttaaagttcggtacgggttcgttttaagggttacggtttaaggggttaccgggtacgggttaacggggtaccgtacccggttcgggttaccccgttaccccgg

SEQ ID NO: 247481 - DNA, 832 bp, Homo sapiens
  misc_feature: GYAE6OF01DYQMW.17.28.C06.1.454.CMB.1.raw
  modified_base (462)..(462): a, c, t, g, unknown or other
  misc_feature (462)..(462): n is a, c, g, or t
tcagcgtagactagcacgaccggtgctcgatttagagctcacgtattggggtttgggggaggtctcagagaggaggcttagccctggactccaaggcctttccacttggtgatcagcactgagcacagaggactcaccatggagttggggctgaacttgggttttccttgttgcttgttttagaggtgtcagtgtgaggtcagttggtgacggtccggggaggccgtggtccacggccggtgggggtccctgagctctccgtgtcgacacgcctaccggtacttccccttagtaagttagtttagttggtattggtaacgtttcggggacccacgaacgtaccgtacgggaacgggggaacggggtccgtaggggacggtacgggtacgaaccgaaacgtaaaataaaggacgaaaagtaacgtacgggtaaacgtcggtacccggttaagtttttaccggngggtaccttaggtggtaacggtaacggggttaccccgtttactacccgtaaacttccgttaaccgaaacggaacctaacccggaaaaccgaacctaaaacggtaactttaccgaaacgtttacgtaaccttaactaaaccctaacgtacgaaacgaccgtccgtaaggtaacggacggttccacgaaagacccggtaacgggtccggttaacttaagtacggttagggtcgaaaccgggtaagtaaggttaagggtaaaaagggtaaaaagttgggttacggtacggttttcgggtttaacgggtttacgggaccgggggttacgaacggggggtcctttaaccccgggttggtacccccggtaacccgg

SEQ ID NO: 247482 - DNA, 752 bp, Homo sapiens
  misc_feature: GYAE6OF01C8K4J.17.28.C06.1.454.CMB.1.raw
  modified_base (186)..(186): a, c, t, g, unknown or other
  misc_feature (186)..(186): n is a, c, g, or t
  modified_base (230)..(230): a, c, t, g, unknown or other
  misc_feature (230)..(230): n is a, c, g, or t
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttcctgttgcttgttttagaaggtntccagtgtgaggtccaggttggtgaggtccggggagcctgtccngccgtgggggtccctgagactctcctgtcgcagcccgtccgtacttcccccttanagtagttatggtattcgacgttgggtccncacgactccggaggggaagggngtcgggaggtggggtcgaccaaanaagtaaacgacaagatacggaactcgtaccgtaaggtttacgtggaccttgtaggtaggtaacgggttcccttaccactaccgtctacccgaaggaacgaaccgaaaccgtacccgtaaagtaaccttcctaaaaccgttcgttaaacgttaacccttaaccgaaacgttaacgaaaaccggtaccgtacccgttaaggtaacggtacggttaccgaaccgtaacggaacccggacggggtaccccgtttagttaacgtttaccgttaggttcgacggtaacgtagtaagggttaaaggtaaaaaaggttagtagggtacctttggttaccgggttttaggttcggggaccggtaacggggccgtttaccccggtgggtaccctacccccgg

SEQ ID NO: 247483 - DNA, 724 bp, Homo sapiens
  misc_feature: GYAE6OF01BCGQK.17.28.C06.1.454.CMB.1.raw
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (267)..(267): a, c, t, g, unknown or other
  misc_feature (267)..(267): n is a, c, g, or t
  modified_base (329)..(329): a, c, t, g, unknown or other
  misc_feature (329)..(329): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtccgtcgggcccagtctgtgctgactcacgccctaccctcagtcgtcgtcgggacccccgggnaggacggtcaccatatcttgttctagaaacngctccggcatcacaactaactnttttgctggtaccagctacttccaggctccggcccccgtactcctacactctagtaagaatnactcagtcccggtcccgtcccgggttcccgtacgaccgtacttccgtcgtcgggtaccttccgtagtttcggtccgtaccgggtccctacccgtccgtaccccgtcccttccccgtacgaacccgtacgtaccgtacggggttcccggggtacccggttccccggggtaccggaagggtacgtacgggtacgggttcgttaacggttactttaacgttccgttgggtccgaccgtacgggtggtaacgtcggtactcgttacgtaggttacgggttcgggtccgggttgggtcccgggagggtaaccgggtcggtaacggtcccggtacggtacccggttacgtacggacccgtaccgtacccggaccggtcccgtacccgttccccggtacccg

SEQ ID NO: 247484 - DNA, 870 bp, Homo sapiens
  misc_feature: GYAE6OF01D2EE3.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttggttttcttgttgcttgttttagaaggtgtcagtgtgaggtctagttggtgaggtccggggagccgtggtccaggccgtcgggggtcctgacgactctcctgtcgcacgcccgtccggtacctttccccttacgtagtttagtttagttggtacttcggtacgtttcgggtcccgaccgacggtaccgttccggaaggggggtaacgggggtccgttaggggtacggggttcggggtaccggaacccgaaaacgtaaagtaaaacggacgtaaaaggtagtacgggaaaccgtcggtacccggttaaggtttttaccggtacggtacttcggttagggttacgggtaaccggggttcccttttaccaacccgtacgttcccgtaccgtaaacggaaccgaaacccggtaaacccgtaaccgtaaaacgttaaccgtttaccgtaaacgtttacgttaaaccttacccgttaaaaccgtaaacgttaacgaaaccgtaaccggtcggtaaggaacgtaccggtaccgaccggtaacggaacccggtccggtaaccggtttacgtttaaagttcccggtagggttaccgaacggttaaaggacgttaaagggttaaaagggtaaaaagttcggttacgggtttacgtttagggtttagggtttacgggcgggggtaaccgtacgggtacccgtccggttcggtacccgtaccccgg

SEQ ID NO: 247485 - DNA, 754 bp, Homo sapiens
  misc_feature: GYAE6OF01AEAYA.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtcagttggttgaggtcggggagcctggtccagccgtggggggtccctgagactctcctgtgcacgccgtccggtacttcccctcagttagttattggatcgtacgttgggtcccgccgagacctaccggagggggaacggggcgtagggagggttggggtaccggtaccaaaacgtaacgtaaaacgcgtaaaggtagttacggaacttcggaccggttagttttacggtggtacttcgtggtacggtaacgggtcccgtttacaaccagttaccctacccgtaggaacgaaccctaaccggaaccccgtaaagtaactttaccgaacgtttacgttaacgttaaccctaaccgtaaaccgttacgaaaccgtacggtacccgtaaggaacggtacggtaaccgaccgtaaacgggaaccgaccgggttcgttagttaaccgttacgtgtcggtaacggaagtagtagggtaaagggtaaaaagttggtacggtattggttaggtttaagggtcggggaccgtaggggaccgttcccgtcgggtcctaacccccgg

SEQ ID NO: 247486 - DNA, 604 bp, Homo sapiens
  misc_feature: GYAE6OF01BG1EI.17.28.C06.1.454.CMB.1.raw
  modified_base (191)..(191): a, c, t, g, unknown or other
  misc_feature (191)..(191): n is a, c, g, or t
  modified_base (360)..(360): a, c, t, g, unknown or other
  misc_feature (360)..(360): n is a, c, g, or t
  modified_base (382)..(382): a, c, t, g, unknown or other
  misc_feature (382)..(382): n is a, c, g, or t
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaggtgtccagtgngaggtccagttggttgaggtccgggggaggcctggtccagccgtggggggtccctgagactctcctgtcgcagcctccggattcccccttcagtagttattggatgacgttgggtcccgccagacctccgaggggaagggctggagtgggtgccgaacataaagcaagntaggactgccgtagttttacgngactcgtgtggaacgggtcctttacacctactcctccgagaacgacaacgaccaagaattcactagtactacctacaactacgaacagaccgtacgagngtacgcacgaccgaccggcgttagttacttacgnggtcgacgagtagtaggtaaggtaaaaagtagtagtcgttaggtttggtttagtaggggccgagggacgtcccggtggtcgtaccccgg

SEQ ID NO: 247487 - DNA, 895 bp, Homo sapiens
  misc_feature: GYAE6OF01AT81F.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccagtggaggttggggctgtaacgttgggtttttccttgttgtcttgtttagaggtgtccagtgtgacgtcgtaggttggttgacggtccggggagccgtggtccgacggtcccggtcgggggtccctggacgtaccgttccgtccgtggtcgaccgtaccgtccccgttacccggttacctttcccccctttacggtaacggtttacggttttaagtttcggtaacgttcggtaaccggttttccggggtaccccgacccgtaacggtacccgttacccggggaaaggggggtaaaccggggtcggttacgggggtaacgggttcggggtaccggaaacccgtaaaacgtaaagtaaaacgacgtaaaaggtacgttaacgggaaccgttcggtaacccggtttaacggttttaacggtacggtaccgttacgttaggtacggttaaccggttccccgtttaccaccgtacttaccgaccgtaaggaaccgaaccgaaccgtaaccgtaaacgtaacttacctacgttacgttaacttaacgtaaccgtaaccgtaacgaaccgacgtaccgtagtaacgtacgtaccgacgaaccgaaccggtaccggtaccgttacgttacgttacgtacgtacgtacggtaggtaagtaaaggtaaaggtaaaaggtaaggttaggttacggttaggttacccccccccggtttaggttacgggtaccggtacgggtaccggtacccggtccggttcccgtaccccg

SEQ ID NO: 247488 - DNA, 790 bp, Homo sapiens
  misc_feature: GYAE6OF01A8YVZ.17.28.C06.1.454.CMB.1.raw
  modified_base (499)..(499): a, c, t, g, unknown or other
  misc_feature (499)..(499): n is a, c, g, or t
tcagcgtagactagcacgaccggtgctcgatttagagctcacgtattgggtttggggaggtctcagagaggaggcttagccctggactccaaggcctttccacttggtgatcagcactgagcacaggagactcaccagtggaggttgggctgtaacgttggtttttccttgttgtcttgttttaaggaggtcgtccgtagtggtgtacggtccgtaggtttgggttggtacggggtccgggggacggtcccgtcgggtcccgacggtccggttcggggggtccctaggacgtaccgttccgtccggtgtcggaccgcgtccccgttccggtacctttcccccttagtaaggtttacgtttagttcggtagttcggttacggttcggggtccccgaccgtagtacccgtaccggggaaggggaacgggtctagggcgggttgggtacgaccgaaactagtaaacgacgaagagtcggaactcggtacgttagtttacggngtacgtcgttggacggtaccggtccttaccacctctaccgcaacgacaaccgtaacgacgaaagtactcgtaagtagtaactcaaacgtaaccacgtaacgactccgagaggactcgacgtaaaccgtacggcccggtagtacgtttactaggtcggtacggacgaaggttacgttaagggtaaaaaggttaaacggtcgttaggggttaccgttttaagggttagggttaaccggttacgggggacccgttacggggtacggtttcccgtacccggcggtttaacccccg

SEQ ID NO: 247489 - DNA, 689 bp, Homo sapiens
  misc_feature: GYAE6OF01BHCQK.17.28.C06.1.454.CMB.1.raw
  modified_base (599)..(599): a, c, t, g, unknown or other
  misc_feature (599)..(599): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggttgaggtccgggggaggcctggtccagccgtcgggggtccctgagactcctcctgtcgcacgcctccggtactttccccttacgagttagttattggatgtacgttcgggtcccgcgagaccgtccggaagggggaacggggcgtaggggagggtggggtcggaccaaacgaagtaaagacgaagagtaggaacgtggaccgttaggttttacggtggtacgtcgtggtacgggtaacgggtcccgtttaccacctacgtccctaccgagacgtaaccaaccgaccaagtaacttccaacttagtaactacctaacaactagaaaccgacgtccttaaggacgtaacgtcgacgaacgaccgacgggtccgttagttaacttacgtggacgngaaggtagttaaggtaaaggtaaaagttgttaggagtttggttaggtttagggtcggggtaccgagggcgtcccggtggtccccgtaccg

SEQ ID NO: 247490 - DNA, 611 bp, Homo sapiens
  misc_feature: GYAE6OF01EZX1O.17.28.C06.1.454.CMB.1.raw
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
  modified_base (472)..(472): a, c, t, g, unknown or other
  misc_feature (472)..(472): n is a, c, g, or t
tcagcgtagactagcacgaccggtgctcgatttagagctcacgtattgggtttgggggaggtctaaaacagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggacttccccttcagtagttattggatgacgttgggtcccgccagactccgaggggaacggggctgggaggtgggtggaccaacataaagcaagatggaactgccgtagttttacgnggactcgtgtggaacggtccgtttcacctntctccagacgacaaccgaccaagacttcactgaactctacaactcgaaacncgacctagagtacgtcgacagaccgacgggccgttagtaacttctggtacgagagtagtaggtaaaggtaaaaagtgtaggcgttggttagtttaggttcgggggaccgaggggtactcccggttggtcccgtacccgg

SEQ ID NO: 247491 - DNA, 836 bp, Homo sapiens
  misc_feature: GYAE6OF01EZK44.17.28.C06.1.454.CMB.1.raw
  modified_base (190)..(190): a, c, t, g, unknown or other
  misc_feature (190)..(190): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgtaacgttgggttttccttgttgcgttgttttagaaggtntccagtgtgaggtcgtaggttggtggacggtccgggggagcctggtccaggtccggtcgggggtccctgacgaccttctccgtgtcgcgacgtcccgttcccggtacctttcccccttacgtaacgttaggtttacgttagggtattcggtaccggtttccggggtccgacccgtaacggtacccgtccggaaggggggtaacggggtccgtaggggacggggttggggtaccgggtaaccctaaaacgtaaagtaaaacggtacgaaaggtacgtacggtaaaccgtcggtacccgtttaggtttacggtaggtaccgtttcgttacgggtaaccgggttccttaccgacctacgttccgtacgaaggtaaccgaactaaccgtaaccgtaaagtaacttaccgtacgttagttaacttaacctaactaaaccgtagaaaccgtacggtccgtaaggacgtacggtaccacgaacggacccgtaaccggtccgttaggttaacttacgttcgtacggtaccggaagttacggtaaggtaaacggtaaaaaagttacggtaggttacgttagggtttacggtttaacgggtcgggaaccggtaacggggaccgttacccggtcggttaccccgtaacccgttcccg

SEQ ID NO: 247492 - DNA, 839 bp, Homo sapiens
  misc_feature: GYAE6OF01BW7HY.17.28.C06.1.454.CMB.1.raw
tcagcgtagactagcacgaccggtgctcgatttagagctcacgtattgggtttggggaggtctcagagaggaggcttagccctggactccgaaggcctttccacttggtgatcagcactgagcacagaggactcaccagtggaggttgggctagtacgttggttttccttagttgtcgttgtttagagtcgtcgagtgtgagtctaggttggtggacgggtccggggaggccgtcggtccacgggtccggtcgggggtccctggaacgtcctcctccgtagtcgcgtacgtcccgtccggtacctttccccgtagtaaggttagtttagtaggtatcggtaccgttcgggtaccgccaaggtacccggtaccgggaagggggaacgggtcgttagggacggttacggggacgaacctaaaacgtaagtaaacgaacgtaagtagtaacgggtacctacggtaccggtttaaggttttacggacggtacgttcgtacggggtaacggtaccggggttaccttaccaaccggtacttaccgtaaccgaagggaaccgaaccgaaccgtacgtaaacgttaacgtcttaacgtacgttaactacctaactaacgtaacgaacgtacgtagtacgtaagtacgtaccgaacgacgaccgtacgggtacgttattaaccggtttgaacggttaccgaggtaagtaaggtttaacgggtaaaaaaggttaaaccggtagggttacggtttacggttaggttttaaacggggtttttaccggggcggggttaaaccccgggttagggtaaaccccgttcccggttagggaccccgtttaaccccgg

SEQ ID NO: 247493 - DNA, 744 bp, Homo sapiens
  misc_feature: GYAE6OF01AF4YI.17.28.C06.1.454.CMB.1.raw
  modified_base (247)..(247): a, c, t, g, unknown or other
  misc_feature (247)..(247): n is a, c, g, or t
  modified_base (277)..(277): a, c, t, g, unknown or other
  misc_feature (277)..(277): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgcccaccctcaggtgtccgtcggggacccccgggcaggacgggtcaccattatcttgttctaggaaacncgtcctccggcactctacaaactaaacttntttttgctaggtaccagactaacttcccgaggaccgtccccggaccccccgtacttccctacactactaagtaacgaaatacgactaccacgtcccgggtccccggtccggggtccctacggtaccgtacgttctcgtcggtcctcgtacgtcgtccgtcggccctacctccgaccgtccctacccgtacgacctcgtccgtacgggtccggtcccgtcccgggtacgacggtcgtacggacggtcgttagtaacgttttaacttccggtggttccggaccggttaaccgggtgggtaactcgtaaccgtacgttacgtacggttaacggttccggggttccgggttacgggtccgggacggggtaccgggtaccgtacgggtaccgtaccgggtaacccgttacccggttaacgaccgtacccggtacccggaacggttccccgtccccggtccccgttacccggg

SEQ ID NO: 247494 - DNA, 820 bp, Homo sapiens
  misc_feature: GYAE6OF01AGQXD.17.28.C06.1.454.CMB.1.raw
  modified_base (253)..(253): a, c, t, g, unknown or other
  misc_feature (253)..(253): n is a, c, g, or t
tcagcgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtcgtcgggacccccgggcacggagggtcaccatatcttgttctggaaacagcctccggcatctacaactaaactntttttgctggtaccagacaacttcccgaggactccggcccccgactcctcatctaatagaatgactcacgtccggcccgttaccggggtccctacggaccctacgtttccgtaccgtcgggtccttacccgtagttcggttccgtccgggtaccctaaccccgttccgaacccggtcccccgtttacccgttaccggaaaccccgtaccgttaccgggtaaccggggttcccgggggtacccggttacccccgggggttacccggtagggtacgttacggggaaccggtttccgtttaacggttaaactttttaacgtttaccgttacgggttaccggtaaccccgggttacgggttacgggaacgttacggaaccgttaacgttaccccgttaggtaacggttccggggtttaccgggtttcgggttaccggggaccgggtagggtaaccccgaggtacccgttacggaccccgttacgttaaccggacgtaccggacccgtaacggcccgttaccggcccccgttcggtccctaccgtcccgttccgttcccccgtccctacccg

SEQ ID NO: 247495 - DNA, 799 bp, Homo sapiens
  misc_feature: GYAE6OF01A8D1Q.17.28.C06.1.454.CMB.1.raw
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgtttagaggtgtcagtgtgaggtcagttggtgaggtcggggagctggtccagccgtgggggtcccngagcttctcctgtgcacgtccgtccggtactttccccttntagttagtttagttgggatggtacggtttcgggtcccnccacggaccctacccggaaggggggaaggggtccgtggggtacggtggggtcggacccaaacgtaagtaaaacgcgaaagacgtacggaactcggtaccggttaaggtttttacggacgggtaccttcggttagggtacgggtaaccggggtttcccgttttacccgaacccgtacgttcccgtaccgaacggtaacgaaaccgtaaacccggtaaccctaaaggtaaactttacccgtaacgtttacgttaacgtttacccttaaaccgtaacgttaacgaaaccgtaccgtacccgtaggaacggtaacgtccggacaacgggtaccgaacccgggtcgttacgtttaacgtttcggtcggtagaccgggtagtacggttagggtaaaaggtaaaagttggtcggtaggttggttttacggtttagggtaccggggtaccgggtacgggtaccggtcccgttcgggtccctaccccggg

SEQ ID NO: 247496 - DNA, 905 bp, Homo sapiens
  misc_feature: GYAE6OF01CHMBU.17.28.C06.1.454.CMB.1.raw
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttggttttccttgttgcttgttttagaaggtgtcagtgtgagtccagttggtgaggtcggggagcctggtccagccgtgggggtcctgagactctcctgtgcngcctcgtacttcccttnagttagttagttggtatcgtacgttcgggtccgccgaaggaccttccggaaggggaacggggtcgtaggggaggtcggggtacggaccctaaagaacgtaaaagaccgaaaggtagttaacggtaaacctcggtaccggttaaggtttttaaccggttaggtaacccgtttacgtttacgggtaacggggtaaaaccggggtttcccgttttacccgaacccgttagttaccccgtaccggaaaggtacggaaacccctaaacccggaaccgtaaaacggttaactttacccgtaaacgtttacggttaaacttacccgtaaaccgtaaacgttacgtaaaaccgaccgttaacccggttagggaacgtaacgggtacccgaccggaaacgtacccggaaaccggggtttcccgttaagttaaaccgttttaacgtcgggtaagggaacccggttaaggtaaggttaaaggggtttaaaaaacggggtaaaaacggtttaacgggtagggtttaaccggttttggggttttaaccgggtttttaaacggggtttacgggggggaaacccggttagggggggttaaccccgttacccccggtttacgggggttacccccgttaacccccggg

SEQ ID NO: 247497 - DNA, 619 bp, Homo sapiens
  misc_feature: GYAE6OF01AEWCQ.17.28.C06.1.454.CMB.1.raw
  modified_base (309)..(309): a, c, t, g, unknown or other
  misc_feature (309)..(309): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
tcagcgtagactagcacgaccggtgctcgatttagagctcacgtattggggtttgggggaggtctcagagaggaggcttagccctggactccaaggcctttccacttggtgatcagcactgagcacagaggactcaccatggagttggggctgaactgggttttcctgttgctgttttagaggtgtcagtgtgaggtcagttggttgaggtccggggaggcctggtccagccgtggggggtccctgagactctcctgtgcacgcctccggtacttcccctcagttagttattggatgacgttgggtccnccagacctccggagggggaaggggcgtgggaggtggggtagaccaaacaataaaagacaagagtaggaactgaccgtagtttacgnggactntggtgaacggtcctttacacctatcctaccgagacgaaccaacgaccaaagtaacttacacttagtactacctaacaactgaacagcctagagacgtcgacgagaaccgacggccgttagtacttacgtgtgacgtaagtagtaggtaaaggtaaaagtagtaggtacgttgttaggtttaggttacgggcgtagggaccgtccgtcggtcgtacccg

SEQ ID NO: 247498 - DNA, 624 bp, Homo sapiens
  misc_feature: GYAE6OF01ENEPL.17.28.C06.1.454.CMB.1.raw
  modified_base (385)..(385): a, c, t, g, unknown or other
  misc_feature (385)..(385): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcagcctccggacttccccttcagtagttattggatgacgttggtcccgcagactccgaggggagggcgtggagtgggtcggaccaacaataaagcaagataggaactgaccgtagttttacgnggtactctggtgaacggtcctttcacctatctaccgagagaccaacgaccaagaacttacactagtactactaacaacgtacgaacacgccgtagagtacgtccgacacggaccaccggtaccgtcgttattacgtagtcggacgtagtagtaggtaaagggaaaaagttagtggtacttcggttaggtttagttcgggggaccgtaaggggaccgtcccggttggtcccgtaccccgg

SEQ ID NO: 247499 - DNA, 686 bp, Homo sapiens
  misc_feature: GYAE6OF01AC828.17.28.C06.1.454.CMB.1.raw
  modified_base (286)..(286): a, c, t, g, unknown or other
  misc_feature (286)..(286): n is a, c, g, or t
  modified_base (410)..(410): a, c, t, g, unknown or other
  misc_feature (410)..(410): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttgggctgaacgttgggttttccttgttgcttagttttagaaggtgtccagtgtgaggtccagttggttgaggtccgggggaggcctggtccagccgtgggggtccctgacgactctcctgtgcagcctccggacttcccctnagttagttatggatgacgttcggccgaccagaccgtccggaggggaacggctgggagtgggtacgaccaaagaagtaaagacaaggtatacggaactggtaccgtaggttttacggtgtacttntaggtaggtacgggttacctttacacctatcccgtaacagaacgtaaccaaccgacctaaagtacttaccaacgttagttacctaactaacctaacgtacaacgacgtccgagaacgtacgtccgacacgaccgcggtaccgttagttacttacgtgacgacgtaagtagtaaggtaaaggtaaaacgttgtacgggttattgggttttaacggtttacgggtacggggtaccgggtaaggggacccttacccgggtcggttaccccgtaccccgg

SEQ ID NO: 247500 - DNA, 741 bp, Homo sapiens
  misc_feature: GYAE6OF01DBEZN.17.28.C06.1.454.CMB.1.raw
  modified_base (223)..(223): a, c, t, g, unknown or other
  misc_feature (223)..(223): n is a, c, g, or t
tcagcgtagactagcacgaccggtgctcgatttagagctcacgtattgggtttggggagcttcagctgtggtagagaagacaggattcaggacaatctccagcatcggccgcttccctctcctcctccaccctcctcactcactgtcgcgacgggtccgtcgggcccagtctgtgctcgactcgacgcccaccctgacgttcgtccggtccggggaccccggnaaggacggtccaaccattattcgttcgttacgagggaaacctgtccgtccgctatacctaactaaacttaacttgtttcgcgttacggacacgtacctaacgtccgaaggtccccgtaccccggaccccctatccttactactacgtaataagtaacgtcgtactcgtaacccggtccccggtccccggtaccgggtcctacgtaaccgtctttcgcgtaccggtctacgtcgttcgtacgtaccgaccctaccgtaccgtaccgtacccctccgtaacgtacctacgtccggtacggtaccgggtcccggtacggtaccgtaggtaggtcgaccggtattagttacgttataccggtacgtacggtacccggaggttacgacgtacgtactaccgtacgtcggtaacggttcgggtacggtcgggttacgggaccgggagtaccggtcggtacggtaccggtaccgttcggaaaccgtcgacccgtacgaacccggtccgtacccgtcccggtcccg

SEQ ID NO: 247501 - DNA, 726 bp, Homo sapiens
  misc_feature: GYAE6OF01AVOWU.17.28.C06.1.454.CMB.1.raw
  modified_base (222)..(222): a, c, t, g, unknown or other
  misc_feature (222)..(222): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggaggttggggctgaacttgggttttccttgttgtcttgttttagaaggtgtccagtgtgaggtcagttggttgaggtcggggnggaaaaaaaaccgtggtccgagccgtcgggggtcccgtgagactctccgtgtgcacgccgtccggactttcccccttcacgttagttattggtatgtacgttgggtccgccgacgtacctccgaggggaacggggcgtggtaggtggggttcgggccgaacgaattaaaaggaccgaaagagtacggaacgtgaccgtaaggttttaacggttacgggtacgttccgtggtgtaacgggtacccgttttacccgaccgtactctccacggacaaccgaacgacccaaggaaactttccaaacttacggttaacttacctaaccgaaccttacggaaacctacgccgttagaggtacgtccgacgacgacgaccgggtccgtagtacttacgtagtgacgagagttaggtaaggtaaaaagtagtagggacctttgggttaggtttttaagtcgggggtaccgtaacggggacgttaccccgttgggtaccccgttacccccggg

SEQ ID NO: 247502 - DNA, 731 bp, Homo sapiens
  misc_feature: GYAE6OF01C5HYX.17.28.C06.1.454.CMB.1.raw
  modified_base (277)..(277): a, c, t, g, unknown or other
  misc_feature (277)..(277): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaggtgtcagtgtgagtccagttggtgaggtccggggagcctggtccaggccgtgggggtccctgacgactctcctgtgacagcctccggacttcccctnagtagtttatggatgtacttcggggtccaccagtaccgtccggaaggggaacgggcgttgggaggtggggtaccggaccaacgaaagtaaaacgcaagaacggtacggaacgtcgtccggttaaggttttacgaggaccttgtaggttacgggaacggttcccgttaccacctacttccgtaccgaagacggaaccaacccggacctaaaaggtacttaccgtaacgttagtaacttaacctaacctaacgtacgaaacctacgcccgttaagagtaccggtcacgaacgaacccggtaccgggttaccgttaggttaaccttagttcgtacggacggtaaggtagttaacgggtaaaaggtaaaaagttcggtggtaccggtttagggttaggttttacgggacggggtaccggaagggggtaccctaccccggttgggttcccctaccccgg

SEQ ID NO: 247503 - DNA, 797 bp, Homo sapiens
  misc_feature: GYAE6OF01BIDQE.17.28.C06.1.454.CMB.1.raw
  modified_base (216)..(216): a, c, t, g, unknown or other
  misc_feature (216)..(216): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggttttcctgttgcttgttttagaggtgtccagtgtgagtcagttgtgagtcgggagctgcngcgtggggcctgagactctcctggtcgcacgtccgtccggtacttcccccttactaggttagttagttgggtacttaggtacgttcgggtacccgacctaaggacccgttaccggaaggggggtaacggggccgtagggggtagggttacgggggtacgggtacccaaaacggtaaagttaaaacggaccgtaaaaggtaagtacgggtaaaccgttacgggtacccggtttaaagggtttttaccggtaggggtaaccctttgtagggtaacgggtaacgggttcccggtttacaacccgtattccgtaccaagtaacgaaccgaacgtaaccgaaacgttaacgtttaccacgttaggttaaaccttaccgttaaacgtaaaccctaacggtaaaccgtacgtaacccgtagggtaacgtacgtaaccgggacgtaacgtaaccgaccgggttaccgtgttaacgtttaccgtggtagacggtaagtagtggtaaaacggtaaaagttcgtagggctttgggttaagtttacggtaccgggaccggagggtaccgtacccggttggtacccgtaacccg

SEQ ID NO: 247504 - DNA, 643 bp, Homo sapiens
  misc_feature: GYAE6OF01DX7J2.17.28.C06.1.454.CMB.1.raw
  modified_base (381)..(381): a, c, t, g, unknown or other
  misc_feature (381)..(381): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtccagttggttgagtccgggggaggcctggtccagccgtggggggtccctgagactctcctgtgcagcctccggattccccttcagtagttattggatgacgttgggtccgccagactccgaggggaaggggctggaggtgggtggccaagataaagcaaagatggaactgccgtagttttacgngactctgtagaacgggtcctttcacctatcctaccgaagacgaacaacgccaaagtattacaactgtaactactaaccaactagaaacacgcctaggaagacgtaccgcaacggaccaccgggtaccgtaggttactttaaccgtggtcggacgagtaacgtagggttaagggaaaaaagttagttagggtactttgggttagttttaggttacggggggaccctaagggggtaccgtccccggtcgggttccgtaccccgg

SEQ ID NO: 247505 - DNA, 833 bp, Homo sapiens
  misc_feature: GYAE6OF01A0C61.17.28.C06.1.454.CMB.1.raw
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
tcagcgtagactagcacgaccggtgctcgatttagagctcacgtattgggtttggggatcacaaaacaaccagattcctcctctaaagaagccctgggagcacagctcatcaccatggactggacctggacgttctctttggtggtgcgagcagctacgaggtgtccgacgtcccaggtccagttggtgcaagtcgtgggctgaggtagagcgcgtggtcgtcggngaggtcctcgtanacgacggtcttcgtaggacggctaccttcgacgtcggtaaccttagtacgttttagtaagtttcggggttcgccgggacgggtcccgttcggtacgggaaccgtaagggtcccgtttagggaaggttcgggtaagggttaaggggaaacggtcggttacccggttacccgtttacggttacggtttaacccggaaacctaacccgtaaaccccgaaaacccgtttaacccggaccgaaaccgttaaaccgggtaacggtttaccccgggaaacgggtaccgttaacggaaccccttaaccgaaaccccgtaaccggttaaaccccgggaacggttaaacctaaaaccgttaacgaaccgtaaacgtacgttaacggtaccgtacggacgttaacgacgaacgtacgtaccttacgacctataccggtagacggtaccgacggttccttacgtccgttacgtcggtacgtaacggtagaacttaacgttacctaagtaaccttacgttacgtacccttttaccctttaccgttacccttaccgttacgtaccgtttcggaccggttacccgcgttaaccggggccccttacccgg

SEQ ID NO: 247506 - DNA, 784 bp, Homo sapiens
  misc_feature: GYAE6OF01B7QPX.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaacgttggttttccttgttgcttgttttagaaggttgtccagtgtgacggtcctagttggttgagggtccggggagtccgtggtccaggccgtcgggggtccctaggacgtactcctccgtgtcgcacgtccgtccggtactttcccccgttatagttagtttaagtggtatcgtacgttgggtcccgaccgagtacccgtaccggaaggggtaacgggtccgtagggtacggttgggtaccggaacccaaagtaaagtaaacggacgttaaaggacgtttacggaacgttccggaccggtttaacgttttacggtacgggtaacctttcggttacggttacgggtaaaaccgggtcccgttttaccgaccgtaaccgtttcccgaccgtaaagaaccgaaccgaaccgactaaacgtactaccgtacttagtaccgtactaaacgaacgtacgaaaccgtacgtaccgtagaacggagttaccgacgaaccggaaccggtacccgggtactttacgtacgtttaaccgtggttacggaacggtagtagttaacgggtaaagtaaaaagtcgtggttacggttggttaaggtttcgggacggtaccgagggccctacggtcgtacccgtacccg

SEQ ID NO: 247507 - DNA, 576 bp, Homo sapiens
  misc_feature: GYAE6OF01EQHJ9.17.28.C06.1.454.CMB.1.raw
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
  modified_base (542)..(542): a, c, t, g, unknown or other
  misc_feature (542)..(542): n is a, c, g, or t
tcagcgtagactagcacgaccggtgctcgatttagagctcacgtattgggtttggggaggtctcagagaggaggcttagccctgggacctccaaggcctttccacttggtgatcagcactgagcacagaggactcaccatggagttggggctgaactgggtttcctgttgctgttttagaaggtgtccagtgtgaggtccagttggttgaggtccggggagcctggtccaggccgtggggggtccctgagacgtctcctgtgcagcctccggattccccttcagttacgttattggaatggaacttcgggtccgcagactcaggggagggctggagtgggtgcaacataagcaaganggaactgccgtagttttacgnggtactcgtgtaggaggtcctttacgacctatcctcagacgacaacgcaagattcatgtatactacaacgtgaacngacctggaagacgtacgcaagactacggccgttnttacttacngtagcgagacgtggtaagaaaagtgtggtacttggtagttttagnggggaccaaggggactcccgtggtcccgtacccg

SEQ ID NO: 247508 - DNA, 803 bp, Homo sapiens
  misc_feature: GYAE6OF01EEB0F.17.28.C06.1.454.CMB.1.raw
tcagcgtagactagcacgaccggtgctcgatttagagctcacgtattggggtttggggaggtctcagagaggaggcttagccctggactccaaggcctttccacttggtgatcagcactgagcacagaggactcaccagtgggagttggggctagtaacgttgggttttccttgttgcttgttttagaaggtgtcagtgtgaggtctaggttggttggacgggtccgggggaggtcctcggtccgacggtccggtcgggggtccctggacgtctcctcgtgtgacgacgtcccgtccggtaccttcccctacgtagttagttagttggattcgtacggttcgggtccgtacccaacggtaccgtaccgggaaggggggtaacggggtcggttaggggacggggttcggggtacggacccgtaaagtaaagtaaacgacgaaagtacgtacggtaacgtcggtaccgttaggtttacggtcgtcgttacgtggtaacggtaaccgggtcctttaccgacctacgtaccgtaccgtagaaccgaacgaacctaccggtaaattacttacgtacgttagtaactaccgaactaaacgtcgaaactcgtaccggtagaacggtacgtccgacgtaacggaccgtccggggtactttaggttaacttcgtacggtagacgtaggtaacggttagaaaaaacgggttaaagttcgggttagggttaccgtttagggttttagggtttaaacgggcccggggtacgggtaaccgggtcccggttacccggtttggaaccccccgtttccg

SEQ ID NO: 247509 - DNA, 659 bp, Homo sapiens
  misc_feature: GYAE6OF01A8XBZ.17.28.C06.1.454.CMB.1.raw
  modified_base (503)..(503): a, c, t, g, unknown or other
  misc_feature (503)..(503): n is a, c, g, or t
  modified_base (558)..(558): a, c, t, g, unknown or other
  misc_feature (558)..(558): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgtttagaggtgtcagtgtgagtccagttggtgagtcggggagcctgtcagcggtcgggtcctgagctctctgtgcacgtccgtccggtaccttcccctagtacgttagttagttggatacggtacgttcgggcccgacgaacgtcctaccggaagggggacggtcgtagggaggttgggtacgaccctaaaacgtaagtaaacgacgaaagtagtacgggtaactcggaaccggttagtttacgggagtacttcgtaggtacggaacgggttccttacacctatcctacgagactaacacgacaagtatcatagtactactaacatacgaancgctaggacgtacgtacacgacgaaccgtacggtccgttaattacgttaaccggnggtacgagtaagtaggtaaaggtaaaaggtaaagtggtcggttattagggtttaggttacgggcgggaacggtaggtacccgtcggttcgtacccgtaccg

SEQ ID NO: 247510 - DNA, 850 bp, Homo sapiens
  misc_feature: GYAE6OF01CXWLF.17.28.C06.1.454.CMB.1.raw
  modified_base (365)..(365): a, c, t, g, unknown or other
  misc_feature (365)..(365): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcacatggagttgggctgaactgggtttccttgttgcttgtttagaaggtgtcctagtgtggagtcgtagttggtgagggtcggggagcgtggccaggccggtcggggtccctaggactacctcgtctggtacgcgaccgtccgtaccggtaccttccccgttataggttatttaagttggtattcgtacggttcggcccgacgagtacccgtacggaagggagggctagggnggtacggggacgaaccaagaaacgtaaaacgcgtaaaggaacgtacggaacgtacggtaccggtttaacggtttaacgacggaacctttggtacggtaacggggaaccgggttaccctttaacgaaccccgtattacccgtaacgtaacggaaacgtaaccgaaaccgtaaccgtaaagtaaccgtttacaacttaacggttaactaaaccgtaaacctaaacgtacgtaaaaccgacggttacccgtaaggtaaaccggacggaacccgaacgaaccgggtaacccggtaccgggttaacccttaaggtttaaaccttacggttacggggacgttaacggaaagttaaggttaaacggttaaaaaaggggaaaaggtttaacgtacgggtacggttttagggtttaaacggggtttacggacgggggtaacccggtaaaggggttccccgtaaccccgggttcggggtacccccttaacccggg

SEQ ID NO: 247511 - DNA, 748 bp, Homo sapiens
  misc_feature: GYAE6OF01DTC01.17.28.C06.1.454.CMB.1.raw
  modified_base (185)..(185): a, c, t, g, unknown or other
  misc_feature (185)..(185): n is a, c, g, or t
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (395)..(395): a, c, t, g, unknown or other
  misc_feature (395)..(395): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgtttagaaggtntcagtgtgagtccagttggtgaggtccggggaggcctggtccgagtccgtgggggtccctgacgactctcctgtgcagcctccggtattcccctntagtagttatggtactgacgttcggtccgccagacctccggaagggagggtcgtaggnggtcggcgacaaacagtaaaagcgaaagagtggaactcggtaccgtaagtttacggnggtaaccgttcgtaggtacggtaacggtcccgtttacacccgtactacctaccgaagaaccgaaccgaacccgtaaccgaaaaggttaaacctttcgtaaacgttacggttaaacttaccttaaaaccgaacgtttaacggaaacggtaccgtaacccgtaggtaaacgggacgttaccgaaccgtaacggaaacccgtacgggtacccggttaagttaacgtttaccgtaggttcggacgtaggtaagttacggtaaaagggtaaaacgtaaggtttaggtaccttggggtttaaacgtttgggttacggggaccgtacgggtacccgtccggttaccggttcgtaccccgg

SEQ ID NO: 247512 - DNA, 833 bp, Homo sapiens
  misc_feature: GYAE6OF01DZTFC.17.28.C06.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (309)..(309): a, c, t, g, unknown or other
  misc_feature (309)..(309): n is a, c, g, or t
tcagcgtagactagcacgaccggtgctcgatttagagctcacgtattgggtttggggaggtctcagagaggaggcttagccctggactccaaggcctttccacttggtgatcagcactgagcacagagactcaccatggagttgggctgaacgttgggttttcctgttgcttgtttagaaggtgtccagtgtgagtccagttggtgnggtcggggngctgcagcggtggggtcctgagactctctgtcgcacgccgtccgactttcccctatagttagttagtggtacgtcgtacgttcggggtacccncgtaaggccgttaccggaagggggtaacggggtccgttaggggaacgggtttcggggtaccgggaacccctaaaacggtaaagttaaaaacgggaccgtaaaaggtacggtaacggggtaaaaccttcggggttacccgggtttaaaacggtttttttacccgggtacggggttaaccgtttacccggttagggtttaacgggtaaacccgggggtttccccgtttttaaaccccgaacccgttaaaccgtttcccgttaacccggtaaggaaaccggtaaacccgtaaacccggaaccgtaaaacggtaactttaacgtaacgttacgttaactactaaccgtaaacgtaacgtaacacgtacctaggtacgtacgtacgacgacggaacgtacccgtacgttacgttacgttacgtagtacggacgtaaggtagttagggaaaggtaaaaggtacgtaggtcgttaggttcgttttaggcggggttacgacgggacggttcccggttcgtccggttaccccg

SEQ ID NO: 247513 - DNA, 775 bp, Homo sapiens
  misc_feature: GYAE6OF01E2EF3.17.28.C06.1.454.CMB.1.raw
  modified_base (181)..(181): a, c, t, g, unknown or other
  misc_feature (181)..(181): n is a, c, g, or t
tcagcgtagactagcacgaccggtgctcgatttagagctcacgtattggggtttggggaggtctcagagaggaggcttagccctggactccaaggcctttccacttggtgatcagcactgagcacagaggactcaccatggagttgggctgaacttggtttcctgttgcttgtttagagtntcagtgtgagtccaggttggtgaggtccggggagcctggtccagtccggtggggggtccctaggacgactctccgtgtcgctacgccgttaccggtactttcccccgttagtaaggttacgtttaagttcgggaacttcggtaccggtttccgggtaccgaccaacggtaccgttaccggaaggggggtaacggtcggtaggggtaaggttcggggtacggaccccgtaaaaggtaacgtaaacggacgaaagtacggtacggtaacgtcgggacccggtttaaggttttaccggacgggtacttcggttaggtacgggtaaacgggttcccttttaccaccgtactcccgtacgtaagaacgaaccaaccgtacctaaagtacttactacgtacgtactaccgaacgtaactagaaccgtacgtaccgtaggacgtacgtacgacgaacgaccgcggtaccgtacgtttaccttagtacgtcgacgtagacgttaacggaaaaggtaaaaccgttaggtggtacgtttcgggttagttacggggtacggggttaccggacgggtaaccggttccccgtaggtccccgtaccgg

SEQ ID NO: 247514 - DNA, 606 bp, Homo sapiens
  misc_feature: GYAE6OF01BSOXW.17.28.C06.1.454.CMB.1.raw
tcagcgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggcccccgactcctcatctatagaaatgatcatcggccctccggggtccctgaccgtattctctcgctccatgtctggcacctcacgcctccctgacctatcagtcggctccggtccgaggactgaggtctagattatactgtgccaccggtgggatgactatcctagaacgtgggttccggtggttcgggcgggtaacggggaccagggcgtacggaacccgttaccgtaaacgtccgaacggaccccgaaagggtccctacccggtcccccccgttacggtcccgtaacccttccgttcccggttcccccaaccccccgtttccccg

SEQ ID NO: 247515 - DNA, 784 bp, Homo sapiens
  misc_feature: GYAE6OF01EEI4S.17.28.C06.1.454.CMB.1.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (432)..(432): a, c, t, g, unknown or other
  misc_feature (432)..(432): n is a, c, g, or t
tcagcgtagactagcacgaccggtgctcgatttagagctcacgtattgggtttgggtaggtctcagagaggaggcttagccctggactccaaggcctttccacttggtgatcagcactgagcacagaggactcaccatggagttgggctgtaacttgggttttccttgttgcttgttttagaaggtgtccagtgtgagtcagttggttgaggtcggggagcctgtccngcgtgggggtcctganactctcctgtgcacgtcctaccggacttccccttcagttacgttattggattgtacgttggggtcccgaccagacctccggaagggggaacgggggcgttggggagggttcggggtacggacccgaaactaagtaaaacggcaaaggtatacgggtaaacctcggtacccggttaaggtttttacggnggtaccttcgtaggtaagggtaaccgggtcccgttttaccaacctacgttaccctacccgtaaggaaccgaacccgtaaaccgtaccctaaaaggttaacttaacctacgttaaggttaacttaccgttaaaccaacgttacgaaacgacgtacctacggtaagaaccggttcgaacgtaacggaaccgtaccgggtaccgttaacggttaatttaccgtggtacggtaacgtaaggtacggttaaggtaaaacggtaaaaagttacgttacggtacggtttgggttaaggttttacggttaacgggggtccaaacggggtaccgtacccggtgggttaacccgtaccccgg

SEQ ID NO: 247516 - DNA, 706 bp, Homo sapiens
  misc_feature: GYAE6OF01CNW8J.17.28.C06.1.454.CMB.1.raw
  modified_base (234)..(234): a, c, t, g, unknown or other
  misc_feature (234)..(234): n is a, c, g, or t
  modified_base (268)..(268): a, c, t, g, unknown or other
  misc_feature (268)..(268): n is a, c, g, or t
tcagcgtagactagcacgaccggtgctcgatttagagctcacgtattgggtttggggaggtctcagagaggaggcttagccctggactccaaggcctttccacttggtgatcagcactgagcacagagactcaccatggagttgggctgaacttggttttcttgttgcttgtttagaggtgtccagtgtgaggtcagttggtgaggtcggggagctgtccagccgtggggtccngagctctctgtgcagtcctcgtacttccccttanagttagttagttggattgacgttcgggtcccgccgagacctccggaaggggacggggctagggaggtggggtcgacaacgaataaagacaaagagtacggaacgtcggtaccggttaagttttacggcggtacttcgtaggtacggaacggttccctttacacctatccgtccgaagacaacgtaaccgacaagtaactctacttagtaactacgtaacaacgtagaaccgacgtacccgtaggtacgaacgttccgaacgaccggaccggtaccggtaccgtttagttaacgttacgtggtacggacgtaacggttagtaacgggttaaaggtaaaaaggtttacgtgggttacggttaggtttacggttttaacgggttccgggggtaaccggtacggggtaccgttccccgggttagggttcccgttacccccgg

SEQ ID NO: 247517 - DNA, 853 bp, Homo sapiens
  misc_feature: GYAE6OF01CUWPL.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagacggactcaccagtggaggttggggctgtaacgtttcgggtttttccttggttgtcgtttaggtttttaaggaagggttcgtccgaggtggtggtaggtcctaggtttgggttaggacggggttccggggggacggtcccgtcgggtacccgacggggtccgggttcggggggggtacccctggaacggtccttccgtccgttggcgccgaccgtcccgtaccggtacctttccccgttagtaaggttagttagttacggagttcggtacggttcgggcccgacacggtacccgtacgggaaggggacgggtcgtgggtacggttggggacgaacccaaagtaaagaaacggagtaaaggagtaacggtaaccgttccggtaacggtttaacgtttaacggcggttacctggtagggttacgggaaccggtttccctttaacaccgttactaccgtacgaaagacgaacctaaccgacaaagtacttacaacgttataacgtactaaaccaacgtacgaaactacgtaccgagtaacggacgtaccgaacgaacggaacgtaccgggtacgtttacgttaacgtaccgttggacggtacgtaacggtaagtaagggttaaaaacggaaaaaggttggttacgggtacgtttagggtttaggtttaccggggtacgggtaaccggggtacgggtacccggtacccggttccggtacccgttaccccgg

SEQ ID NO: 247518 - DNA, 754 bp, Homo sapiens
  misc_feature: GYAE6OF01A8BL6.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggaggttggggctgaacgttgggttttccttgttgtcttgtttagaaggtgtccagtgtgagtccagttggttggacggtccggggaggccgtggtccaggccgtcggggggtccctgacgtactcctctgtcgcgacgccgtccggtactttccccctactagttacgtttagttcggaatgtacgttcgggtcccgccgacgaccgtccggagggggaacggggtcgtaggggaggttcgggggtacggaaccctaaacgtaagtaaaagaccgaaagagtacgggaaacgttcggacccggttaggttttaacggtcggtacgttacgtggtacgggtaaccgggttcccgttttaccaccctaacgttccgaccgtaaggaaccgaacccgtaaacgacccgtaaagtaaccttacacgtagttactactaacgtaactacgaacgtacgccgagacggagtccgagacgaccgacgtccggttattacgttacgtggtacgacggtagtaagtaggtaaacgggtaaaaagtgtcggttacgttagggtttacggtttgggttacggggcccggtaagggttaccccgccggttgggtcccgttaccccgg

SEQ ID NO: 247519 - DNA, 732 bp, Homo sapiens
  misc_feature: GYAE6OF01EARGT.17.28.C06.1.454.CMB.1.raw
  modified_base (250)..(250): a, c, t, g, unknown or other
  misc_feature (250)..(250): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggttttctgttgctgtttagaggtgtccagtgtgagtcagttggttgaggtccggggagcctggtccagccgtgggggtccctgagctctcctgtncacgcctccggacttccccttacgagttagttattgggattgtaccgttggtcccgccagacctccggaggggaaggggccgtaggggaggtgggtacggacccaaagaagtaaagcaaagagtaggaactgaccggttaagttttacggcggtactcgtaggttacgaacgggttccctttacgaccgtactacccttaccgaagtaacgtaacccgaaaccggtaacccaaacggtaactttaacccctaacgttacggttacttaaacccttaaccaaacctaacgtaaacccgacgtacccttaggaacgaccggttccgaaccgaacggaacccggaaccggtcccggttagttacgtttaacgtggtacggaccgtaagtacgtaggtaaaggtaaaaagttagtaggtctttggttagggtttcggtacggggtaccggaacgggtaccgtcccggtacggttcccgtaacccgg

SEQ ID NO: 247520 - DNA, 977 bp, Homo sapiens
  misc_feature: GYAE6OF01CUHVK.17.28.C06.1.454.CMB.1.raw
tcagcgtagactagcacgaccggtgctcgatttagagctcacgtattggggtttgggggaggtctcagagaggaggcttagccctggactccaaggcctttccacttggtgatcagcactgagcacagaggactccaccagtgggaggttggggctagaacgttgggttttccttggttgtcgttgttttagaaggttgtaccgtaggtggtggtaggttccgtaggtttggttggacgggtccggggggaggccgtggtccaggtcccggttcggggggtcccttggacgtacctcctccgtgtcgcgacgtcccgtaccgtacctttccccttagtaggttagtttacggttggtacgtacggtaccggtttccgggtcccgaccgacggtacccgttaccgggaaggggggtaacgggggtcggtaggggtacgggttgggggtaccggaaccctaaaacgaaagtaaacggagtaaaggaaggtacggtaaccggttcggttaacccggtttaaggggtttttaaccggttagggggtaaccctttacgggtttacgggtaacggggtaacccgggtttaccccgttttaccgtacccgttaaccgttcctaaacccggaacgtaacccgtaaacccggaaacccgtaacccgtaacggtttaaacttaccgtaacggttactttaaacgttaacccgtaaaccgtaaaccgttacggaaacctaaccgggtactaccggggtaacgtaccggttaccggaaccgtaaaccgggaaccggtacccgggttaccgttacgttacgtttaccgggttagtaccgggacggtaaaggttaacggtaaacgggttaaaaggtaaaaacggttggtagggttacggttttgggtttaaccggttttagggggtaccggggtaacccggggtaacgggtccccggttacccggttcgggttaacccccggttaccccgg

SEQ ID NO: 247521 - DNA, 651 bp, Homo sapiens
  misc_feature: GYAE6OF01A7EL9.17.28.C06.1.454.CMB.1.raw
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (394)..(394): a, c, t, g, unknown or other
  misc_feature (394)..(394): n is a, c, g, or t
  modified_base (453)..(453): a, c, t, g, unknown or other
  misc_feature (453)..(453): n is a, c, g, or t
  modified_base (473)..(473): a, c, t, g, unknown or other
  misc_feature (473)..(473): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtcggggaggccgtggtccagccgtgggggtccctgagctctcctgtcgcngcctccggtacttcccctnagttagttattggatcgtacgttgggtccncgagacctccggaggggacggggcgtgggaggtggggtcgaccaaacgaagtaagcaaagagtggaactgccgtagtttcgnggtactgtgtaggtaacggtccgtttacactctctacgagaacgacaacgcaagtactnatgtactcaactactagacncgtactgaagtcgtcgacgacgacgtaccggcgttacgtacttacgtaggtacgacggagtaaggttacgggtaaaaggtaaaaaggttacgtaggggttacgtttagggttcggtttaagggttacggggtacccggtaggggtacccgtcccgggttggttcccccgtaaccccgg

SEQ ID NO: 247522 - DNA, 701 bp, Homo sapiens
  misc_feature: GYAE6OF01BRUV0.17.28.C06.1.454.CMB.1.raw
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
  modified_base (672)..(672): a, c, t, g, unknown or other
  misc_feature (672)..(672): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggtttctgtgcttgtttagagtgtcagtgtgagtcagttggtgagtcggggagcctggtcagccgtggggtcctgagactctctgtgcagcctcgacttccctnagtattatgatgacgttggccncgagaccgtaccgaaggggtaacggctaggaggtgggacgtaccaaacgtaagtaaacgcaaaggtgtaggaactggaccgttagttttacgnggtactcgtaggtacggaacgggttccctttacgaacctacgtcctaccgaaggacaaccgaaccgaccgtaaagtaccttaacacgttagtaactaaccgtaaacgtaactacggaaactacgtccgtaaggtaacgtacgtccgaacgaacgaccggtaacccgggtcgttaggtttaaaccgttcgtaggacggtacggaaagttaccggtaaaggttaaaaggaaaaaacgtttcgggaggttctttacgggtttaagttttaaggggacccggggaacgtaaccggggttaccncccggtttacgggtccccttaaccccggg

SEQ ID NO: 247523 - DNA, 842 bp, Homo sapiens
  misc_feature: GYAE6OF01BY69G.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagagactcaccatggaggttggggctgaacttgggttttccttgttgtcttgtttagaggtgtcagtgtccgaggtccaggttggttgaggtccgggggaggccgtggtccgagccggtggggggtccctgacgactctcctgtgcacgcctccggactttccccttacgtaggttacgtttagttggagtggtaacgtttcggggtcccgccgaacgacccgtaccgggaaggggggtaacgggggtcggttacggggaggggttcggggtacggaacccgaaaacgtaagttaaaacgaccgaaaaggtagtaacgggtaaaccgtcgggtaccggtttaagggtttttaacggtacgggtaccgttcgtaggttacgggtaaacgggttcccgttttaccgaacctacttcccgtaccgaagtaaacgaaccgaaaccggaccgaaaagtaacttacgaaccgttacgttaacttaccttaaaccgaacgttacgaaacgtaccgtcccgtaaggaacggtacgtccgaacgtaccggaacccgtaccggggtacccgttaggttaacttttaacgtggtacggtacggtaagtaagttaagggtaaaagggtaaaaacggttacggttgggtactttggggtttaacgttttaggggttaccggggtaccggtaacggggtaccgttcccgggttacggttcccggtaaccccg

SEQ ID NO: 247524 - DNA, 1052 bp, Homo sapiens
  misc_feature: GYAE6OF01A5BQH.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagagactcaccatggagttgggctgaacttgggttttccttgttgcttgttttagaaggtgtccagtgtgaggtccagttggttgaggtccggggagcctggtccagccgtcgggggtccctgacgctctccgtgtcgcacgcccgtccggtactttcccccttcgtagttagtttacgttggattcggtaaccgttcgggtcccgtccgtcgacccgttacccggaagggggtaacggggtccgtaggggtaacgggtttcgggggtacggaaccccgaaaacgtaaacgtaaaaacggaaccgtaaaaaggtaaggttaaccgggtaaaaccgttccggggttaaccccggttttaaagggtttttttaaacccgggtacgggggtttaacccgtttaccgggttttacggggttaaaccggggttaaaacccggggggttttacccccggtttttaaccccgtaaacccccgttaaaccgtttaccccgttaaccccgtaaaaggggaaaccccgttaaaacccggtaaacccgtaaacccccggttaaaaagttaaacccgtttttaccgaaacccgttttaaggttaaaccctttaacccctaaaaccgtaaacccgtttaaccggaaaaacccgttaccgtacccccggttaagggaaacggtaccgttaaccccgggccgaaacggtaacccccggttaacccggggtaccgttttaagttaacccgttttaccgtcgggttaacggacggtaacggtttaaggttaaacgggttaaaaaaggggtttaaaaaaccgtagggtttacggttaacggtttttcggggttttaaggttttaaccggggttaccggggggtacccgttaaacggggggttaccccgtaccccgggttaccgggttaccccggttaaccccccgg

SEQ ID NO: 247525 - DNA, 735 bp, Homo sapiens
  misc_feature: GYAE6OF01A9F3D.17.28.C06.1.454.CMB.1.raw
  modified_base (318)..(318): a, c, t, g, unknown or other
  misc_feature (318)..(318): n is a, c, g, or t
  modified_base (407)..(407): a, c, t, g, unknown or other
  misc_feature (407)..(407): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtccagttggttgaggtccgggggaggcctggtccagccgttggggggtccctgagactctcctgtgcacgcctccggtacttccccttcagttagttattggatgtacgttgggtcccnccagacctccggaggggacggggtcgtgggaggtgggtacggaccaaacagtaaagcaaagagtaggaactcggaccgtagttttacgnggtactgtaggtaggtacggtcccgtttacacctattcctaccgaagacgaaccgaaccgaccaaagtaactaccctagtagttactacctaaccaactagaaaccgcgtaccctaggaacgacggtaccgaccgaacggaacccggtaccggtccggttaagtttaacgttacgtggtaccggacggtaaggtaacgttaagggtaaaacgggtaaaaaagttcggttagggtaccggtttaaggttttagggtttacgggttacgggggtaacccggtaagggggtaacccggttccccggtttaggggtcccccgttaccccggg

SEQ ID NO: 247526 - DNA, 832 bp, Homo sapiens
  misc_feature: GYAE6OF01DPE51.17.28.C06.1.454.CMB.1.raw
  modified_base (322)..(322): a, c, t, g, unknown or other
  misc_feature (322)..(322): n is a, c, g, or t
tcagcgtagactagcacgaccggtgctcgatttagagctcacgtattgggtttggggaggtctcagagaggaggcttagccctggactccaaggcctttccacttggtgatcagcactgagcacagagactcaccatggagttggggctgaacttgggttttccttgttgtcttgtttagaaggtgtcagtgtgaggtcaggttggtgaggtccggggagcgtggtccagccggtgggggtccctgagacctctcctgtgcacgccgtccggtacttccccttactaggttagtttagttggattcgtacgttcgggtcccnccagaccgtaccggaaggggaaggggtcgtagggtaggtggggtacggaccaaacgtaagtaaaacgacgtaaagaagtacggtaacgtcggtaccggtttaacggtttttacggtacggtaccgttcgttaggttaacgggtaaccgggttcccgttttacccgaacccttacgttaccccgttaaccggaacggaacgaaacccgtaaacccgacccgtaaaagttaaccttactaaccgtttagttaacttaaccgtaacctaacgtacgaaaccacgtaccgtaggaacgtacgtccgacgaacgtaaccggacccggttacgttagttaaacgtttcgttacggtcggtaacggtaacgttaaggtaaacgggttaaaagggtaaaaaagtttacggtaagggtttcggtttaacggggttttacgggttttaacgggttacgggggtaacccgggttaacgggggtcccgtttaccccgggttcccggttaccgttaaccccgg

SEQ ID NO: 247527 - DNA, 691 bp, Homo sapiens
  misc_feature: GYAE6OF01BPMKN.17.28.C06.1.454.CMB.1.raw
  modified_base (404)..(404): a, c, t, g, unknown or other
  misc_feature (404)..(404): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccaggttggttgagtccgggggaggcctggtccaggccgtggggggtccctgagactctcctgtgcagcctccggtacttccccttacagttacgttattggatggtacgttcgggtccgccagactccggagggggaaggggcgtggaggtgggtacgccaaacataaaagcaaagatagggaactcggtaccgtagttttacgnggacttgtggtacggaacggggtcccgtttacgacctattccctaccgagacgtaaccaaccgaccaaagtaacttcaacgttgtaacttactaaccaactacgaaacacgtacctaggacgtacgtccgacgaacgtaccgaccgggccgttagttacttacgtggtacgacgtaagtacgtagggtaaaaggttaaaaaggtcgttagggttacgttggtttaggttttacgggttacgggggaccgtaacggggtaccgtcccgttgggtcccgttaccccggg

SEQ ID NO: 247528 - DNA, 686 bp, Homo sapiens
  misc_feature: GYAE6OF01EHDSP.17.28.C06.1.454.CMB.1.raw
  modified_base (188)..(188): a, c, t, g, unknown or other
  misc_feature (188)..(188): n is a, c, g, or t
  modified_base (219)..(219): a, c, t, g, unknown or other
  misc_feature (219)..(219): n is a, c, g, or t
  modified_base (669)..(669): a, c, t, g, unknown or other
  misc_feature (669)..(669): n is a, c, g, or t
tcagcgtagactagcacgaccggtgctcgatttagagctcacgtattggggtttgggggaggattcaggacaatctccagcatggccggcttccctctcctcctcaccctcctcactcactgtgcagggtcctgggcccagtctgtgctgactcagccaccctcagtcgtcgtcggggacccccgggnagagggtcacatatcttgttcgtaggaaacngccgtccggcattctactaaacttaaacttatttttcgctaggtaccagactaacttcccgaaggaccgtcccggacccccgtactcctactactactaagtaagaaatgactacgacgtcccgggtccccgttccggggtaccctcggtaccctattccgtcgtacggccttacgtagttcgtacgtcggtaccaacccttcgccgtacccctaccgtcgaacctacgtcgaggtccggggtcctaccgggtacggaaggtactagggacggtcttagtaatttacgtacgtgtccgacgtcgggtaggactacgaactacgtacgtaggtacggttccggggttcggtaggttccggggacggaaccggtacgacggtcgtaccggtacctacgtaacgacgaccgaccgtagcccgtcccgtccgtccgtctcctcgtcccgtcccncctccgtacttcgctcg

SEQ ID NO: 247529 - DNA, 684 bp, Homo sapiens
  misc_feature: GYAE6OF01BEK95.17.28.C06.1.454.CMB.1.raw
  modified_base (183)..(183): a, c, t, g, unknown or other
  misc_feature (183)..(183): n is a, c, g, or t
  modified_base (263)..(263): a, c, t, g, unknown or other
  misc_feature (263)..(263): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttgggctgaactggttttcctgttgcttgtttagaaggtntccagtgtgagtcagttggttgaggtcggggagcctggtccagccgtgggggtccctgagtctctcctgtgcacgttccnccggtacttccccttcaagttagttagttggtattcgtacgttcgggtccccgcgacgtaccgtaccggaaggggacggggtcgtaggggaggtggggtacggaccaaaccgaaagtaaacgacaaggtacgtacgggaactcggtaccgttagttttacggtcgtactcgtggtaggtaacggtccttaccactagtcctaccgtagaactaacaacgactaaagtactacacttagtactacctaacaactacgaacacgtacctaggaatacggaccacgaacgtaccgaccggtccgttaatacgttccgacgtacgacggtaagtacgttagggaaaacgtaaaaggttagtcgggtacttaggtttacgttaagggtcgggacggtacgggaccgtcgtacggttccctacccgg

SEQ ID NO: 247530 - DNA, 746 bp, Homo sapiens
  misc_feature: GYAE6OF01EF1FV.17.28.C06.1.454.CMB.1.raw
  modified_base (685)..(685): a, c, t, g, unknown or other
  misc_feature (685)..(685): n is a, c, g, or t
  modified_base (716)..(716): a, c, t, g, unknown or other
  misc_feature (716)..(716): n is a, c, g, or t
tcagcgtagactagcacgaccggtgctcgatttagagctcacgtattgggtttggggaggtctcagagaggaggcttagccctggactccaaggtcctttcctacttggtgatcagcactgagcacagaggactcaccatggagttgggctgtaacgttgggttttccttgttgtcttgttttagaaggtgtcctagtgtgaggtcgagttggttgaggtccgggggaggtccgtggtccgagtccggtcgggggtccctgtacgtactccgtccgtgtcgctaccgcctccggtactttccccttacgtagttcgttattggattgtacggttccggtaccgtcaacgtacgtcggaggggacgggtgtggtagggtgggtacgaccgtaacgaaacgtaaaagacgaaagtagtaccggtaactacggtaccggttaaggttttacgggtagaacccgttgtcggtaacggaacgggttcccgttaccgcctagtacccgttaccggaagtaaccgaacccgtaaaccgtacccgtaaagtaactttaccgtaacttcgtaacttacccgtaaactaacgttcgaaacctaccggcctagggtaacgcgtacggtcaacggacgtacggtcgtattacgtttacgagttggacaggtacgtaaggtaagtaaaaggagttcgnggttttaatgggtttaacgtgggggtaaccngggaaccgtttccccggtaggcccttcccg

SEQ ID NO: 247531 - DNA, 742 bp, Homo sapiens
  misc_feature: GYAE6OF01DRFU5.17.28.C06.1.454.CMB.1.raw
  modified_base (186)..(186): a, c, t, g, unknown or other
  misc_feature (186)..(186): n is a, c, g, or t
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgccacctnagtcgtcgtcgggacccccggnaggaggtcaccatatcttgtctagaacagcgtccgntactctacaactaaactnttttcgctacggtaccagactaacttcccgaggtaccgtccccggcccccgtacttccctctacttactaataaggaaacttgactacgtacgtcccgggtccccgtaccgggggtccctacggacccgttatttccgtccgttcggcccttaaccgtcgttacggttcgtacgggcctacccgtactccgtaccctaccccgtacgacccgtacgtcggtacggttcggggaccccgttacccgggtaccggtaggtaacgttcggaacgggttcttaacggttaactttacgtttacgttcggtcgtaaccgtacgggtaggtacgttaccggtaactacgttacgtacggttaacggtttccgggttaccggttcgggttaccgggcgggaaccgggaccgttagggcccgttacggcccgttaaccggtacgtaccgaaccgtacccggacggtcccgtcccgtccccggtacccg

SEQ ID NO: 247532 - DNA, 888 bp, Homo sapiens
  misc_feature: GYAE6OF01BEBXY.17.28.C06.1.454.CMB.1.raw
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtcgagtgtgaggtcagttggttgaggtcggggagcgtgtcacgccggtgggggtccctgacgtctctccgtgtcgcncgtccgtccggtaccttccccgttntacgttagttacgttggatcgtacggttccgggtccgaccgacggtaccgtccggaagggggaacgggtcggtaggggtaggtcggggtacggtaccgaaaacgtaagtaaaacggacgtaaaggtagtagggtaaacctcgggtaacccggtttagttttacggggtcggtaacttcggtaacggtagggtaaacgggttccccgttttacaccgtaacgtccctaccgggaacgtaacgaaccgtaaccgtaaaccggaaaacgttacttaacgttaacttacggttattaaccctaacctaacgttaaccgaacgtaccgtacccggttaggaacggtacggtaacccgaccgtaaacggtacccggtacccgggttaccgggtttacggtttaaaccgtttcggttacccgggtggaaaccgggttagggtaaacgttaaagggttaaaagggttaaaaaaacggttcggttaaccgggtttagggtttagggttttaacggggttttaaacggggttcccgggggggttaaacccggttaaccggggttaccggggtaccccccggtttacggggtccccgttaaccccccgggg

SEQ ID NO: 247533 - DNA, 832 bp, Homo sapiens
  misc_feature: GYAE6OF01A7D70.17.28.C06.1.454.CMB.1.raw
  modified_base (263)..(263): a, c, t, g, unknown or other
  misc_feature (263)..(263): n is a, c, g, or t
tcagcgtagactagcacgaccggtgctcgatttagagctcacgtattggggtttggggagcttcagctgtggtagagaagacaggattcaggacaatctccagcatggccgcttcctctcctcctcaccctcctcactcactgtgcgagggtcctgggccctagtctgtgctgactcacgcccaccctcgagtcgtaccggtccggggacccccgggcgaggacgggtccaccgtattacttcgtttgttcgtacggaaacgngtccgtaccggctactctaacaaacttaaacttagttttcgcttcggtaccagtactaacttccggagtacccgtccccggaccccccgtacttcccactactactaaacgtaagtaaattcgaactaccgacgttccccgggaccccggttccggggtccctcggtaaccgtactttccgtccggtcggaccttctacgtcgtcgtcggaccctcctccaccgtccctccgtacctacctcgtacgtacgggtccgggtacccgttccccgggtacgacgggtataacggggcgtttaccgttacggtttaagttttaacccgttttcggtcgggttaaccggaccccgggtttagggttaacggggttaccgtaacgaacccggttaccgtacggtttacgggtaacccggggtttcgggttaccgggggttcgggacccggggggtaccggggacgggttaacccgcggggttacccggttaacccggtccgttaaacccggtacggaccggttaacccgggacccgtaacgggtccccccgtcccgggtaccccggttaccccgg

SEQ ID NO: 247534 - DNA, 846 bp, Homo sapiens
  misc_feature: GYAE6OF01CBFU6.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaacttgggttttccttgttgcttgtttagaggtgtcagtgtgagtcctagttggttggaggtccggggaggcctggtccaggtccggtcgggggtccctgacgtactctccgtgtgccacgtcccgtccggtacctttcccccgtagtagttacgtttagttaggacgttcggtacggttttccgggtacccgtacccgtaaggtacccgttaccccgggaagggggggtaaaccggggtcggttacgggtaaggggtttcgggggtacccggaacccgtaaaaacgttaacgttaaaaaccggcgaaaacgggtacgttaacgggtaaccgttaccggggtaacccggtttttaagggtttttaaccggttacgggtaaccgtttcggttaggttaaccggggtaaacggtttcccccgtttacccggaaccttaacgttacccgtaccgaaacgtaaccgtaaccgaaaccgaacgtaaacgtaacgttcaacgttacgtaactaccgtaactaactaagtaaccagtaccgtgaacggtacgacgacaacggacgaccggttccgtagtttaactacgtgtcggacgttaagacgttaaggtaaaggtaaaagtcggttaggttacggttgtttacgggttaggtaccggtacgggtacgggtaccgttaccggtccggtaccgttaccccgg

SEQ ID NO: 247535 - DNA, 166 bp, Homo sapiens
  misc_feature: GYAE6OF01DQG45.17.28.C06.1.454.CMB.1.raw
  modified_base (119)..(119): a, c, t, g, unknown or other
  misc_feature (119)..(119): n is a, c, g, or t
  modified_base (136)..(136): a, c, t, g, unknown or other
  misc_feature (136)..(136): n is a, c, g, or t
  modified_base (142)..(166): a, c, t, g, unknown or other
  misc_feature (142)..(166): n is a, c, g, or t
tcagcgtagactagcacgaccggtgctcgatttagagctcacgtattgggtttggggagcttcagctgtggtagagaagcaggattcaggacaatctccagcatggccgctttcccctntcctcctcaccctcctnactcannnnnnnnnnnnnnnnnnnnnnnnn

SEQ ID NO: 247536 - DNA, 849 bp, Homo sapiens
  misc_feature: GYAE6OF01E3FUM.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgtaacgttgggttttccttgttgtcttgttttaggaaggtgtccagtgtggaggtccgtaggttggttggacgggtccgggggaggccgtcggtccgacggcccgggttcggggggtccctaggacgtacctcctccgtgtcgaccgtacgtccccgtaccggtaccttccccgttacgtaaggtttagtttaaggttcggtacgttacggtaccggtttccggggtccccgtaccgtaacggtacccggtaacccggggaaggggggtaaaccgggtcggtacgggggtacgggttcgggggtaaccggtaacccaaaaacgttaaaaggtaaacggaacgaaaaggtacggtaacgggaacgttcggtaaccggtttaacggttttacgggaccggttacgttcggtacggtaacgggtaaccgggttccgtttaaccgaacccttacgttcccgaacggaagtaaccgaaccgaaacccgtaacgtaaacgtaacttaccgtagttaacgtacgtaactaaccgtaacgtaacggtaacctcggtacctaggacggtacgtcgacgaacgaccgtacggtcgttaagttacttggtcggagagtaagtagtaaagggtaaaaagtaagttcgtcggttggtttggttacgttcgggacgggtaacggccgggacctccggttaggtccctacccgg

SEQ ID NO: 247537 - DNA, 837 bp, Homo sapiens
  misc_feature: GYAE6OF01ERVY3.17.28.C06.1.454.CMB.1.raw
  modified_base (346)..(346): a, c, t, g, unknown or other
  misc_feature (346)..(346): n is a, c, g, or t
  modified_base (389)..(389): a, c, t, g, unknown or other
  misc_feature (389)..(389): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatgggagttgggctgaacttggttttcctgttgcttgttttagaaggtgtcctagtgtggaggtccagttggttgaggtccgggggaggccgtggtccgaggccggttggggggtccctggacgaccttcgtcctggtcgcgacggtccctccggtacttcccccttgtaagttagtttagttaggatcggtaccgtttcggggtcccnccgacggtacctaccgggaagggggtaacggggtcgtaggggnggttcggggtacggacccgaaataagtaaaacggccaaaggtagtacgggtaaactcggtaccggttaagggtttttaacggcggtaaccttcggttagggttacggaacggggttcccgttttaccgaacctacgttccctacccgaagtaaccgaaccgtaaacccggtaaccgtaaacgggtaactttacccgtaacgtttacggttaacttaaccgtaaaccgtaaacctttaagggtaaacgttaacggtcccgtaaggtaaccgtacggtaccgacgtaacggtaccgaccgggtaccgttagttaacgtttcgtaggtacgaggtaacgtaggttacggtaaaggtaaaaaggttagtacgggttaacgttggtttaagggtttacgggacggggtaaccgggttagggtaccggtcccggttcggtacccgttaccccgg

SEQ ID NO: 247538 - DNA, 737 bp, Homo sapiens
  misc_feature: GYAE6OF01DE2A5.17.28.C06.1.454.CMB.1.raw
  modified_base (528)..(528): a, c, t, g, unknown or other
  misc_feature (528)..(528): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaacttgggttttccttgttgctgttttagaaggtgtccagtgtgaggtcctaggttggttggaggtccgggggaggccgtggtccagccgtcggggggtccctgacgactctcctgtgcacgcctccggactttccccttagtagtagttagttggtatgtacgtttcgggtccgaccagacctccggaaggggaacggggtcgtgggtaggtcggggacgaccaacgaagtaaagacgaagagtacggaactcggtaccggttaaggttttacgtcggtacttcgtagggttacggaaccgggtttcccgtttccaacccagtttcccgtaccgaagaacgaaccaacgacccctaaagtaacttaccgaacttntaacttactaaccaaactaggaaaccacgtaccgtaggaaccgtagtccgtacgaaaccggtaccgtaccgggtacccgttagtttaacttacgttaggtgaacggtaagtagttaaagggtaaaggtaaaaagtaggtgggtactttggtttaggtttaacggtcggggaccggtagggtaccgtccccggtgggttccctaccccgg

SEQ ID NO: 247539 - DNA, 772 bp, Homo sapiens
  misc_feature: GYAE6OF01CYCOH.17.28.C06.1.454.CMB.1.raw
  modified_base (125)..(125): a, c, t, g, unknown or other
  misc_feature (125)..(125): n is a, c, g, or t
tcagcgtagactagcacgaccggtgctcgatttagagctcacgtattgggtttggggaggtctcagagaggaggcttagccctggactccaaggcctttccacttggtgatcagcactgagcacngaggactcaccagtggagttggggctgtaacttggttttccgttgttgtcttgtttagagtgtccagtgtgagtcagttggttgaggtcgggaggcctggccagtccggtcggggtcctagagcctcgtctgtcgcgacgtccgtaccggttaccttcccgtacgtacgtagttaagttaggtacgtcggtaccgttcgggtaccgacgtaacggaccgtacgggaaggggaacgggtcggtagggtacggtcgggtaccggaacctaaacgaaacgtaaaggtacgaaggtaacggtaaggtaccgtacgtaccggtttaggtttaccggtacgtaccgttcgttacggtacggggtaaccggttaccgttaccgaaccttaccgtaccgttacgaacggtaacaaccgaaccgtacctaacgttaacttacgtacgttataccttaaccgtaactaaccgtaacgtaacgaccgtacgaagtacgttaacggcgacgacggtaacccggtaaccggtccgtaaagttccttaaggttacgtaggtacgtaacgtaggtaaaggtaaacggtaaaaggtggtacgttaggttcggtttaggttacggttacggtacggaacgggtcgtaccggtcgtccgtacccg

SEQ ID NO: 247540 - DNA, 701 bp, Homo sapiens
  misc_feature: GYAE6OF01B5N65.17.28.C06.1.454.CMB.1.raw
  modified_base (409)..(409): a, c, t, g, unknown or other
  misc_feature (409)..(409): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggttttccttgttgctgttttagaaggtgtccagtgtgagtcagttggttgagtccggggagcctggtccagccgtgggggtccctgagcctctcctgtgcagtcctccggactttcccccttgagttagtttattggtatcgtacgttcgggtcccgccgagacctccgaaggggtaaggggctgggaggtgggtcggaccaaacgtaagtaaaagacgaaagagtaggaacctggaccgttaaggttttacgnggtactcgttggtaggtaacgggtcccgttttacgaacctagtccctaccgaagtaacgaaccaacccgacctaaaagtaacttaccacttagttaactccgttaaacaaccgttacgaaaccgagcccgtagaacgtaccggtacgacgaacgaccgaccggtccgttaagttacttacgtcggtgccgtaagtagtacgtaaagggtaaaaagtgttaggtacggtttggttggtttaacggttcggggaaccggttacgggaccgttccccgttggtcccgtaaccccg

SEQ ID NO: 247541 - DNA, 883 bp, Homo sapiens
  misc_feature: GYAE6OF01AK0O6.17.28.C06.1.454.CMB.1.raw
  modified_base (320)..(320): a, c, t, g, unknown or other
  misc_feature (320)..(320): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagtggggctgaacttgggttttcttgttgctgttttagagtgtccagtgtgagtctagttggttgacggtccggggagccgtggtccagccgtgggggtccctgacgtctcgtccgtgtgcgacgtcctccggtacttccccgttcgagttagttactggtactagacgtttcgggcccncgacgtacgtccggaagggggaagggtccgtagggaggtcggggtacggaccctaaagtaagttaaaacgccgaaaggtacgtagggtaaacttccgggaacggttacggttttaacggtacggtcgtaccgtttagggaggtaaccggttcccggtttaccaaccgtaaccggtttcgaacccgaacggtaacgtaaccccgaccgggtaactaacggttactttacccgaaacgtttcgggtaactttaaccgaacccgtaagttaaccgggaacttacccggtacgttaggaaccggttacgtacccggcgtaaaaccgggaccggttaaccccgggtcggttttaaaggttaacccgtttacggtacggtcggggtaaaaccgttaggtaaacggttaaaccgggggtttaaaaagggtaaaaaggtttacccggtacgggggtttttcccttaaggggggtttttaacccggggtttaaaaccgggtcgggggggtcccgtaaaaaccggggggccttttaaaacccccgggggtcttaacccccgggggtttaaccc

SEQ ID NO: 247542 - DNA, 808 bp, Homo sapiens
  misc_feature: GYAE6OF01EART7.17.28.C06.1.454.CMB.1.raw
  modified_base (336)..(336): a, c, t, g, unknown or other
  misc_feature (336)..(336): n is a, c, g, or t
tcagcgtagactagcacgaccggtgctcgatttagagctcacgtattgggtttggggaggtctcagagaggaggcttagccctggactccaaggcctttccacttggtgatcagcactgagcacagagactcaccagtggagttgggctgaacgttggttttcctgttgcttaggtttagaaggtgtcgtagtgtgacggtcctaggttggtaggacgggtccgggggagccgtcggtaccacggtccggtcgggggtccctgacgtctcctcgtgcgacacgtccgtccgtaccttccctacgagtttagttgtggactcgtacgttcggtaccnctacgtacgtaccggaggggacgggtcgtagggtggtcgggacgaacccaaagtaacgtaaaggacaaaggtacgtaggaccttacggtaccggtttaaggtttacggacgtactcggtaggtaacgggacggttccttaccgaacttctacccgtacgaacggtaacgaaccgtaaccggaacctaaagtacctttacgaaccgtttacgtacttaaccgtactaaccgtaacggtaaccgtacggtaccgtacggtaacgtaccggtacgaaccgtaaacgggtacccggaccggttaccgttaggttaacttccggtacggtacgacggtaacggtaaggttaaacgggtaaaaacgggtttaaaggttaaacggtcgggtttaacgttcgggttttaaagggtttaccgggtacggggtacggtaaccgggtacccgtaacccggtttcgggtaccccgttaacccgg

SEQ ID NO: 247543 - DNA, 756 bp, Homo sapiens
  misc_feature: GYAE6OF01AD66A.17.28.C06.1.454.CMB.1.raw
tcagcgtagactagcacgaccggtgctcgatttagagctcacgtattgggtttggggagcttcagctgtggtagagaagacaggattcaggacaatctccagcatggccggcttccctctcctcctccaccctcctcactcactgtgcagggtcctgggcccagtctgtgctgactcagcccaccctcagtcgtccgtcggggacccccgggcaggacgggtcaccatacttcttgttcgtaggaaacagcctccggcatctacaaactaaactatttttcgcgtggtaccagacaacttacccacggaccgtccccggaccccccgtacctcctcactcctaagtaacgaaatgtactctacgtcccggtccccgtccggggtccctcgtaccgtactttcctcgtcgcctctactcgtcgtcgcctacctcctacgtccccttaccgtacgacctacgtccgtacgggtccgggttccttcccggtacggtacccgggaacgggtacggttacggaccgggttcgttagttaacgttttaacgtttccggttaggttcccgggtaccgttaccggggtaggttaccgttacggaaccgttccgttaccgttacggtacggttaccggggttcccgggttcggttacccgggggaccggggtaaccgggccgttacgggccggttaccggaaccccgtttaccgtaacggtacccgacccgtaacccggccggtccccgtccccgggtacccccg

SEQ ID NO: 247544 - DNA, 766 bp, Homo sapiens
  misc_feature: GYAE6OF01EW75J.17.28.C06.1.454.CMB.1.raw
  modified_base (254)..(254): a, c, t, g, unknown or other
  misc_feature (254)..(254): n is a, c, g, or t
  modified_base (307)..(307): a, c, t, g, unknown or other
  misc_feature (307)..(307): n is a, c, g, or t
  modified_base (629)..(629): a, c, t, g, unknown or other
  misc_feature (629)..(629): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggttttccttgttgtcttgttttagaggtgtcagtgtgagtcagttggtgaggtccggggagccgtggccagccgtgggggtcctgacgctctctgtcncacgcctccgtacttccctacagttagttattggattcgacgttcgggtcccncgaagccgtacggagggggacggggtcgtgggaggttcggggcggaccaaaacgtaagtaaagacgaaaggtagtaacggaacgtcgtaccggttaagttttaccggaggtacttcgtaggtacgggtaacggttcccgtttacgactactcctaccgaggaacgaccaacggaacctaaagtaacgttcgtaaacgttaggtaacttaccgtaaaacgtaaccgtaacgaaaaccgtccgtaccgtaaggtaacggccggtaccggagaaccgggaacccgtaccgggtaccgttaagttaaccgtttcgttaccgggtanaccggtaagttaacggttaaagggtaaaacgggttaaaaaagtccggttaggtaccgtttaagggtttagtttacggggttaccgggggtaaccgtacgggggtacctcccggggtttaccggtcccgttaccccgg

SEQ ID NO: 247545 - DNA, 811 bp, Homo sapiens
  misc_feature: GYAE6OF01EB02Y.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccagtggtagttggggctagtaacttgggttttccttgttgtcttgtttagaggtgtcagtgtgagtcgtagttggtgaggtccggggaggcgtggtccaggccgtcgggggtcctggacgtacctctcctgtcgacgtacgtcccgtccggtacctttccccttacaggttagtttagttgtagttacgtacggttcgggtacccgtacgtacggtaccgtaccgggaaggggggacggtccggttaggggcgggttaggggtccggaaccctaaaagtaacgtaaaaggaccgtaaaggtacgtacgggtaactaccgggtaacggtttaacggttttacgggtacggtacgtttacgtacgggttaccgggacgggttacccgtttacccgaaccgttatccccgtaacggacgtaaaccggtaacccgtaaaccgaaccgtaaacgttaacttacgttaaagttcggttaacttaccgtaaactacgtaaccgtaacgcctacggtgtaacgcggtaccgagaaccgtacccggacgttacgttgtaacgttcgtagacggtaggtaagtaacggttaggtaaaaacggtaaacgttggtaaggtcggtttaggttacccgggtttagggacccgggttaggacgggtccctaccgggttcgaggttaccccg

SEQ ID NO: 247546 - DNA, 906 bp, Homo sapiens
  misc_feature: GYAE6OF01AMX8K.17.28.C06.1.454.CMB.1.raw
  modified_base (385)..(385): a, c, t, g, unknown or other
  misc_feature (385)..(385): n is a, c, g, or t
  modified_base (773)..(773): a, c, t, g, unknown or other
  misc_feature (773)..(773): n is a, c, g, or t
  modified_base (798)..(798): a, c, t, g, unknown or other
  misc_feature (798)..(798): n is a, c, g, or t
tcagcgtagactagcacgaccggtgctcgatttagagctcacgtattgggtttgggggaggtctcagagaggaggcttagccctggactccaaggcctttccacttggtgatcagcactgagcacaggaggactcaccagtcgggtaggttcggggctgtaacgttggggttttccttggttgtcgttgttttaaggaaggttcgtaccgtaggttaggtcggtacggttccgtaggtttgggttcgggtaacgggttccggggggacggtccgtcgggtccgacggtccgggttcggggggtaccctggacgtacgtcctcgtgtcgtaccgagtcccgtaccggttaccttaccccgttgtaacggtttacgtttgttacggngttacggttaccggttccggggcccgtacccggaacggtaccgtcccggggtaaggggggtaaccgggtcggtacgggggtaacgggttccggggtaacggaacccgtaaaacggtaaacgtaaaacggacgtaaacgggtacttaacgggaaccgttcgggttaaccggtttacggttttaaccgggacgggttacccgttaggttaccgggtaaggtaaccggggttacccctttaccgaacgttacctacccgtaccggtaagaaccggtaaacgaaccggtaccctaaaggttaaccttaccgtaacgttagttaacctaaccgtaactaacgtaaccgaacgtaaccgtccggtaagacgtacggcaacccgtaggaccccgnggttaaccgtattcgttaacgtacncgggaacgtggtaagtaggtaaacggtaaatacgggtcttaggttacggttaggttccggggttacggacggggtacggtacccgtacggttcccggcgttaccccgg

SEQ ID NO: 247547 - DNA, 943 bp, Homo sapiens
  misc_feature: GYAE6OF01BLPHI.17.28.C06.1.454.CMB.1.raw
tcagcgtagactagcacgaccggtgctcgatttagagctcacgtattgggtttgggggaggtctcagagaggaggcttagccctggactccaaggtcctttccacttggtgatcagcactgagcacaggaggactcaccagtggaggttggggctaggtaacttggggttttccttggttgtctttgtttagaaggtgtccgaggtgtggacgttccgtaggtttggttggacgggtccggggggaggtccgtcggtaccgtacgtccgggttcggggggtccctaggacgtcttcctcgtggtcgacgtaccgtccgtaccggttacctttcccccgttacgtaaggtttacggtttagttagggtaccgttcggttacggttcccggggtacccgtaccgacggtaccgtacccgggaaggggggtacggggtccggtaggggtcggtacggggtcggtaaaccaaaacgtaacgtaaaacggaccgaaaggtacgttaacgggtaacctcggggtaaccgtttaggtttaccgggacggttacctcggtttaggtacgggttaaccgggttcctttacccgacttaaacgttccgtaaccggaaggaaccgtaaccgtaaccggtaaaccgaaacggttaaccttaccgtaaacgttaccgtttaaacgtaacccttaaacggtaacctacgtaaaccgaagttaccgagggtaacggtacgtaacccgggtacgaaaccgggaccggttaaccgggtacccggttagtttaaccgtttaacggtcggtttaggaacgggttaacggtaacggtttaaagtaaaaggggttaaaaacggtcgggttaaggttaccgggttagggtttaacggtttaggggttacggggtaaccggggtacggggtaccgttaccccggttccgggttcccggtaaccccg

SEQ ID NO: 247548 - DNA, 792 bp, Homo sapiens
  misc_feature: GYAE6OF01C66YF.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagagactcaccagtggagttgggctgacgttgggttttccttgttgcttgttttagagtgtcagtgtgacgtctaggttggttgacggtccggggagcctggtccgagtccggtcggggtaccctgacgacgtctcctgtcgcgtacgtcccgttccggtacctttccccgttacgtaggtttaagtttagttacggtaacttggtaacggtttcgggtacccaccgtaacggtaccgtaccggaaggggtaacgggtcgtgggtagggttgggtacggaccctaaacgaagttaaaacgacgtaagtaacgtacggtaacgtaccggtacggtttaacggttttacggtcggtaccttacggtcggttaacgggtaaaccggtcccttttaacccgaccgtaacgtttcccgtaaccgtaacggaaccgtaaccgtaaacccgaccgttaaaacgtaacgtttacgtacgtttagtaacttaaccgtaacctaacgtacgaacgtcgacgtagaacggtagtacccgacgacgaccgtaccggtcgttagttacgttacgtggttacgcggtaagtagtacggtaaaggttaaaacgtgtggtcgtttaggttaggtttacggttacgggacggttagggtaccctccggttaccggtcttacccgg

SEQ ID NO: 247549 - DNA, 1058 bp, Homo sapiens
  misc_feature: GYAE6OF01ESZB0.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagagactcaccatggagttggggctgaacgttgggttttccttgttgtcttgtttagaggtgtcagtgtgaggtcctaggttggttggagggtccgggggagtccgtcggtccacggccggttcggggggtccctggacgtacctccttccgtgtcggcaccgtcccgttccggtacctttcccccttacgtaagttagtttagttggtatcggtacgttcgggtcccgacgacgtaccgtaccggagggggaacggggtcgtaggggtacggggttcggggtacggaacccgtaaaacgtaaacgtaaaacggaccgaaaaggtaacggttaacgggaaccgttaccgggtacccggttttaacggtttttaacgggacgggttaaccgttacggttgggttaaaccggggttaaccgggggttaccccttttaacccgaacccttaaccgttcccgttaaccccgaaagggaacccgtaaaccgaaacccggttaaacccgaaaacggtttaaccctttaacccggtaaacgtttttaacgttaaacccgtttaacccgtaaaacccgttaacccgggttaaacgtaaaacccggttaccggtacccggtttaagggaaacggtaacccgggttccccgaaaaccggtaaccggaacccccgggttaaccccggggttaacgttttttaacccgttttaaacggtttaccggttacggggttacccggaaaccgggttaaagttaaaccgggttttaaagggggaaaaaaagggttttaaaaaacgttaccggggtttacgggtttacggtttttacggggggtttttaaacgtttttaccgggggggaaccccgggggtaaccccgggttaagggggggttacccccttaacccccggggttttaacgggtcccccctttaaacccccggg

SEQ ID NO: 247550 - DNA, 973 bp, Homo sapiens
  misc_feature: GYAE6OF01AOALK.17.28.C06.1.454.CMB.1.raw
  modified_base (286)..(286): a, c, t, g, unknown or other
  misc_feature (286)..(286): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtccggggagcctggtccagccgtgggggtccctgagacctctccgtgtgcacgcctccggactttccccttnagttagttagttggtatagtacgttgggtcctccgagtacctaccggaggggaagggtcgtaggaggtgggtacggaccaaacgaataaagacgaaagtagtacggaaacttcggtaacccggttaaggttttaacggtacggtaacctttacgtagggttaacgggtaaaccggggtccccgtttttacccgaacccgtaaccgttacccgtacccgtaaaggtaaaccggaacccgtaaacccggtaaacccgtaaaaacggttaaaccgttttacccaaaacccgtttacggttaaaccgttaacccttaaaacccgaaaccggttaaccggaaaacccgtaccggtaccccgtaaagggtaaacgggtaaccggtaccccgggtaaccgaaccggaaaccccgggtacccggggttaacccggttaacgggttttaacctttaaccgggttaacgggttcgggtaaacccggtaaagggttaacccggttaaagggttaaaaaggggttaaaaaaacccgtttaagggttacgggggtttaaaccggtttcggggttttttaaacgggttttttaaccgggggttaaacccgggggggtacccccggtttaaaagggggggtaaaccccccggtttccccccggggtttagggggttaaaccccccggtttaaaccccccggg

SEQ ID NO: 247551 - DNA, 630 bp, Homo sapiens
  misc_feature: GYAE6OF01B5NUP.17.28.C06.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (401)..(401): a, c, t, g, unknown or other
  misc_feature (401)..(401): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagagggtcaccatatcttgttctggaaacngctccggcatctacaactaaacgtntttttgctggtaccagctaattcccaggactccggcccccgactcctcatcctatagaaatgatcacgtcggcccgtccggggtccctgaccgtattctctcggctccatcgtctggccacctcacgccctcctcgaccngtcaggtcgggaccttccgggtaccgaggtactggaggtccttagtaatttacgtttactggtcgtccgtaccggtgggattcgacctagttccgtagtaagttccggggttccggtcgggtttcgggccggggtaacgggtaccgacggggtcttacgggtacccggttaccgttaaacggtccgaaccgtccccgaaagggtccctcccggtaccccccgttccggg

SEQ ID NO: 247552 - DNA, 806 bp, Homo sapiens
  misc_feature: GYAE6OF01BTB2M.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccagtggaggttggggctaggaacgttggggtttttccttggttgtcgtttaggtttttaaggaaggttgtccgagttggtggtaggtccgtagtttgggttcggacgggtccggggggaggccgtggccgaggccggttcggggggtcccctggacgtaccttcgtccgtggtcgccgacgtcccgtccggttaccttcccccttgtaacggtttagtttaattgggtatcggtacgttcgggtcccgaccgaggtaccgtaccggaaagggggacgggtcgtaggtacggtgggtacggaaccaaactaaagtaaagacgaaagtacggtaacggactacggtaccgtttaagtttacggtagtacgtcgtaggtacggacggttcctttacactactcgtacaggacgtaacaacgacaaagtacgtctagttactaacgtactaacgtaactacgaaccgacgtccgagacgtcgtaccgaacgcggaaccgtacggtaccgttacttaagtaccgttggtacggacgtaaagggtacgttaaagggtaaaaggttaaaaaggtaccgtttagggaggttttaccggtttagggtttaacggggtccgggggtaacccggtacgggggtaacctaccccgggtttcgggtacccccgttaaccccggg

SEQ ID NO: 247553 - DNA, 756 bp, Homo sapiens
  misc_feature: GYAE6OF01BYIFM.17.28.C06.1.454.CMB.1.raw
  modified_base (164)..(164): a, c, t, g, unknown or other
  misc_feature (164)..(164): n is a, c, g, or t
  modified_base (391)..(391): a, c, t, g, unknown or other
  misc_feature (391)..(391): n is a, c, g, or t
tcagcgtagactagcacgaccggtgctcgatttagagctcacgtattggggtttggggaggtctcagagaggaggcttagccctggactccaaggcctttccacttggtgatcagcactgagcacagaggactcacatggagttgggctgactggtttctgtgnttgtttagagtgtcagtgtgagtctaggttggttggacgggtcgggggagtcctggtccaggccggtcggggggtccctgagtacctcctcctggtcgcacgtccgtccggtaccttccccttataggttagttagttggatcgtacgttcgggccgaccaagaccgtaccggaagggaacggggtctaggggaggtcggggtacggacccaaaagaaagaaaaganaaaggagtacggtaaacgtcggaccggtttaagtttacggaggtaccgttgtttcgggtaacggtaaccggggttaccctttacccaaccttacgttacccgtacgaacggaacggaaccgaaccgaaccgtaaacgtaacttactacgtacgttaactaactaactaacctaagaacgacgtaccgtaacgtacgtagtaccgacgaaccggaaccggaccggtaccggttacgttaacgttacgttacgtaggtacgaagtaagtaaggtacggtaaaaaaaaaaaggtgtagggtacgttagttaggtttagggttacgggtaccgggacgggtaccggtccggttccggtccgttaccccg

SEQ ID NO: 247554 - DNA, 921 bp, Homo sapiens
  misc_feature: GYAE6OF01BMOD4.17.28.C06.1.454.CMB.1.raw
tcagcgtagactagcacgaccggtgctcgatttagagctcacgtattgggtttggggaggtctcagaggaggaggcttagccctggactccaaggcctttccacttggtgatcagcactgagcacaggaggactcaccgagtgggtaggttggggctagtaacgtttcgggtttttccgtttggttgtctttggttttaggaaggttcgtcgagttgtaggtaggttccgtaggtttgggttggtacgggttccgggggggacgggtcccgttcgggtaccgacgggtccgggtttcgggggggttcccttgggacgtaccgttccgttcccggttggtcggccgaccggtccccggttaccggttaccttttaccccttacgttaaggtttacgtttagtttagggtagttcggtaccgtttcgggggtcccgaccgtacggaccggttacccgggaagggggggtaacggggttcggtaggggtacggggttcgggtacggaaccgaaaacgtaacggtaaacgacgtaaggtaagtacggtaactccggtacggtttaaggttttacggtacggtacgttacggttggtaacgggtaccgggttacctttacccgaccgttacgtaccgtaccggaacggtaaccgtaaccgaacccgtaaccggaaattaccgttaaccgtacgttaactttacgttaaaccgtaacccgtaaacgtaacgaaaccgtacggtaacccggtggaaccggtaccggttaccgggaacgaaccgggacccgttaacccggtccgggttaatttaccgtacgtggttacgcgtaagtacggtaggtaaaagtaagggtgttacgtaggttcggttttaggtacgggttcgggaacgggtacggtaacggtccgttaacgggcccttacgg

SEQ ID NO: 247555 - DNA, 791 bp, Homo sapiens
  misc_feature: GYAE6OF01BEIWZ.17.28.C06.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagtgggctgaagttcggttttcttgttgcttgtttaagaagtgtcagtgtgagtctagttggtgnggtcggggngccgtggtcagcgtggggtcctgagctctcctgtcgcacgccgtaccggtaccttccccttacgtagttacgtttagtggtactgtaccgttcgggtccgaccgacggaccgtaccggaaagggggaacggggtcgtaggggacgggttggggtaacggaacccgaaaacgtaaagtaaaacggacgtaaaggaggttaacgggtaaaccttggtaacccggtttaaggttttttaaccgggtacggggtaacctttcggttagggtaacgggtaaccggggttacccggttttaccaacctacgttaccgtaccaacgggtaaacgaaccgtaaacccggaaccgtaaagtaaacgtttactaaccgttaggtaacttaacctaaccaaacgttaacgaacgtaacgtacccgtaggaacggtacgtaacgacgaacggaaccgaccggtacgttagttaacgttacgtcggtagacgtaaggtagtaaggttaaacggaaaaagttcggtaggtagttaggtttaggtttacggagggtaccggtacggtaacggtcccgttcggcccgttaccg

SEQ ID NO: 247556 - DNA, 811 bp, Homo sapiens
  misc_feature: GYAE6OF01ARQSP.17.28.C06.1.454.CMB.1.raw
  modified_base (647)..(647): a, c, t, g, unknown or other
  misc_feature (647)..(647): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaacgttgggtttccttgtgtcttgttttagaggtgtccagtgtggaggtcctaggttgggttggacgggtccggggggagccgtcgggtcccaggtcccggttcgggggggtcccctggacgtaccttccgttccgtggtcgccgacggtccccgttcccggtacctttcccccgttagtaacggttacggtttacgttggtacttcggttaccggttccggggttaccccgcccgtaacggtacccgtaccgggaacggggggtaacggggtcggttaggggacggttggggtaccggaaccaaaagtaaagtaaacgacgaaagtacgtacgggtaacgtcggtaccgttaggttttacgtaggtcctcggtaggtacgggacggttcctttaccaccgttacgtccgtacgacgaacgtacggaacccgtaaccgaccgtaaagtaacttcgaaccgtttaagtaccgttactaaccgtaacctaggaaacccncgtaccgtacggagtaaccgccggtaccgtaacggaccggtaacccgtaccgttaacgttacgttaggccgtaagtacggtagtaagttaaggaaacggtaaacgtgtcggttagttagttaggttaacgggtcgggaccgtagggtccctcggttcgtacccg

SEQ ID NO: 247557 - DNA, 751 bp, Homo sapiens
  misc_feature: GYAE6OF01CNZMR.17.28.C06.1.454.CMB.1.raw
  modified_base (185)..(185): a, c, t, g, unknown or other
  misc_feature (185)..(185): n is a, c, g, or t
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagcgtagactagcacgaccggtgctcgatttagagctcacgtattgggtttggggaggtctcagagaggaggcttagccctggactccaaggcctttccacttggtgatcagcactgagcacgagacgactcaccagtggaggttgggctagaacgttggtttcctgttgcttgtttagagtntcagtgtgacgtctagttggtgacggtccggggngccgtggtccacggtccggtcggggtccctgacgtcctcgtccgtgtcgccncggtccctaccggtccttcccgttagagttattagtggatcgtacggtcggtcccgacgtacggtaccgtacggaacggggacgggtcgtagggaggttagggtaccgaacctaagaacgtaaaggacctaaggacgtacggacgtacggtaccgtttaggtttcggagtaccgtagtaggtacgggtaccggtttacccttacctaacctagtccctacgaaggtaccaaccgacgtaacaaacgttataccgtagttaacgtactaacaactaactacgaactcgactacggagtaccgagacgtacgacccggtacggtaccgttagttaccgttgtacgggctaaggtaagttaagggtaccgttaaaaaggtaaaccgttggttcggtaacggttttgggttaaacgggtttaccggggacggtaacccgggtaacggggtccgtttaacccggtccgggtaaccccttacccgg

SEQ ID NO: 247558 - DNA, 873 bp, Homo sapiens
  misc_feature: GYAE6OF01CX8KG.17.28.C06.1.454.CMB.1.raw
  modified_base (239)..(239): a, c, t, g, unknown or other
  misc_feature (239)..(239): n is a, c, g, or t
tcagcgtagactagcacgaccggtgctcgatttagagctcacgtattgggttgggaggtctcagagaggaggcttagccctggactccaaggcctttccacttggtgatcagcactgagcacagagactcaccagtggagttgggctgaacgtttgggtttttcccgttgttgtcttgttttagaaggtgtccagtgtgtacgtcctagttggtgacggtccggggagcctcggtaccncggtccggtcgggggtccctaggataccgtcctaccgtgtgacgacgtcccgtccggttccttccccgtcgtaagttacgtttattaggtactcggttacgttccggtccgccaacgtaccgtccggaagggggtacggtcgttagggtacggttaggggtcccggaacctaaacgtaaacgtaaacgacgaaacggtagtacgggtaaccgttcggtacccggttttaggttttaacccggtaacgggttccttacgggtaggtaaccgggtacggttaccccccgttttacgacccgtttaactccccgttaccgaaacggtacccgaaaccgaacccggaaccccgtaaagtttacccgtttaacgtactttaaccgttaacgttaccgtaaaccccgtaaacgaacgttaaaccggcctaccgacggtaaccgtacggttacccgaacgttaaaccggaacccgtacccgggtttccgtagtttaacccgttagttcgggttacaacggttaggtaagtaaccgggttaaagtaaaacgttaccgggtaggttacgtttaggttaccggtttttaacggccgggtacgggtacgggaaacccgttccggccggtttaccccgtaacccgg

SEQ ID NO: 247559 - DNA, 848 bp, Homo sapiens
  misc_feature: GYAE6OF01BL5HU.17.28.C06.1.454.CMB.1.raw
  modified_base (120)..(120): a, c, t, g, unknown or other
  misc_feature (120)..(120): n is a, c, g, or t
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (291)..(291): a, c, t, g, unknown or other
  misc_feature (291)..(291): n is a, c, g, or t
tcagcgtagactagcacgaccggtgctcgatttagagctcacgtattgggtttggggaggtctcagagaggaggcttagccctggactccaaggcctttccacttgtgatcagcactgancacagaggactcaccatggagttggggctgaactgggtttcctgttcgcttgtttagaggtntccagtgtgnggtccagttggttgaggtccggggagcctggtccagccggtgggggtccctgagacctctccgtggtcgacgagtacccgtcggtaacttcccccttanaacgttagttaactggaacgtcgtacgttcgggtcccgacacgtactccggaaaggggtacgggccgtagggtacggtagggttacggacctaaagaaacgtaaaagaccgtaaaaggaacgtacgggtaacttacggggaacccgttaaggtttttaaccgagggttaccgtagttacggttaaggtaaccgggggttccctttaaccaccgtaactacccgtacgaaggtaaccgaactaacccggtaaccaaaggtaacttcttaacgtaagttaactacgtaaacaacgttaacgaaacgtaacggtacctaggtaaacggtaccgtaacggaaccgtaaccggtaaaccgtacccgggtaccgttaaacgggtttaaccttaaccggttaacgtaccgggtaaagtaaccgggttaaataaccgggtaaaaagggttaaaaaacccgttaaggtacggttaccgttagggttttaaccggtttacgggttaaccggggtaaccggaacgggttaaaccggttaccccttggggtaaacccggttaacccccg

SEQ ID NO: 247560 - DNA, 835 bp, Homo sapiens
  misc_feature: GYAE6OF01BEARS.17.28.C06.1.454.CMB.1.raw
  modified_base (137)..(137): a, c, t, g, unknown or other
  misc_feature (137)..(137): n is a, c, g, or t
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
tcagcgtagactagcacgaccggtgctcgatttagagctcacgtattgggtttggggaggtctcagagaggaggcttagccctggactccaaggcctttccacttggtgatcagcactgagcacagagactcaccanggagttgggctgtaacttgggttttccttgttgtcttgtttagtagtgtcagtgtgagtcagttgtgaggtcggggagtcgtcggtacncgccgtcgggggtccctggacgtcctcgtccgtgtgcnccgtcccgttacccggtacctttcccccttacgtaagtttacggtttattggtacgttaggtaccgtttcggggtccccgaccgtacgtaccgttaccggaagggggaacggggtcggtgggtagggttacggggtccggtaccgaaacgtaaagtaaacgacgaagtaggtacggtaaccgtcgtaaccgtttaaggtttaccggtggtaaccgttcgttacgggtacgggtaaccgggttaccccgtttaccgaacctacgttaccctacccgtaaggtaacccgaaaccctaaacccgtaccgtaaagtaacgtttaaccttaaccgtaacgttaacttaaccttaacccgaaacttacggtaaacccgaccggttacgaacgaggtacgcgtaaccgaacggaccggtacccggttcggttagttaccgtttaacgtcggtacgcgtaagtacggtagtaaaaccggtaaaagttggtacggttagtttcggtttaggtttaccggggttacccggggtacgggtacggggtaccccgttacccgggttgtccccccgttaacccgg

SEQ ID NO: 247561 - DNA, 861 bp, Homo sapiens
  misc_feature: GYAE6OF01DULWO.17.28.C06.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
tcagcgtagactagcacgaccggtgctcgatttagagctcacgtattgggtttggggaggtctcagagaggaggcttagccctggactccaaggcctttccacttggtgatcagcactgagcaacagacggactccaccatggagttgggctgaacgttgggttttccttgttgcttgttttagaaggttntacagtgngtaggtcctaggttggttagagggtccgggggacggtccgtcgggtccacggcccgggtcggggggtccctaggacgtaccttcctccgtgtcgacaccggtcccgtaccggtacctttccccgttatacggttaagttagtcggtatccgtacgtttcgggccgacacggtactaccgggaaagggggaacggggtcgtaggggtacggttcgggtacggaacctaaacgaagtaaaaggaccgtaaaaggtaacgtacggggtaaaaccgttccgggtaaccggttttaacgggttttacccggtagggtacccgttacgtttaggggtaaccggtaaccgggggtttacccctttacgacccgtaattacccgtaccgggaaataaccgggaaccgtaaccgaaccttaaaggtaaactttcccgaaccgtttacgtaacgttaacccgttaaaccaacgttaaccgaaactccggtaccgtaagggaacgtacgtacccgataaccgggaccgtacccggtacgttcttacggtaacgttgaggaccggtagtaaccagggttaaaacggtaaagtcgggtaggttgttaaggttcgggtttacggacccggggtaacggttacggacccgtccgggttaccgtcccgtaaccccggg

SEQ ID NO: 247562 - DNA, 638 bp, Homo sapiens
  misc_feature: GYAE6OF01ALK4Q.17.28.C06.1.454.CMB.1.raw
  modified_base (283)..(283): a, c, t, g, unknown or other
  misc_feature (283)..(283): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (455)..(455): a, c, t, g, unknown or other
  misc_feature (455)..(455): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggacttccccttnagtagttattggatgacttgggtccgccagacctccgaggggaagggctggaggtgggtggccaacataaagcaagntggaactgccgtagtttacgnggactntgtgaggtccttcacctatctcagacgacaacgcaagatcactgtactactacactagaacagctgangtcgcaagccgacggtcccgtgtacttacgtggtcgacggagacgttagggtaaacggtaaaaaaggttacgtgggttacgtttagggtttacgggttttttaacgggttccggggggggtaacccggtaaacggggggtaccgtaccccccgggtttaggggttcccccgttaacccccggg

SEQ ID NO: 247563 - DNA, 902 bp, Homo sapiens
  misc_feature: GYAE6OF01EZ4AJ.17.28.C06.1.454.CMB.1.raw
tcagcgtagactagcacgaccggtgctcgatttagagctcacgtattgggtttgggggaggtctcagagaggaggcttagccctggactccaaggccctttccacttggtgatcagcactgagcacagaggactcaccatgggaggttggggctaggtaacgttggggtttttccttgttgtcttgttttaggaaggtgttcagtggtgacggtcgtaggttggttggacgggtccgggggacggcctggtccacggccggtcgggggtccctggacgtactcctccgtgtcgcacgtcccgttccggtacctttcccccttagtaaggttacgtttagttacggtagtacggtcggttacggggtccccgaccgtaaccgtacccgtaccgggaagggggggaacgggggtccggtagggggtaggggttacggggggtaccggaacccaaaacggtaaacgtaaaacgggaacgtaaaacggtagtaaccgggtaaacgtcgggtaacccggtttaaggttttaacgggtacgggttacctacggtttacggttaacggggtaaccgggttacccgttttaacccaacccgttactacccggtaacccgaaggtaaccgaaccgtaaccgaaaccctaaggttaacccttacgtaacgttacgttaacttacccgtaaaccaacttaacgaacgtaccgtaccgtaggaacggtacgtaccggagaaccggaccggtaccggtacgttaacgtttacgttacgttggtacgacggtaaggtaaggttaaggaaaacgggttaaaagttaggttacggtcgttttaagggttacggttttacggggcggggtaaaccgggacgggttaccggtccccggtacgggttccccgttaccccgg

SEQ ID NO: 247564 - DNA, 761 bp, Homo sapiens
  misc_feature: GYAE6OF01EJ5L7.17.28.C06.1.454.CMB.1.raw
  modified_base (434)..(434): a, c, t, g, unknown or other
  misc_feature (434)..(434): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgagtccagttggtgaggtccggggaggcctggtccagccgtgggggtccctgagactctcctgtgcacgcctccggtacttcccccttcagttagttagttggatcggtactttcgggcccgccgacgacctccggaggggggtaagggggcgttaggggaggttgggggtacggacccaaaacgaacgtaaaaggaccgaaaggagtagggaacctcggtaccggtaggtttttacggnggtacctcgtggtaagggaaccgggtcccgttttaccaccgtatcccgtaccgaagaacgaaccaaacggacccaaaagtaacttaccaacgttagttaactcctaaaccctaaccttaacggaaacctacgtacccgtaggtaacggtaacggtccgaacgaaccggaccggaacccgggttccggttagttaacgtttacgtcggttacgggacgtaagtagttagggtaaaagggtaaaaaacgtttggtacgggttgttggtttaggtttacggttcgggggaccgtaggggtaccggtcccgttagggtcccgttaacccgg

SEQ ID NO: 247565 - DNA, 708 bp, Homo sapiens
  misc_feature: GYAE6OF01BB3N9.17.28.C06.1.454.CMB.1.raw
  modified_base (183)..(183): a, c, t, g, unknown or other
  misc_feature (183)..(183): n is a, c, g, or t
  modified_base (275)..(275): a, c, t, g, unknown or other
  misc_feature (275)..(275): n is a, c, g, or t
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactggttttccttgtgcttgtttagaggtntcagtgtgaggtcagttggtgaggtcggggagctggtcagccgtgggggtccctgagactcctctgtcgcacgcctccggtacttcccctanagttagttgttggatggtacgttcgggtccgcaggacctccggaagggggaacggggtcgtagggagggttggggacggaccaaacgaataaaagacaaaggtacgtacggaactcggaccggttaaggttttacggaggtactcgtggtggaacggtccgtttacaccatcctacgaaggtacgaacaacgaccaagtaacttccactagtactactaacaacgtagaaccacgaccgtaggaaggtacgtaccggacaacgggaaccgtaccggtaccggtttaagttacggtttacgttggtacgacggttaaaggtaggttaaaggtaaacgggtaaaaagtggttaggtacgtttagggtttacggtttacgggttacggggtacgggtaaccgggaacgtcccccggttagggtccccgtaaccccg

SEQ ID NO: 247566 - DNA, 543 bp, Homo sapiens
  misc_feature: GYAE6OF02GFQBL.17.28.C06.1.454.CMB.1.raw
  modified_base (375)..(375): a, c, t, g, unknown or other
  misc_feature (375)..(375): n is a, c, g, or t
  modified_base (495)..(495): a, c, t, g, unknown or other
  misc_feature (495)..(495): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctgggagtgggtggccaacataaagcaagatggaactgccgagtttacgnggactctgtgaagggcctttcaccatctccagagacaacgccaagattcactgtatctgacaaatgaacagccttagacgacgacgacacggctgtgtattactgtgcgagagactccgngtgctggagtcgaaggtgaccgtacgggtcgggagggtctgggttacg

SEQ ID NO: 247567 - DNA, 542 bp, Homo sapiens
  misc_feature: GYAE6OF02JH6ZB.17.28.C06.1.454.CMB.1.raw
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccgaggggaggggctggagtgggtggccaacataaagcaagatggaactgccgagttttacgnggactctgtgaagggcctttcaccatctccagagacaacgccaagaatcactgtatctacaactgaacngcctgagagtcgnagacacggccgtgtacttactgtgcgagatgtaggaaaagtatggctgtgtttagtggggccagggacgcccgtgggtccaccgg

SEQ ID NO: 247568 - DNA, 545 bp, Homo sapiens
  misc_feature: GYAE6OF02HRPOT.17.28.C06.1.454.CMB.1.raw
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (484)..(484): a, c, t, g, unknown or other
  misc_feature (484)..(484): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttggggtccgccagactccagggaaggggctggagtgggtggccaacataaagcaagatggaactgccgagttttacgtggactctgtgaagggcctttcaccatctcagagacaacgccaaagaattcatgtatctacaactgaacngcctgagngtcgcagacacggcctgtattctgtgcgagntgtaggaaaagtatggctgttgtttagtcggggaccaggggacgcccgttggtctacccgg

SEQ ID NO: 247569 - DNA, 520 bp, Homo sapiens
  misc_feature: GYAE6OF02H8QTF.17.28.C06.1.454.CMB.1.raw
  modified_base (402)..(402): a, c, t, g, unknown or other
  misc_feature (402)..(402): n is a, c, g, or t
  modified_base (503)..(503): a, c, t, g, unknown or other
  misc_feature (503)..(503): n is a, c, g, or t
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccactcctcatctatagaaatgatcatcggccctcggggtccctgaccgattctctggctcatgtctggcacctcagcctccctgacccatccagtcgggctccggtccaggatgaggctgattatactgtncacgtggatgacatcctgaatggtccgtgttcggcggagggaccaggctcgaccgtctaaagtccagcccaggctcgcccctggtcctactctcgttcccncctcctcctagtctacg

SEQ ID NO: 247570 - DNA, 550 bp, Homo sapiens
  misc_feature: GYAE6OF02JBLQP.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgaggggaaggggctgggagtgggtggccaacataaagcaagatggaactgccgtagtttacgtggactctgtgaagggccgtttcacctatctccagagacaacgccaagaattcatgtatctacaactgaacagcctgagagtcgcagacacggccgtgtattactgtgcgagatggtaggaaaagtagtggtactgttagtttagtggggccagggagcccgtggtcctacccg

SEQ ID NO: 247571 - DNA, 543 bp, Homo sapiens
  misc_feature: GYAE6OF02H3J8I.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactcccagggaaggggctggagtggggtggccaacataaagcaagatggaactgccgtagtttacgtggactctgtgaaggccgtttcaccatctccagagacaacgccaagaattcactgtatctacaactgaacagcctgagagtcgcagacacggccgtgtattactgtgcgagatgtaggaaaagtatggctgtgtttagttggggccagggacgtccgtggtctaccg

SEQ ID NO: 247572 - DNA, 555 bp, Homo sapiens
  misc_feature: GYAE6OF02IPXES.17.28.C06.1.454.CMB.1.raw
  modified_base (376)..(376): a, c, t, g, unknown or other
  misc_feature (376)..(376): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccaggggaaggggctggaggtgggtggccaacataaagcaagatggaactgccgtagtttacgnggactctgtgaagggcctttcaccatctccagagacaacgccaaagaattcactgtatctacaactgaacagcctgagagtcgcagacacggccgtgtattactgtgacgagatgtaggaaaaagtataggacttggtgtttaagttggggacctaggggacgcccgtggtctacccgg

SEQ ID NO: 247573 - DNA, 550 bp, Homo sapiens
  misc_feature: GYAE6OF02GF21M.17.28.C06.1.454.CMB.1.raw
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaanataaagcaagatggaactgccgagttttacgnggactctgtgaacggcctttcacatctccagagacaacgcaagattcactgtatctaacactagaacagcctgagagtcgcagacacggccgtgtattactgtgcgagatgtaggaaaagtagtggtactggttagtttagttgggaccgagggacgtcccgtggtcctacccgg

SEQ ID NO: 247574 - DNA, 554 bp, Homo sapiens
  misc_feature: GYAE6OF02GO7BL.17.28.C06.1.454.CMB.1.raw
  modified_base (539)..(539): a, c, t, g, unknown or other
  misc_feature (539)..(539): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagcctggggggtccctggagactctcctgtgcagcctccggattccccttcagtagttattggatgacttgggtccgcagactccagggaaggggctgggagtgggtggccaacataaagcaaagatggaactggccgagttttacgtggactctgtgaagggcctttcacatctccagagacaacgccaaagattcactgtactctaacaactgaacagcctgagagtcgcagaccacggccgtagtacttacgtgtcgcgagataggtaggaaaagtaagtggacttgtgtttagtggggccagggcncccgtggtctaccgg

SEQ ID NO: 247575 - DNA, 571 bp, Homo sapiens
  misc_feature: GYAE6OF02F31WA.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagattcactgtatctacactgaacagcctgagagtcgcagacacggcctagtacttacgtgtgcgagatgtaggaaaaagtatggacttaggttaggttttaagttcgggggacctaagggggacgtccccggttagggtccctaacccggg

SEQ ID NO: 247576 - DNA, 605 bp, Homo sapiens
  misc_feature: GYAE6OF02IJW5T.17.28.C06.1.454.CMB.1.raw
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgagtccgggggaggcctggtccagccgtggggggtccctgagactctcctgtgcagcctccggacttccccttcagtagttattggatgacttgggtccnccagactccgagggagggctggagtgggtggccaanataaagcaagataggaactgccgtagtttacgnggactcgtgtggaacgggtccgtttacacctatcctaccagacgacaacgccaaagaattcatgtactctaacaactagaacagcctagagacgtcgacagacgaccggccgttagtacttacgtggtgacggagtagtaggtaaggaaaaagttagtacggtacttaggttaggttttaaggtcggggaccgaggggtaccgtcccggttcgggtacccgtaccccgg

SEQ ID NO: 247577 - DNA, 561 bp, Homo sapiens
  misc_feature: GYAE6OF02IMD66.17.28.C06.1.454.CMB.1.raw
  modified_base (278)..(278): a, c, t, g, unknown or other
  misc_feature (278)..(278): n is a, c, g, or t
  modified_base (414)..(414): a, c, t, g, unknown or other
  misc_feature (414)..(414): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
  modified_base (546)..(546): a, c, t, g, unknown or other
  misc_feature (546)..(546): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgagtccggggaggcctggtccagcctggggggtccctgagactctcctgtgcagcctccggattccccttnagtagttattggatgacttgggtccgccagacctccgaggggaaggggctgggaggtgggtggccaacataaaagcaagatggaactgccgtagttttacgtggactcgtgtgaagggcctttcaccatctcaganacaacgccaagaattcactgtatctacaactgaacagcctagagagtcganagacacggccgtagtacttacngtgcgagatagtaggaaaaagtagtggacttggttagtttagttggggaccaggggacncccgttggctacccg

SEQ ID NO: 247578 - DNA, 557 bp, Homo sapiens
  misc_feature: GYAE6OF02HDWVE.17.28.C06.1.454.CMB.1.raw
  modified_base (372)..(372): a, c, t, g, unknown or other
  misc_feature (372)..(372): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggagggctggagtgggtggccaacataaagcaagatggaactgccgagttttacgnggactctgtgaagggtcctttacaccatctccagagacaacgccaagaacttcactgtactctaacaactgaacagcctgagagtcgcagacacgggcctgtacttacgtgtgcgagatgtaggaaaagtatgggctaggttgtttaagttggggaccgagggtacggcccgttggcctacccgg

SEQ ID NO: 247579 - DNA, 664 bp, Homo sapiens
  misc_feature: GYAE6OF02I3FWA.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgtgctgtttagaggtgtccagtgtgaggtccagttggttgagtccgggggaggcctggtccagccgtggggggtccctgagactctcctgtgcagcctccggacttccccttcagtagttattggatgacgttgggtccgccagactccgaggggaaggggctgggaggtgggtggaccaacaataaagcaagatggaactggccgtagttttacggtggaccttcgtggtaggaacgggtccgtttccacctatcctccaaggacgaaccaaacggcccaaagtaacttcacttgtaactacgtaaccaacttggaaacagcctaggagacggtcgacacggacgaccgggccgttagttattaccgtgtacggacggagtacgttaggtaaggtaaaaaggtagttacgggtactttgggttacggtttttaacgggttaggggggaccccgttaagggggtaaccggtccccggttgggtaccccgtaaccccggg

SEQ ID NO: 247580 - DNA, 581 bp, Homo sapiens
  misc_feature: GYAE6OF02HS8GU.17.28.C06.1.454.CMB.1.raw
  modified_base (377)..(377): a, c, t, g, unknown or other
  misc_feature (377)..(377): n is a, c, g, or t
  modified_base (440)..(440): a, c, t, g, unknown or other
  misc_feature (440)..(440): n is a, c, g, or t
  modified_base (466)..(466): a, c, t, g, unknown or other
  misc_feature (466)..(466): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgcagactccgagggaggggctggagtgggtggccaacataaagcaagatggaactgaccgtagttttacggnggactctgtggaagggtccgtttacaccatctaccagagacaacgccaaagaattcactgtanctaacaactgaacagcctgagatcgnagacgacgccgtgtacttactgtagcgagataggtaaggaaaaagttagtaggtacttggttagttttaagttcgggggacctaagggggacgtccccgtagggtcctaccccgg

SEQ ID NO: 247581 - DNA, 619 bp, Homo sapiens
  misc_feature: GYAE6OF02HI7TV.17.28.C06.1.454.CMB.1.raw
  modified_base (385)..(385): a, c, t, g, unknown or other
  misc_feature (385)..(385): n is a, c, g, or t
  modified_base (460)..(460): a, c, t, g, unknown or other
  misc_feature (460)..(460): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggacttcccccttcagtagttattggatgacttgggtccgccagactccgaggggaaggggctgggaggtggggtggccaaacataaagcaagatggaactgccgtagtttacgngactctgtgaagggtccttcaccatctccagacgacaacgccaaagaattcactgtatactaacaactgaaaccngacctgagtacgtccgacgaaggaccacgggccgttagttacttacgtggtgacggtaagtagtagggtaaaggtaaaaagttaagtgggtacttaggttaggttttaggtcgggggacccgtaagggggaccgtccccggttacggtccgtaccccgg

SEQ ID NO: 247582 - DNA, 556 bp, Homo sapiens
  misc_feature: GYAE6OF02G2SVF.17.28.C06.1.454.CMB.1.raw
  modified_base (277)..(277): a, c, t, g, unknown or other
  misc_feature (277)..(277): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (446)..(446): a, c, t, g, unknown or other
  misc_feature (446)..(446): n is a, c, g, or t
  modified_base (486)..(486): a, c, t, g, unknown or other
  misc_feature (486)..(486): n is a, c, g, or t
  modified_base (510)..(510): a, c, t, g, unknown or other
  misc_feature (510)..(510): n is a, c, g, or t
  modified_base (541)..(541): a, c, t, g, unknown or other
  misc_feature (541)..(541): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggagcctggtccagcctggggggtccctgagactctcctgtgcagcctcggattccccttnagtagttatggatgacgttgggtccgccagactccgaggggaagggctggagtgggtgccaanataaagcaagatggaactgccgtagtttacgnggactcgtgtacgaagggtcctttcactatctccagacacaacgccaagaattcatgtatctaacactgaaacngcctagagagtcgacagaccacgggcctagtaattcctgngacgagactaggtaaggaaaagtntggactgttagtttagtggggcctaggggcncccgtggtcctaccg

SEQ ID NO: 247583 - DNA, 541 bp, Homo sapiens
  misc_feature: GYAE6OF02IW3WZ.17.28.C06.1.454.CMB.1.raw
  modified_base (528)..(528): a, c, t, g, unknown or other
  misc_feature (528)..(528): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggaggtgggtggccaacataaagcaagatggaaactgccgagttttacgtggactctgtgaagggcctttcaccatctccagagacaacgccaaagaattcactgtatctacaactgaacagccctagagagtcgcagacacggccgtgtattactgtgcgagatgtaggaaaagtaatggctgtgtttatgggcaggganccctggtccaccg

SEQ ID NO: 247584 - DNA, 589 bp, Homo sapiens
  misc_feature: GYAE6OF02GWLG9.17.28.C06.1.454.CMB.1.raw
  modified_base (389)..(389): a, c, t, g, unknown or other
  misc_feature (389)..(389): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccgaggggaaggggcgtgggagtgggtggccaacataaagcaagataggaactgaccgtagttttacgtaggactntgtgaacgggtcctttacacctatctccaagacgaacaacgaccaaagaacttcaacttgtatctacaactgaacagcctgagagtcgacacgacacggccgtagtattacgtgtgacgagataggtaaggaaaagtaagtaggtacgttgttagtttagtacggggtaccgaagggtcgcccgttaggtacctacccgg

SEQ ID NO: 247585 - DNA, 704 bp, Homo sapiens
  misc_feature: GYAE6OF02HIEO6.17.28.C06.1.454.CMB.1.raw
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatgggagttggggctgaacttgggttttccttgttgcttgtttagaggtgtccagtgtgaggtccagttggttgagtccggggaggcctggtccaggcctgggggtccctggagactctcctgtgcacgcctccggattccccttnacgttagttattggattgtacgttgggtccnccgagacctccgaggggaacggggctagggagtcggggtacggaccgaacgagtaaacggctaaggagtacggaactggaccgtaggttttacggnggtaacttactggtacggtaacgggtccgtttacgacctagttcctacccgaagtaccgaacaacccgaccaaaggtaactttccgaacttagtaacttacctaacctaactgaaaccacgtccgtagaagtacgtcgacaacggaccgtaccgggccttagtacttacgtggtacgacgtaggtaacgtgggtaaacggtaaaaggttcgtagggtaacgtttgggttaagtttttaacggtcggggggtccctaaaggggttcccggtcccgttacgggttacccctaccggg

SEQ ID NO: 247586 - DNA, 600 bp, Homo sapiens
  misc_feature: GYAE6OF02JTKI2.17.28.C06.1.454.CMB.1.raw
  modified_base (374)..(374): a, c, t, g, unknown or other
  misc_feature (374)..(374): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggtttcctgtgctgtttagaggtgtccagtgtgaggtccagttggttgagtccgggggaggcctggtccagcctggggggtccctgagactctcctgtgcagcctccggattccccttcagtagttattggatgacttgggtccgcagactccgagggaagggctggagtgggtggccaacagtaaagcaagatggaactgccgagtttacgtggactntgtgaacgggtccgtttcaccgtatctccagtacgacaacgccaaagtactcactgtatactacaactgaaacagcctagagagtacgcaagaccgaccggtccgtaggttacttacgtggtcgacgaggtatggtaaggtaaaaaggtagtcggtacttaggtttaggtttaaggttcgggggccgaaggggtaaccgtcccccgggttaggtacccgtacccgg

SEQ ID NO: 247587 - DNA, 604 bp, Homo sapiens
  misc_feature: GYAE6OF02I83HZ.17.28.C06.1.454.CMB.1.raw
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggaggcctggtccagcctggggggtccctgagactctcctgtgcagcctccggattccccttcagtagttattggatgacttgggtccgcagactccgagggaagggctggagtgggtgccaacagtaaagcaagatggaactgcgtagtttacgtgactctggtagaagggtcctttacacctaatctaccagacgaacaacgccaaagaacttcactgtaactcaacaactagaacacgcctagagagtacgacagacacggccgtagtaacttacgtgtcgcgagtataggtaaaggtaaaaacggtaataggtacgtaggtttaggttttaggtacggggtaccggtaaggggaccgtacccggttagggtcccgtaacccgg

SEQ ID NO: 247588 - DNA, 532 bp, Homo sapiens
  misc_feature: GYAE6OF02F7OZ8.17.28.C06.1.454.CMB.1.raw
  modified_base (373)..(373): a, c, t, g, unknown or other
  misc_feature (373)..(373): n is a, c, g, or t
  modified_base (408)..(408): a, c, t, g, unknown or other
  misc_feature (408)..(408): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgcgagttttacgnggactctgtgaagtgccgtttcaccatctccaganacaacgccaaagattcactgtatctacaactgaacagcctgagagtcgcagacacggccgtagtattactgtgcgagatgtaggaaaagtatggctgtgttagtgggccagggacgcctggtcc

SEQ ID NO: 247589 - DNA, 620 bp, Homo sapiens
  misc_feature: GYAE6OF02IM04Z.17.28.C06.1.454.CMB.1.raw
  modified_base (372)..(372): a, c, t, g, unknown or other
  misc_feature (372)..(372): n is a, c, g, or t
  modified_base (507)..(507): a, c, t, g, unknown or other
  misc_feature (507)..(507): n is a, c, g, or t
tcagcgtagactagcacgaccggtgctcgatttagagctcacgtattggggtttggggggtagagaagacaggattcaggacaatctccagcatggccggcttccctctcctcctcaccctcctcactcactgtgcagggtcctgggcccagtctgtgctgactcagcccaccctcagtgtcgtcggggacccccgggcaggagggtcaccatatcttgttctggaaacagctccggcatctacaactaaactattttgctaggtaccagacaacttcccaggactcccggccccccgactccctcatctaataagaaatgactcacgtccggcccgtccggggtcctgaccgtattctctgcctcatgtcncgcacctcacgtcctcctgaccatcgaggtcggcgtcggtcgagtagtgagctagtattactcgtgtcgcgacggtggatcgactctccgtagtaacgttcgggtccggttggtaccgggcgggtaacggaccgnggtaccgtcgacccgttacgtaacgaccgaccggaaccccgaggtacccgtcccggtacccccggttcggtaccttaccgttcccgttcccgttacccctaccccgttacccg

SEQ ID NO: 247590 - DNA, 589 bp, Homo sapiens
  misc_feature: GYAE6OF02H88DR.17.28.C06.1.454.CMB.1.raw
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggaggcctggtccagcctggggggtccctgagactctcctgtgcagcctccggattcccccttcagtagttattggatgacttggggtccnccagactcccgaggggaaggggctggagtgggtggccaacataaagcaagatggaactgccgtagttttacgnggactcgtgtgaagggtcctttcaccatctccagacgacaacgccaaagatcactgtatctanaactgaacagctagagagtcgnacgacacggccgtgtacttacgtgtgacgtagagtagtaacggtaaaaagtagtagggtacttggttagttttaaggttcgggggtacccaggggtaccgtcccggttagggtccctaacccgg

SEQ ID NO: 247591 - DNA, 579 bp, Homo sapiens
  misc_feature: GYAE6OF02IW1LF.17.28.C06.1.454.CMB.1.raw
  modified_base (389)..(389): a, c, t, g, unknown or other
  misc_feature (389)..(389): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgagtccgggggaggcctggtccagcctggggggtccctgagactctcctgtgcagcctccggacttcccccttcagtagttattggatgacttgggtcccgccagactccgaaggggaaggggctgggagtggggtggaccaacagtaaaagcaaagatgggaactggccgtagttttacgnggacttctggtggaagggtccgtttcaccatcctccagacgacaacgaccaagaattcactgtaatctaacaactagaacacgcctagagagtcgacagaccacggccgtgttattacgtgtgcgagatggtaaggaaaagtagtaggctagttgtttagtcggggcgagggagtcccgtggtctacccg

SEQ ID NO: 247592 - DNA, 571 bp, Homo sapiens
  misc_feature: GYAE6OF02H52DH.17.28.C06.1.454.CMB.1.raw
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagcctggggggtccctgagactctcctgtgcagcctccggatttcccccttcacgtagttattggatgactttggggtccgccagactcccaggggaaggggctggagtgggtgccaacataaagcaagatggaactgccgagttttacgnggactctgtgaagggtccgtttnaccatcctcagagacaacgccaaagaacttcacttgtatctaacaactagaacacgcctgagagtcgcagacacggccgtgtattactgtgacgagatggtaaggaaaagtatggacttggttaggtttagttggggaccaggggactcccgttggtactacccgg

SEQ ID NO: 247593 - DNA, 695 bp, Homo sapiens
  misc_feature: GYAE6OF02GVP0Y.17.28.C06.1.454.CMB.1.raw
  modified_base (284)..(284): a, c, t, g, unknown or other
  misc_feature (284)..(284): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgtcttgtttagaaggtgtccagtgtgaggtccagttggtgaggtccggggagcctggtccagccggtcgggggtccctgagactctcctgtgcacgccctccggacttccccttnagttagttagttggatgtacgttcgggtcccgccagacctccggaaggggaaggggccgtagggaggtgggtcggacccaaacaaagtaaaacgcgaaagagtaggaactcggaccgttaaggttttacgtaggtacttcgtaggtacggaacgggttcccgtttaccgaacctagttccctaccgaaggacgaaccgaaaccgaccgaaaagtaacttaccgaacttagttaactacctaaaccgtaactacggaaacacgacctaggacgtacgtcgacgagaccgacggtccgtagtacttacgtgtcgacgagtattagggtaaggtaaaaagttagtaggtacgttaggttaggttttaggtacggggaccgtagggtaccggtcccgttaggtacccgtacccgg

SEQ ID NO: 247594 - DNA, 580 bp, Homo sapiens
  misc_feature: GYAE6OF02IY1N3.17.28.C06.1.454.CMB.1.raw
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccnccagactccaggggaggggctgggaggtgggtggccaacataaagcaagatggaactggccgtagtttacgnggactctgtgaagggtccttcaccatctccagagaccaacgccaaagattcactgtatctaacaactgaacngcctagagngtcgcagacacggcgtgtattacgtgtgacgagagtggtaaggaaaaagttgtaggtacgttggttagttttaaggttcgggggacctaaggggtacgtccccgttgggtaccctacccgg

SEQ ID NO: 247595 - DNA, 609 bp, Homo sapiens
  misc_feature: GYAE6OF02F70WY.17.28.C06.1.454.CMB.1.raw
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (466)..(466): a, c, t, g, unknown or other
  misc_feature (466)..(466): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagccctccggacttcccccttcagtagttattggatgacttgggtcccgccagacctccgaggggaaggggctgggagtggggtggccaacataaagcaagatggaactgccgtagttttacgnggtactntgtgaacgggtccgtttcacctatctccagacgaccaacgccaaagacttcactgtactctaacaactgaaacngcctagagagtcgacagaccgacggccgtagtacttacgtgtgcgagagtaggtaaggtaaaagtagtacggtcgttaggttgtttttaaggttcgggggacccgtaagggggtaccgtccccggttaggtacccgtacccgg

SEQ ID NO: 247596 - DNA, 562 bp, Homo sapiens
  misc_feature: GYAE6OF02IIIV7.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgaggggaaggggctgggagtgggtgccaacataaagcaagatggaactgccgtagtttacgtggactctgtgaagggtccgtttacaccatctcagagacaacgccaaagaattcactgtatctaacactgaacagcctgagagtcgcagacacggccgttagtacttactgtgcgtagataggtaaggaaaagtatggcttaggttagtttagttcggggaccagggacgcccgtggtcctaccgg

SEQ ID NO: 247597 - DNA, 600 bp, Homo sapiens
  misc_feature: GYAE6OF02JPVUJ.17.28.C06.1.454.CMB.1.raw
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
  modified_base (449)..(449): a, c, t, g, unknown or other
  misc_feature (449)..(449): n is a, c, g, or t
  modified_base (578)..(578): a, c, t, g, unknown or other
  misc_feature (578)..(578): n is a, c, g, or t
tcagcgtagactagcacgaccggtgctcgatttagagctcacgtattgggtttggggtagggagttcaggacaatctccagcatggccggcttcctctcctcctcaccctcctcactcactgtgcaggtcctgggccagtctgtgctgactcagccacctcagtgtcgtcgggacccccgggcaggacggggtcaccatactctttgttctggaaaaccngctccggnaatcctacgaactaaaacntttttggcttggtaccagctaaattcccaggtactccggccccccgatcctacatcctataacgaactgatcatcgcccgtccgggtcctgacccatctctgcacntgctgacncctncnctccngactancngtcggtcctgccgagncgtaggctagcttaatacgctcgcgtaaccggtggtagtcgaactcgttcccnggtaacttcggggtccgttcggggttacgccggggtacgtaccggtaggtccgtcgtaaccggttccagttaccgacgcccgtaaggtcctcggtcccccgttaagccctacggtctccggttaacccnccgttaccctccgtagcctcgg

SEQ ID NO: 247598 - DNA, 744 bp, Homo sapiens
  misc_feature: GYAE6OF02IENFD.17.28.C06.1.454.CMB.1.raw
  modified_base (285)..(285): a, c, t, g, unknown or other
  misc_feature (285)..(285): n is a, c, g, or t
  modified_base (405)..(405): a, c, t, g, unknown or other
  misc_feature (405)..(405): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcacgcctccggacttcccccttnagttacgttattggatgtacttcgggtcccgccacgacctcccgaaggggaaggggcgtagggaggtggggtcggaccaaacagtaaaacgcaaagatggaactgaccgtagttttacgnggtacttcgtgtaggaacgggtcccgtttacacctacttcctaccgaggaacgaacgaaaccgacccaaaggtaaacttacctacgttacgtaacttacctaaaccgtaaaccgttacggaaaacctacggtacccgttacgggagtaaccggtaccgacgaaccggaaccgtaacccgggacccggttttaagttaactttaaccgttcggtacggcgtaacgtagttacggtaagggtaaaaaagttaggttacggtacgttaggttttacgggtttaaggtttcgggggacccgtaacggggtaccgtaccccggttgggtacccctaaccccggg

SEQ ID NO: 247599 - DNA, 699 bp, Homo sapiens
  misc_feature: GYAE6OF02HZM74.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtccagttggttgaggtccgggggaggcctggtccagccgtggggggtccctgagactctcctgtgcacgcctccggtacttccccttcagttagtttattggatgtacgttcgggtcccgccagacctccgaaggggaaggggctggggaggtggggtcggaccaaacaagtaaaaggcgaaaggagtagggaaactggccggttaaggttttacggtggacttcgtggtaggaacggggtcccgttttaccacctacttcctaccgaagacgaacaaccgaccaaagtaacttccacttgtacttacctaacaaactcgaaaccagccctagacgagtccgacacggaccgaccggtccgtagttactttacgtggtagacggtaagtacgttaggtaaacgggtaaaaagttacgtcgggtactttagggtttaggttttacgggttcggggacccggaaggggttaccgtccccggttacgggttccctaaccccgg

SEQ ID NO: 247600 - DNA, 571 bp, Homo sapiens
  misc_feature: GYAE6OF02GWEK9.17.28.C06.1.454.CMB.1.raw
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggacttcccctcagtagttattggatgacttgggtccnccagactccgaggggacgggctgggagtgggtggccaacataaagcaagataggaactgaccgtagttttacgnggactctggtgaacgggtcctttcacctatcctaccagacgacaacgaccaaagtactcactgtatcaacaactgaacagcctgagagtccgnacgaccncggccgtgtattacgtgtcgcgagatggtaaggaaagtgtaggctgttagtttagtcggggccagggacctcccgttggtcctacccgg

SEQ ID NO: 247601 - DNA, 552 bp, Homo sapiens
  misc_feature: GYAE6OF02HD98N.17.28.C06.1.454.CMB.1.raw
  modified_base (379)..(379): a, c, t, g, unknown or other
  misc_feature (379)..(379): n is a, c, g, or t
  modified_base (485)..(485): a, c, t, g, unknown or other
  misc_feature (485)..(485): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttggggtccgccagactccaggggaaggggctgggagtgggtggccaacataaagcaagatggaactgccgagttttacgnggactctgtgagggcctttcaccatctccagagacaacgccaagaattcactgtatctacaactgaacagcctgagagtcgcagacacggccgtgtattactgtgngagatgtaggaaaagtaatggctggttgtttagttggggacctagggacgtcccgtggtcgtacccg

SEQ ID NO: 247602 - DNA, 676 bp, Homo sapiens
  misc_feature: GYAE6OF02GUJKY.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggacttccccttcagtagttattggatgacttgggtccgccagacctccgaggggaaggggctgggaggtgggtggccaacataaagcaagagtaggaactgaccgtagttttacgtggtacttctggtaggaacgggtccgtttacacctactcctaccaagacgaccaaccgaccgaaagtaacttacacgttagtaactacctaacaacgtagaaacagtaccctaggaagaggtccgacaacggaccgaccgggtcccgttagttaactttacgtgtcggacggagtagttaggtaaggtaaaaaggttacgtagggtacgttagggtttaacggttttacgggttacggggggacccgtaagggggtaccgtccccggttacggggttaccctaccccggg

SEQ ID NO: 247603 - DNA, 595 bp, Homo sapiens
  misc_feature: GYAE6OF02I7Z71.17.28.C06.1.454.CMB.1.raw
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgtttagaggtgtccagtgtgaggtcagttggttgaggtccgggggaggcctggtccagccgtggggggtcctgagactctcctgtgcagcctccggacttccccttcagtagttattcggatgacttgggtccgccagctccgaggggaagggctggagtgggtgccaananaaagcaagatggaactgccgtagtttacgnggactcgtgtagacgggctttcaaccntctccaganacaacgacaagatcactgatctacaatacgaacagctaggagacgtccgacgagaccacgggtaccgttagttacttacgtgtcggtacgaagagttggtaaaggaaaagttaagtaggtcgttagttaggttttaggttacggggccgtaaggggtaccgccggttacggtcccgttaaccccgg

SEQ ID NO: 247604 - DNA, 558 bp, Homo sapiens
  misc_feature: GYAE6OF02HD9RH.17.28.C06.1.454.CMB.1.raw
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
  modified_base (445)..(445): a, c, t, g, unknown or other
  misc_feature (445)..(445): n is a, c, g, or t
  modified_base (458)..(458): a, c, t, g, unknown or other
  misc_feature (458)..(458): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattcccccttcagtagttattggatgacttgggtccnccagactccagggaagggctggagtgggtggccaacataaagcaagatggaactgccgtagtttacgnggactctgtgaagggctttcaccatctccagacgacaacgccaaagaacttcatgtatctacaactgaacngcctgagagtcgnagacacggcctgtacttactgtcgacgagatgtaaggaaaacgtagtggactgttagtttaagttggggacctaggggacgcccgttaggtccctacccg

SEQ ID NO: 247605 - DNA, 728 bp, Homo sapiens
  misc_feature: GYAE6OF02IDEKC.17.28.C06.1.454.CMB.1.raw
  modified_base (426)..(426): a, c, t, g, unknown or other
  misc_feature (426)..(426): n is a, c, g, or t
tcagcgtagactagcacgaccggtgctcgatttagagctcacgtattgggtttggggaggtctcagagaggaggcttagccctggactccaaggccctttccacttggtgatcagcactgagcacaggaggactcaccagtaggagttggggctgaacgttgggttttcctgttgctgtttagaagtgtccagtgtgagtccagttggttgaggtccggggagcctggtccacgccgtcgggggtccctggagactctccgtgtgcacgcctccggtacttccccgtgtacgttacgttagtggattcgtacgttcgggtccgccgtagacctccgaaggggaacgggtcgtaggaaggtggggtacgacccgaaagtaagtaaaagccgaaaggatacggaaacttggaccgttagttttaacgnggtacttcgtaggtacggaaaggggttccctttacaaccctattccgtacccgaaggacgaaaccgaaccgaccaaaaggttaacttacgaaacgttgtaattaccctaacgtaactaagaaacacggccttaggaaacgtacgtaccgacaacggaaccgacggtacccggttagtaactttaccgtggacgtacgaagtaagttaggtaaaaggtaaaagtaaggtcggtacgtttaggttacggtttagggttacggggccgtaaagggtcccgttacccgggtgtaaccccgtcccgg

SEQ ID NO: 247606 - DNA, 562 bp, Homo sapiens
  misc_feature: GYAE6OF02H5ATW.17.28.C06.1.454.CMB.1.raw
  modified_base (406)..(406): a, c, t, g, unknown or other
  misc_feature (406)..(406): n is a, c, g, or t
  modified_base (443)..(443): a, c, t, g, unknown or other
  misc_feature (443)..(443): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccaggcctggggggtccctgagactctcctgtgcagcctccggattccccttcagtagttattggatgacttgggtccgccagactccgagggaggggctggaggtgggtggccaacataaagcaagatggaactgacgagttttacgtggactctgtgaaggccgtttacaccatcnccagacgacgaacgccaagaattcactgtatacctanaactgaacagcctgagagtcacgagacacggccgtgtacttatgngcgagntaggtaaggaaaagtatgggacttgtagttttagtcggggccagggacggtcccttaggcctacccgg

SEQ ID NO: 247607 - DNA, 603 bp, Homo sapiens
  misc_feature: GYAE6OF02JFGI4.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgagtccgggggaggcctggtccagcctggggggtccctgagactctcctgtgcagcctccggacttccccttcagtagttattggatgacttggggtcccgccagacctccgaaggggaaggggctggaggtgggtggccaagagtaaagacaagataggaactgaccgtagttttacgtggactctgagtaagggcctttcaccatcctccagacacaacgccaaagacttcactgtactactacaactagaacacgcctgagacgtcgcagacacggccgtagtacttcgtgtgacgagtagtagtaaggaaaagtagtcggtacttagggtttagttttacggttgggggtaccctaaggggtaccggtaccccggttagggtcctaccccgg

SEQ ID NO: 247608 - DNA, 815 bp, Homo sapiens
  misc_feature: GYAE6OF02JDNYG.17.28.C06.1.454.CMB.1.raw
  modified_base (307)..(307): a, c, t, g, unknown or other
  misc_feature (307)..(307): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttcctgttgctgtttagaaggtgtccagtgtgaggtccagttggttgaggtccgggggaggcctggtccagccgtgggggtccctgagactctcctgtgcagccctccggacttcccctcagtagttattggatgacttgggtccncagactccgagggagggctggaggtgggtcgaccaaacgaagtaaacgacgaaggtaagtagggaaacctgggacccggttaaggtttttaccggtacggtaacttcgttaggtgggaaacggggttcccttttacgacccgtaatcccgttaccggaaggtaacgaaccgaaacccggtacccgtaaaaggtaaacctttccgaaacctttggttaaacttaccctaaaccaaaccgttcggaaaaccctacggtacccgttaggaaccgggtaagttcccgggacgaaacggtaacccgacccggggtcccgtttaagtttaaaccgttaaccgttcggtaaacggtccggtaaaggtaacttacgggggtaaaaacggtaaaaaagggttaacgggtcggttaaccgttttaggggtttaacggtttttacggggttaccgggggtacccgtaaacggggggttaccgttaccccccgggttagggtaccccgttaaccccccgg

SEQ ID NO: 247609 - DNA, 567 bp, Homo sapiens
  misc_feature: GYAE6OF02I381B.17.28.C06.1.454.CMB.1.raw
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (447)..(447): a, c, t, g, unknown or other
  misc_feature (447)..(447): n is a, c, g, or t
  modified_base (516)..(516): a, c, t, g, unknown or other
  misc_feature (516)..(516): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtcagttggttgagtccgggggaggcctggtccagccgtggggggtccctgagactctcctgtgcagcctccggacttccccttcagtacgttattggatgacttgggtccgccagactccaggggaaggggctgggaggtgggtggccaacataaagcaagntggaactgcgtagtttacgngactctgtgacgggtccgtttacacatctcagagacaacgcaaagacttcactgtatcaacactgaacngcctagagagtcgacaggaccacgggcgttgtacttacgtggtcgacgagtatggtaaggaaaaaggtntaggcttggtagtttagtcggggacgtagggcacccgttggacctacccgg

SEQ ID NO: 247610 - DNA, 666 bp, Homo sapiens
  misc_feature: GYAE6OF02JY3WE.17.28.C06.1.454.CMB.1.raw
  modified_base (295)..(295): a, c, t, g, unknown or other
  misc_feature (295)..(295): n is a, c, g, or t
  modified_base (383)..(383): a, c, t, g, unknown or other
  misc_feature (383)..(383): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgtgctgtttagaggtgtccagtgtgaggtccagttggttgagtcggggagctggtccagcctgggggtccctgagactctcctgtgcagcctccggattcccctcagtagttatggatgacttgggtccncgtagacctccgaggggaagggctgggaggtgggtcggaccaaacgagtaaaaggccaagatagggaactggaccgtaggttttacgngggacttcgtggtggaacgggtccgtttacaccgtattccgtaccagtacgaacctaaccgaccgaaaagtacgttaccaacgttgtaacttacctaaaccgaaactggtaaaccagtacccttagggaacgtaggttaccgacgaagaacccgtaccgggtacccgttagttatttaccgtggtccgaaggagtactgggttaaacggaaaagtagtcggtacttggtttacgtttaacggtcggggaacgtacgggcgtacccggttggtaccctacccgg

SEQ ID NO: 247611 - DNA, 606 bp, Homo sapiens
  misc_feature: GYAE6OF02INRN9.17.28.C06.1.454.CMB.1.raw
  modified_base (391)..(391): a, c, t, g, unknown or other
  misc_feature (391)..(391): n is a, c, g, or t
  modified_base (415)..(415): a, c, t, g, unknown or other
  misc_feature (415)..(415): n is a, c, g, or t
  modified_base (492)..(492): a, c, t, g, unknown or other
  misc_feature (492)..(492): n is a, c, g, or t
  modified_base (512)..(512): a, c, t, g, unknown or other
  misc_feature (512)..(512): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttcctgtgctgtttagaaggtgtccagtgtgaggtccagttggttgagtcggggaggcctggtccagcctggggggtccctgagactctcctggtgcacgcctccggacttccccttcaggttagttattggtatcggtacgttggggtcccgacctagacctcccgaggggaacggggctggaggtgggtagccgaaacgataaagcaagatggaactgccgtagttacgnggactctgtgaggccgttacaccntctcagacgacaacgccaagtactcactagattaccgtaacaactgaaactacgaccttgaacgtgtcgacagaccncgggtacctgtaacgttacncggtgcgagacgtgtaagggaaaattggtagtcgttaggttagttttaaggtcggggacccgtaggggaccgtcccgttaggtccgtaccccgg

SEQ ID NO: 247612 - DNA, 650 bp, Homo sapiens
  misc_feature: GYAE6OF02JGB1A.17.28.C06.1.454.CMB.1.raw
  modified_base (391)..(391): a, c, t, g, unknown or other
  misc_feature (391)..(391): n is a, c, g, or t
  modified_base (476)..(477): a, c, t, g, unknown or other
  misc_feature (476)..(477): n is a, c, g, or t
  modified_base (486)..(486): a, c, t, g, unknown or other
  misc_feature (486)..(486): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgcttgttttagaggtgtcagtgtgaggtccagttggttgaggtccgggggaggcctggtccagccgtggggggtccctgagactctcctgtgcacgcctccggactttcccccttcagttagttattggatgacgttgggtccgccagcctccgaaggggagggctgggaggtgggtcggccaacgaataaagcaagataggaactgccgtagttttacgnggactcgtggtcggaacgggtcctttcacctatcctaccgagacgaccaacgaccaaagacttcatgtactactacaactgaacnncctgacgtntcgacacgaccgaccggtacgttgtacttacgtggtacgacggtaagtagttaggtaaacgggaaaaagtttcggtagggtaccgtttaggtttacggtttttaacgggttcgggggaccgtaagggggtacccgtaccccggttagggtaccccgttacccgg

SEQ ID NO: 247613 - DNA, 613 bp, Homo sapiens
  misc_feature: GYAE6OF02HQQBU.17.28.C06.1.454.CMB.1.raw
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
  modified_base (455)..(455): a, c, t, g, unknown or other
  misc_feature (455)..(455): n is a, c, g, or t
  modified_base (465)..(465): a, c, t, g, unknown or other
  misc_feature (465)..(465): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcacgcctccggattccccttnagtagttattggatgacttgggtccncagactccgaggggaaggggctggaggtgggtggccaacataaaagcaaagataggaactgccgtagttttacgnggactctgtgaagggtcctttcaccatctcagagacaacgccaaagaatcatgtatctaacaactacgaacncgcctagagngtcgcagacacggccttgtaatttactggtgcggtagagttaggtaaggtaaaaaagttaggtacgggtacttagggtttaggttttaggtttacggggggacctaagggggtacccggtaccccggttgggtacccttaaccccggg

SEQ ID NO: 247614 - DNA, 855 bp, Homo sapiens
  misc_feature: GYAE6OF02GG69Y.17.28.C06.1.454.CMB.1.raw
  modified_base (288)..(288): a, c, t, g, unknown or other
  misc_feature (288)..(288): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggcctggtccagccgtgggggtccctgagactcctcctgtcgcacgcctccggtactttcccccttanagttacgtttagttggatgacgtttcgggtcccgccagacctacgaaggggaacggggcgtagggaggtggggtcggaccaacaagtaaacgcgaagatacggaactcggaccggttagttttacggtggtaccgttcgttggtacgggtaaacggggtcccgttttaccgaacccgtacttcccgttacccgaaggtaaccggaaacccgaaacccggtaacccgtaaaacggttaaacctttaccctaaaccggtttacggttaaccttaacccttaaacccgtaaaccgttaacggaaaacccgtaccggttacccgtaagggaaccggtacggtaccggtaaccgaacgggaacccgtaacccggggttaccggtttaacggttaaccgttttaaccggtcggttacgggacggttaacggtacggttaagggttaaagggtaaaaaacggttacggttacgggttaacgtttagggtttaacggtttttaacggggttacggggtaacccgggtaagggggtacccggtaccccgggttacgggttaccccgttaaccccgg

SEQ ID NO: 247615 - DNA, 544 bp, Homo sapiens
  misc_feature: GYAE6OF02G8M1G.17.28.C06.1.454.CMB.1.raw
  modified_base (376)..(376): a, c, t, g, unknown or other
  misc_feature (376)..(376): n is a, c, g, or t
  modified_base (489)..(489): a, c, t, g, unknown or other
  misc_feature (489)..(489): n is a, c, g, or t
  modified_base (506)..(506): a, c, t, g, unknown or other
  misc_feature (506)..(506): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccaggggaaggggctggagtgggtggccaacataaagcaagatggaactgcgagttttacgngactctgtgaagggtcctttacaccatctccgagacgacaacgcaagaatcactgtatctacaactgaacagcctgagagtcgacagacacggccgtgtattactgtgcgagntgtaggaaaagtatggntgttagtttattcggggcagggacgccgtggctacccg

SEQ ID NO: 247616 - DNA, 604 bp, Homo sapiens
  misc_feature: GYAE6OF02HRDWC.17.28.C06.1.454.CMB.1.raw
  modified_base (375)..(375): a, c, t, g, unknown or other
  misc_feature (375)..(375): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagttagttattggatgacttgggtccgcagctccgagggagggctgggagtgggtgccaacagtaaagcaagatggaactgccgtagttttacgnggactctgtgaggtcctttcaccatctccagagacaacgccaaagatcatgtatctacatagaacagcctgaagtagcgcgaacgaccgaaccgggccgttaggtaactttaccgtggtcgacgagtatagggtaaggaaaaagttaagtagggtacttgggtttaggttttaggttacggggggtaccgtaaggggtaccggtccccggttagggtcccgtaccccgg

SEQ ID NO: 247617 - DNA, 629 bp, Homo sapiens
  misc_feature: GYAE6OF02FPBWA.17.28.C06.1.454.CMB.1.raw
  modified_base (350)..(350): a, c, t, g, unknown or other
  misc_feature (350)..(350): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggactccggccccccgactcctcatctatagaaatgatcatccggccctccggggtccctgaccgtnttctcgtggctccatgtctggcacctcacgccctccctgacccatcgaggtcgggtccctccgggtccgaggtatggacggcttagtatttacttactgtcgccgtaccgggtggactaggtactacgtccttaggtaacgttccgggttccgggttcgggtttaccggggaccgggtaacggggtacccgtacgggtccgttaccggtacccggttaccgttaacgtccgaaccggtaccccggaacgggtcccgttacccggtcccccgttacccgg

SEQ ID NO: 247618 - DNA, 593 bp, Homo sapiens
  misc_feature: GYAE6OF02GATNA.17.28.C06.1.454.CMB.1.raw
  modified_base (384)..(384): a, c, t, g, unknown or other
  misc_feature (384)..(384): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggacttccccttcagtagttattggatgacttgggtccgccagacctccgaggggaaggggctgggagtgggtggccaacataaaagcaagataggaactgccgtagttttacgnggactctgtggaagggtccgtttcaccatccaccagacgacaacgcaagaattcactgtatacctacaactgaacagcctagagacgtcgacagacacggcgtgttattactggtgacgagattggtaaggtaaaaagtagtggtacgttggttaggttttaggttcgggggacctaagggggtccgtcccggttgggtacctacccgg

SEQ ID NO: 247619 - DNA, 581 bp, Homo sapiens
  misc_feature: GYAE6OF02HM8K6.17.28.C06.1.454.CMB.1.raw
  modified_base (280)..(280): a, c, t, g, unknown or other
  misc_feature (280)..(280): n is a, c, g, or t
  modified_base (343)..(343): a, c, t, g, unknown or other
  misc_feature (343)..(343): n is a, c, g, or t
  modified_base (377)..(377): a, c, t, g, unknown or other
  misc_feature (377)..(377): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttnagttagttattggatgacttgggtccgcagactccgagggaaggggctggagtgggtgccaanataaagcaagatggaactgaccgtagttttacgnggtactctggtgaagggtcctttcgacctatctccagacgacgaacgaccaaagaacttcacttgtactctacaactgaacagcctgagacgtcgacagacgcggaccgtgtacttacgtgtgcgagataggtaaggaaaagtagtggacttaggttagtttagttcggggcctaggggtaccgtcccgttgggtcctacccgg

SEQ ID NO: 247620 - DNA, 700 bp, Homo sapiens
  misc_feature: GYAE6OF02HPR2X.17.28.C06.1.454.CMB.1.raw
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactcctcctgtgcagcctccggattccccttnagttagttattggatgacgttgggtcccnccgagcctccgaaggggaacggggctgggaggttgggtcggcccaacgataaagcaaagataggaactgccgtagttttacgtggacttcgtggtaggaagggtccgtttacacctctcctccgaggacgaaccaaccggccaaaggtaacttccacttagtaacttactaacccaatagaaaccacgcccttaggaacgtacgtccgacaacgaccgtaccgggccgttaggttaactttacccgtggtacggacctaaggtacgttaggttaaaggggtaaaaaagtgttacgggtagtttacggtttaagggttttaacggtttacggggggacccgtaaagggggttcccgtaccccggtttaggggtacccccttaaccccggg

SEQ ID NO: 247621 - DNA, 538 bp, Homo sapiens
  misc_feature: GYAE6OF02HWIP8.17.28.C06.1.454.CMB.1.raw
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
  modified_base (497)..(497): a, c, t, g, unknown or other
  misc_feature (497)..(497): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggacttcccccttcagtagttattggatgacttgggtccgcagactccagggaagggctggagtgggtgccaacataaagcaagatggaactgccgagttttacgnggactntgtgaggcgtttcacatcncagagacacgcaagatcatgtanctaacaatgaacagcctgagngtcgacgagacgacggccgtagtattacgtgtgcgtagatggtaggaaaagtntggctagttgtttagtgggcgtaggcgtccgtggtccaccg

SEQ ID NO: 247622 - DNA, 759 bp, Homo sapiens
  misc_feature: GYAE6OF02JIUJ8.17.28.C06.1.454.CMB.1.raw
  modified_base (587)..(587): a, c, t, g, unknown or other
  misc_feature (587)..(587): n is a, c, g, or t
  modified_base (634)..(634): a, c, t, g, unknown or other
  misc_feature (634)..(634): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggaggttggggctgaacttgggttttccttgttgcttgtttagaggtgtcagtgtgagtcagttggtgaggtccggggagccgtggtccaggccgtcgggggtccctgagactctcctgtgcacgtcccgtacggtcctttccccgttcagttagttattggattgtacgttgggtcccgcgacgaccttccggaagggggaacgggtcgtagggtacggttcgggggtacggacccgtaaacgtaacgtaaacggacgaaaggtagtaacgggaaacctcggtaccggtttaaggttttacggtcgtacttcgtggtaaggaacgggttccgtttaccacctacttcgtaccgagaacgtaaccaaaccggtccaaaaggtaaacttccgacgttagttactaaccgtaactaaaccgtagaaaccaggtaccctaggaacggttacnccgaacgtaaccgaaccgttccggggtccgttagttaacgtttacgngacggaacggttaacgagttaggggtaaaaacgtaaaggtacgtttcgggtaatttggtttacgggtttaggtacccggggaacgtcggggtaaccttccccggggttagtcccggttaaccccg

SEQ ID NO: 247623 - DNA, 612 bp, Homo sapiens
  misc_feature: GYAE6OF02FSCUI.17.28.C06.1.454.CMB.1.raw
  modified_base (495)..(495): a, c, t, g, unknown or other
  misc_feature (495)..(495): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgaggtccgggggaggccgtggtccaggccgtggggggtccctgagactctcctgtgcacgccctccggacttccccttcagttagttattggatgacttgggtccgccagactccgaggggaggggcgtgggaggtgggtcggaccaacgaagtaaagcaagataggaactgcgtagttttacggtggactcgtgtaggaacgggtccgtttcacctatcctccaagacgacaacgccaaagaacttcactgtactactaacaactagaacagctagagcgtccganacgacgacggtccgtagtattacgtgtcgagagtagtaggtaaggtaaaagtgtacggtcgttaggttaggtttaggttcggggacgtaggggtacgtcccgttaggtccgtacccg

SEQ ID NO: 247624 - DNA, 689 bp, Homo sapiens
  misc_feature: GYAE6OF02IQKC7.17.28.C06.1.454.CMB.1.raw
  modified_base (405)..(405): a, c, t, g, unknown or other
  misc_feature (405)..(405): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggccgtggtccaggcccgtggggggtccctgagactctcctgtgcagcccgtccggacttccccttcagtagttacttggatggacgttgggtccgccgagactccgaggggaaggggtctgggaggtgggtcggaccaacgaataaacggcaaggagtaggaacgtgtaccgtaggttttacgnggtacctcgttggtacggaaggtccgttttaccacctacttcctaccgacggagaaacccgaacggtacccgaaagtaactttaccgacttagtacgttacctaacaaacgttagaaactagcccgtaaggacgtaacgtccggacaacggaccgtaccgggccgttagttaacgtttaccgtggttagacggtagtatagggttaaacggaaaaggttaagtcggtattaggtttacgtttaggtcgggaccgtagggaccgtccgtcgggtccttaacccgg

SEQ ID NO: 247625 - DNA, 587 bp, Homo sapiens
  misc_feature: GYAE6OF02GDGRN.17.28.C06.1.454.CMB.1.raw
  modified_base (380)..(380): a, c, t, g, unknown or other
  misc_feature (380)..(380): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgagtccgggggaggcctggtccagcctggggggtccctgagactctcctgtgcagcctccggacttccccttcagttagttattggatgacttgggtccgccagacctccgaggggaaggggctgggaggtgggtgccaacataaagcaagatggaactgccgtagtttacgnggactctgtggaaggtcctttcacatctccagagacaacgccaagacttcactgtatcctaacactgaacagcctagagacgtcgacacgacgaccggccgttagtacttacgtgtcgcgagataggaacggaaaagtcgtggtaccgttgtttagtttaggttcgggggacctaagggggtacgtcccggttggtaccctacccgg

SEQ ID NO: 247626 - DNA, 615 bp, Homo sapiens
  misc_feature: GYAE6OF02HO5OG.17.28.C06.1.454.CMB.1.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcaggagggtcaccatatcttgttctggaaacagctccggcatctcaactaaactatttttcgctaggtaccagctaacttcccaggactccggcccccgactcctcatctatagaaatgatcatccggccctccggggtccctgaccgtattctctggctccatcgtctggctacctcacgcctccctgacctatcgaggtcggccgtccggtcgaggagtggaggcttaggtattacgttactggtcgaccgtaccggtgggtactcgaacctagttcccgttagaacggttcggtccgggttaggttccggggcgggaacgggtaccgtagggccgttacggaacccgttaccgtaacgtccggacggtaccccgaacgggtcccttaccggccccccgttaccggg

SEQ ID NO: 247627 - DNA, 571 bp, Homo sapiens
  misc_feature: GYAE6OF02F73WV.17.28.C06.1.454.CMB.1.raw
  modified_base (380)..(380): a, c, t, g, unknown or other
  misc_feature (380)..(380): n is a, c, g, or t
  modified_base (455)..(455): a, c, t, g, unknown or other
  misc_feature (455)..(455): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagccctccggacttccccttcagttagttattggatgacttgggtccgccggactccgaggggaggggctggagtgggtggccaacataaagcaagatggaactgccgtagttttacgnggactcgtgtgaagggtccgttcacctatctccagacgacaaccgcaaagattcactgtatctaacaactgaacngcctgagagtcgacagacacggcctagtattactgtgacgagataggtagtaaaagtagtggtacttggttgtttaggtggggaccaggggaccgtcccgtggtccaccggttccc

SEQ ID NO: 247628 - DNA, 667 bp, Homo sapiens
  misc_feature: GYAE6OF02G26EJ.17.28.C06.1.454.CMB.1.raw
  modified_base (401)..(401): a, c, t, g, unknown or other
  misc_feature (401)..(401): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggacttccccttcagtagttattggatgacttggggtccgccagacctccgaggggaacggggtcgtgggaggtgggggcggaccaaacgaataaagacgaaaggagtaggaactggccgtagttttacggngtactgtggtaggaacgggtccgtttcacctatcctcgagacgacaacgccaaagatcactgtactctaacaatcgaacngaccnggagacgtcgcaacggaaccgacgggccgttagttaactttacgtggttcgacggtaagtagttagggtaaaggtaaaaacggtagttacggggtctttgggtttaaggtttttagggtaccggggggaccgtaaacgggggtacccgtccccgggtttacgggtaccccgttaaccccgg

SEQ ID NO: 247629 - DNA, 612 bp, Homo sapiens
  misc_feature: GYAE6OF02IGR2P.17.28.C06.1.454.CMB.1.raw
  modified_base (376)..(376): a, c, t, g, unknown or other
  misc_feature (376)..(376): n is a, c, g, or t
  modified_base (508)..(508): a, c, t, g, unknown or other
  misc_feature (508)..(508): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgagggaaggggctggagtgggtgccaacataaagcaagatggaactgccgtagttttacgnggactctgtgaagggtccgtttacaccgtatctacccagaacgacctaaacgacccaaaaggtaactttccacttgtaactcctaacaactgaaaccagcctagagagtcgcagacacggcgtgtattacgngtgcgagagtaggtaaggtaaaaagtagtaggtacttggtttaggttttaacgttcgggggacccgtaaggggtacggtaccccgttgggtaccttaaccccgg

SEQ ID NO: 247630 - DNA, 656 bp, Homo sapiens
  misc_feature: GYAE6OF02GJQL4.17.28.C06.1.454.CMB.1.raw
  modified_base (392)..(392): a, c, t, g, unknown or other
  misc_feature (392)..(392): n is a, c, g, or t
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (532)..(532): a, c, t, g, unknown or other
  misc_feature (532)..(532): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtccagttgtgagtccggggagctggtccagccgtgggggtccctgagactctctgtgcagcctcggacttcccctcagtagttatggtatgacgttgggtcccgccagacctccgaggggaaggggctgggaggtggggtcgccaaacgtagtaaacgacgaaagagtacggaaacgtcgccgtaggttttacggnggacttcgtggtacggaagggtccctttcaaccgtatccgtcaagacgaaccaacgaccaagtaactcaacgttgtactactacaacgttagaacngtcctagacgtntaccgnacgacncgggtcctagttaacttcgngtcgtacgaagtacgtaggtaaggtaaaaacgttaggtgggtactttacgggtttagtttttaacggtcgggggaccccggtaagggtaccgggtttcccccctaggggttaccctaccccggg

SEQ ID NO: 247631 - DNA, 627 bp, Homo sapiens
  misc_feature: GYAE6OF02GFCAM.17.28.C06.1.454.CMB.1.raw
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaactattttgctggtaccagcaacttcccaggatccggccccccgactcctcatctatagaaatgatcatccggcccgtccggggtccctgaccgattctctggctccatgtctggccacctcacncctccctgacccatcagtcgggctccggtcgagatgagntgatttatactgtcgcaccggtgggatgactactcgtagaagtcgggttccggtggttcgggcgggacggggaccctagggccttcggtaacccgttcgtaaagtccgaccggaccccgaaggtacccgttccggacccccccgttcgggttaccctaccgtttcccgtttcccggtttaccccccggtccccctttacccgttcccgtttaccggttcccgtaaccccggg

SEQ ID NO: 247632 - DNA, 599 bp, Homo sapiens
  misc_feature: GYAE6OF02HDJY0.17.28.C06.1.454.CMB.1.raw
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggacttccccttcagtagttattggatgacgttcgggtccgccagacctccgaggggaagggctggaggtgggtggccaanagtaaagcaagatggaactgccgtagtttacgnggactcgtgtgaacgggtccgtttcacatctccagagacaacgaccaagtaacttcactgtatactaacaactagaacacgcctagagtagtcgacagaccgacggccgttagtacttacgtgtcgacgagtagtaggtaaggaaaagtagtaggtcgttaggttacgttttaggtcggggaccgaggggtacgtcccggttggtcccgtacccgg

SEQ ID NO: 247633 - DNA, 586 bp, Homo sapiens
  misc_feature: GYAE6OF02H67XE.17.28.C06.1.454.CMB.1.raw
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
  modified_base (481)..(481): a, c, t, g, unknown or other
  misc_feature (481)..(481): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgaggtccgggggaggcctggtccagccgtggggggtccctgagactctcctgtgcacgcctccggattcccccttcagtagttacttggatgacttgggtcccgccagactccaggggaaggggctggaggtggggtgccaacataaagcaagatggaactgccgtagttttacgnggactcgtgtgaagggccgtttcacctatcctccaganacaacgacaaagtaatcactgtatctaacaactcgaaacagcctagagagtcgcagacncgggccgttagtattactgtgacgagataggtaaggaaaagtagtggtacttaggttacgtttaggttcggggccgaaggggtacgcccgttggtacctacccgg

SEQ ID NO: 247634 - DNA, 826 bp, Homo sapiens
  misc_feature: GYAE6OF02IGQT1.17.28.C06.1.454.CMB.1.raw
  modified_base (273)..(273): a, c, t, g, unknown or other
  misc_feature (273)..(273): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggttttcctgttgctgttttagaggtgtccagtgtgagtccagttggttgagtcggggagctggtccagcgtgggggtcctgagactctccgtgtgcacgcctccggtacttccccttnacgttagttagttggactgtacgtttcgggtacccgctaagaccgtccggaaggggtaacggggtccgttagggaacggttcggggtacgaacccgaaacgtaaagtaaaacggacctaaggtaagttacgggaaaccttcggacccggtttaagggttttacggacggtacttcgtaggtacggaaacggggttcccctttacgaacctagttcccgacccgtaaggaacgaaaccgtaacccggtaacgtaaaacggtaacgttaccctaacgttacgttaacgttaaccgttaaaaccgtaacgttaacggaaaaacccgttcggtaacccgtaagggtaacgggtacggttaacccgggactaaccgggaaacccggtaccggggtacccgttaaggtttaaccgtttaccggttagggtaccggtaccgggtaaagtacggttacgggttaaaagggtaaaaacggttcggtaacggttcggtagttttacggttacgggtacggggtaccggtacgggtaccggtcccggttaggaccccttaccgg

SEQ ID NO: 247635 - DNA, 673 bp, Homo sapiens
  misc_feature: GYAE6OF02F9WTK.17.28.C06.1.454.CMB.1.raw
  modified_base (214)..(214): a, c, t, g, unknown or other
  misc_feature (214)..(214): n is a, c, g, or t
  modified_base (295)..(295): a, c, t, g, unknown or other
  misc_feature (295)..(295): n is a, c, g, or t
  modified_base (367)..(367): a, c, t, g, unknown or other
  misc_feature (367)..(367): n is a, c, g, or t
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgtgctgactcagccaccctcagtgtcgtgggacccccgggcaggagggtcaccatatcttgttctggaaacngctccggcatcctcaaactaaactattttgcttggtaccagcaacttcccaggactccggcccccgactcctcatctatanaatcgatcacgtccggccccgtccggggtccctgaccgtattctacgtcggctccatgtctcggacaccctnacgtccctcctacgaccatcgaggtccgggcctccgggtacggacgagtggacgtctagtactttagttacgtggttacgaccgtacgggtgggtactacggtaactacctttacccgtaggttaacgttccgggggttaccgggttcggttcgggggaccgggaacggggtaccgacgggtaccgttaccgggaaccgttccgtaaagtccgaaccgacccgtaacggcccggtcccggccccgtaccgtccgtaccgttccctcccgttaccccacccttcccgtaccttacggcccttaccgg

SEQ ID NO: 247636 - DNA, 784 bp, Homo sapiens
  misc_feature: GYAE6OF02JVK9T.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggtttccttgtgctgtttagaggtgtccagtgtgaggtccagttggttgaggtccgggggaggcctggtccagccgtggggggtccctgagactctcctgtgcagcctccggacttccccttcagtagttattggatgacttggggtccgccagtacctccgagggggaagggctggaggtgggtcggaccaactaagtaaaacgcaaaggacgtagggaaactggaccggtaggtttttaacggtcgggtaacctcgtttggtacggtaacggggtcccggttttaccaacctagtcctaccgaaggtaacgaaccgaaacccgtcccgaaaaaggtactttaacccgacgttacgttactaacccttaaaccgaaacctacgtaaaaccgtaccgtaccggtacgtaacgggtacggttccgggaacgtaacggtacccggtaaccgggggtaccccctttagggttaaccgttttaacccgtaggttaccgggtacgaaggttacggttaggtaaaggggtaaaaaagtcggttacgggtagtttagggttacggttttaagggttccgggggtacggaacccgggggttaacgtccccgggttacgggttacccgttaacccggg

SEQ ID NO: 247637 - DNA, 683 bp, Homo sapiens
  misc_feature: GYAE6OF02JHDDK.17.28.C06.1.454.CMB.1.raw
  modified_base (285)..(285): a, c, t, g, unknown or other
  misc_feature (285)..(285): n is a, c, g, or t
  modified_base (341)..(341): a, c, t, g, unknown or other
  misc_feature (341)..(341): n is a, c, g, or t
  modified_base (507)..(507): a, c, t, g, unknown or other
  misc_feature (507)..(507): n is a, c, g, or t
tcagcgtagactagcacgaccggtgctcgatttagagctcacgtattgggtttggggtagggtctcagagaggaggcttagccctggactccaaggcctttccacttcggtgatcagcactgagcacagaggactcacatggagttggggctgaactgggttttcctgttgctgttttagaaggtgtcagtgtgaggtcagttgttgagtccggggaggctggtccagcctgggggtccctgagactctcgtgtggcagcctccggattccccttcacgtagttnttggatgacttcgggtccgccacgactcccgagggtaggggcgtagggaggtgggngggtaccaacgaataaagcctaagaagtggaaactgacggtagttttacgtaggtactctggttcggaaggtaccgtttcgaccgtaactcctaccaggtaccgaacaaaccgtccaaacgaattacgaacttgtaatactaaccaatacgaaccacgacctaganacggttacgcaaacgcgtaaccgggccgttagttaacgttacgtcgttagtaccgggacgtaagtagtacggtaaaaaggttacgtacgggtacggttacggttagggtttaacgttttacggggggacccttaacgggggacggtaccccggttagggtcccggtttaaccccgg

SEQ ID NO: 247638 - DNA, 724 bp, Homo sapiens
  misc_feature: GYAE6OF02HQ5M4.17.28.C06.1.454.CMB.1.raw
  modified_base (416)..(416): a, c, t, g, unknown or other
  misc_feature (416)..(416): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcagcctccggacttcccccttcagttagttattggatgacgttcggggtccgccgaacgtacctcccgaagggggaaggggcgtgggaggttggggtacggcccaaacaagtaaaagcgaaagagtaggaactcggaccggttaggttttacggnggtaaccttcgtaggtaggtaaacggggtcccgttttacgaaccctagtcctaccgaggacgaaccaaccggaccaaaagtaattccgtaacttggtaacttcctaactaaccgtagaaaccgacgtaccgtagacgacgtaccgacaacggaaccaccgggtccgttagttaacgttactggtagaccgaagtagttacggtaaagggtaaaagttacggtaggttacgtaggtttacggttttaagggttccggggaaccggtacggggtaccggtaccccggtttacgggtacccgttaccccgg

SEQ ID NO: 247639 - DNA, 768 bp, Homo sapiens
  misc_feature: GYAE6OF02JE9GY.17.28.C06.1.454.CMB.1.raw
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgtttagaaggtgtccagtgtgaggtccagttggttgagtccgggggaggcctggtccagccgtggggggtccctgagactctcctgtgcacgcctccggattcccctcagttagttagttggatgtacgttcgggtccgccaggacctaccggaggggaaggggtcgtgggaggttggggtcggacccgaaacaagtaaaacgcgaaagagtagggaactcggaccgtaggttttacggtaggaccttgtggtaggtaacgggtccgtttacaaccgtatcctaccgaagtacgaacccgaaacgtacccaaaggtaactttacctaacgtacgttaacgttacttaaacccgaaacgttcggaaaactacgtaccccgttagaaacggtaaccgttccaaacgtacggaaccgacccgggtacccgtttggttaaactttcgtaggttacggaccgtaagtacgtttagggtaaacggaaaaacggtttaacgtcgggttacgtttaaggttacgggtttttaaacggttcgggggggtaacccgaggggttaacccgggttcccccggtttaaggggccccccttaacccggg

SEQ ID NO: 247640 - DNA, 675 bp, Homo sapiens
  misc_feature: GYAE6OF02HR5O0.17.28.C06.1.454.CMB.1.raw
  modified_base (282)..(282): a, c, t, g, unknown or other
  misc_feature (282)..(282): n is a, c, g, or t
  modified_base (636)..(636): a, c, t, g, unknown or other
  misc_feature (636)..(636): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggtttcctgttgctgtttagaaggtgtccagtgtgaggtcagtggttgagtcggggaggcctggtccagccgtggggggtccctgagactctccgtgtcgcgagccctcggacttcccccgttanagtagttattggatgacgttgggtccgccagactccgaagggtaacggggctagggaggtgggtcggaccaactaagtaaaaggccaaaggtatgggaaactcggacgttaaggttttacgtacgggacctgttaggtaggaaacggggtccggtttacaaacctgttacctaccaggaggaacaaccggtacccaaaagtaacttcaacttaggattacctaacaacgttacgaaaacgtcaccgttagacgtacgtacggcaacgaccgtaaccggtcccgtagtaaccgttatcggtatccgaagtccgtaggttaggaaaaagtaacggtaggtcgtgtttaacggtttntagggggtcccaagggtacggcccgtaggttcaacccgg

SEQ ID NO: 247641 - DNA, 577 bp, Homo sapiens
  misc_feature: GYAE6OF02JERL8.17.28.C06.1.454.CMB.1.raw
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (376)..(376): a, c, t, g, unknown or other
  misc_feature (376)..(376): n is a, c, g, or t
  modified_base (444)..(444): a, c, t, g, unknown or other
  misc_feature (444)..(444): n is a, c, g, or t
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccnccagactccgaggggagggctggagtgggtggccaanataaagcaagatggaactgccgagttttacgnggactctgtgaagggcctttcacatcctcagagacaacgccaagacttcactgtatctacactgaacngcctgagacgtcgacagacgcggccgtagtacttactggtcgcgagtattggtaaggaaaaagttagtggtacttggttaggttttaggttcgggggacctaaggggtacgtcccgttgggtccgtaacccgg

SEQ ID NO: 247642 - DNA, 616 bp, Homo sapiens
  misc_feature: GYAE6OF02HMFAM.17.28.C06.1.454.CMB.1.raw
  modified_base (388)..(388): a, c, t, g, unknown or other
  misc_feature (388)..(388): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtccagttggttgagtccgggggaggcctggtccagccgtggggggtccctgagactctcctgtgcacgcctccggactttcccccttcagtagttattggatgtacttgggtccgccagactccgaggggaagggctgggaggtgggtggccaacataaagcaagatggaactggacgtagttttacgnggactgtgtagaacgggtccgtttacacctatcctccgagacgaacaaccgaccaaagtactacacttgtactactaacaactagaaacacgcgtagagagtccgacacgaccgacgtccgtagttacgttactggtagcgagagtaggtaaggtaaaagttagtggtcgttagttaggtttaggttcggggaccggtagggtacgcccggttggtacccgtacccgg

SEQ ID NO: 247643 - DNA, 890 bp, Homo sapiens
  misc_feature: GYAE6OF02GDG5N.17.28.C06.1.454.CMB.1.raw
  modified_base (265)..(265): a, c, t, g, unknown or other
  misc_feature (265)..(265): n is a, c, g, or t
tcagcgtagactagcacgaccggtgctcgatttagagctcacgtattggggtttgggggaggtctcagagaggaggccttagccctggactccaaggcctttccacttggtgtatcagtcactgagcacagaggactcaccgatggagttggggctgtaacgtgggtttccttgttgctgttttagaggtgtacagtgtgagtcagttggtgaggtccggggagcctggtccagccgtgggggtccctgagctctcctggtcgcncgccgtccggtacttccccttcagttacgtttattggaatggaccgtttcgggggtcccgtaccgaagtacctacccggagggggtaacggggggtctaggggacgggttgggggtcgggaaccctaaacgaacgttaaaacgacgaaaggtacgtagggtaaacgtcgggaccggtttaagggttttacgggtacgggtaccttacggttagggttacggggtaaaccggggtttccccgttttaaccgaacccgttaactttccccgtaccggtaaagggtaaccggaacccgttaaaacccgggaaccctaaaacgggttaacttttaaccctaaccgttaaaggtttaacgttaaccctttaaaacccgaaccgtttaaccgggaaaactacccgggtaccctagggtaacgtaccggttaccgggacctaaacggacccgtacccgggggtaccgttaacggtttacgtttaaccgggttggtaccgggtacgttaagtacggttaggtaaacgggtaaaaaggttaggtacggttagttaacgggtttaaggttttacgggtaccgggggtaccggttaacgggggccgttacccgggttagggtccccttaacccggg

SEQ ID NO: 247644 - DNA, 649 bp, Homo sapiens
  misc_feature: GYAE6OF02HU2LD.17.28.C06.1.454.CMB.1.raw
  modified_base (380)..(380): a, c, t, g, unknown or other
  misc_feature (380)..(380): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggtttcctgttgctgttttagaggtgtcagtgtgaggtccagttggttgaggtccgggggaggcctggtccagccgtggggggtccctgaggactcctcctgtgcacgcctccggacttcccccttcagtagttattggatgacttgggtccgcagactccgagggaaggggctggagtgggtcggccaacataaagcaagatggaactgacgtagtttacgnggatctgtgaacgggtcttcgaccatctcagacgacacgaccaaagaattcactagtactactaacaactagaacacgccttaggagtactacggacaacggtaccaccggggtcttcggtaactttacgtcggtacgtacggagtaacgttagggtaaacgggtaaaaagttaacggtacgggtaccgttagggttttacgttttaaggttcggggggaccctaaggggggtaccttccccggtacggggttacccttaacccccggg

SEQ ID NO: 247645 - DNA, 638 bp, Homo sapiens
  misc_feature: GYAE6OF02F6SXM.17.28.C06.1.454.CMB.1.raw
  modified_base (391)..(391): a, c, t, g, unknown or other
  misc_feature (391)..(391): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaggtgtccagtgtgaggtccagttggttgaggtccgggggaggcctggtccagccgtggggggtccctgagactctcctgtgcagcctccggacttcccccttcagttagttattggattggacttgggtccgccagactccgaagggggaggggctgggaggtggggtggaccaacagtaaagcaagagtggaactgccgtaagttttacgnggacctcgtgtaggagggtcccgtttcacccattcctaccagacgtaaccaaacggccaaaggacttcactgtactctaacactgaacagcctagagtagtccgatagacgacggtcgttagtactttacgtgtcgacggagtagtacggtaaagggtaaaaaggttaggtgggtactttggtttacggttttaaggttcggggggtcccgaaggggttccggtccccggttgggtaccctacccgg

SEQ ID NO: 247646 - DNA, 627 bp, Homo sapiens
  misc_feature: GYAE6OF02GZW5R.17.28.C06.1.454.CMB.1.raw
  modified_base (382)..(382): a, c, t, g, unknown or other
  misc_feature (382)..(382): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagcctggggggtccctgagactctcctgtgcagcctccggattccccttcagttagttattggatgacttgggtccgccagacctccgaggggaaggggctgggaggtggggtggccaacataagcaagatggaactgaccgtagttttacgnggactcgtgtaggaacgggtcccgtttacaccctatcccgtccaagtacggaacaaccgacccgaaagtaacttccaacttagtaactactaactaaccgtagaaaccagacccgtagaagacgtcgacagaccgaccggtccgtagtacttactggtgacgagagtaggtaggaaaaaggtgtggtactggttagttttaggtacggggtccgaggggtaccgtcccgttgggtacctacccgg

SEQ ID NO: 247647 - DNA, 632 bp, Homo sapiens
  misc_feature: GYAE6OF02HDZXH.17.28.C06.1.454.CMB.1.raw
  modified_base (258)..(258): a, c, t, g, unknown or other
  misc_feature (258)..(258): n is a, c, g, or t
  modified_base (340)..(340): a, c, t, g, unknown or other
  misc_feature (340)..(340): n is a, c, g, or t
  modified_base (478)..(478): a, c, t, g, unknown or other
  misc_feature (478)..(478): n is a, c, g, or t
  modified_base (526)..(526): a, c, t, g, unknown or other
  misc_feature (526)..(526): n is a, c, g, or t
  modified_base (554)..(554): a, c, t, g, unknown or other
  misc_feature (554)..(554): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgtgctgtttagaaggtgtccagtgtgaggtccagttggttgagtccgggggaggccgtggtccagccgtggggggtccctgagactctcctgngcagcctccggacttccccttcgagtacgttattggatcgtacgttgggtccgccagacctccgaggggaacgggcgtgggnggtgggcggaccaacgagtaaagcaaggtagtaggaactggaccgtagtttacggagtacctcgtgtggaacgggtcctttaccgactactcgccagacaccaacgccaaagacttcactgtactcaacatggaaacngcctagacgtctcgcaacgcgaacggccgtaagttcttacgtgtacgngtaagtgtaggtaaacggtaaaagttcncgggtctttaggttacggttttaagggtcgggggaccaagggggttaacctccccggttagggtccccttaacccggg

SEQ ID NO: 247648 - DNA, 593 bp, Homo sapiens
  misc_feature: GYAE6OF02H1FSL.17.28.C06.1.454.CMB.1.raw
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagaggtgtccagtgtgaggtcagttggttgaggtccggggaggcctggtccagccgtggggggtccctgagacctctcctgtgcagccctccggacttcccccttcgagtagttattgggatgacttcggggtccgccagacctcccgaggggaagggggcctgggaggtggggtcggccaaacataaagcaagatggaactgccgtagttttacgngactctggtcgaagggtccgtttacactntctacagagacaacgccaaagtattcactgtatacactaatacgaacagcctagacgagtccacaagacaccggcctagtacttactgtgacgagataggtaagaaaacggtaatggtacgttgttagtttaggtcggggactaggggaccgtcccgtggtccctacccgg

SEQ ID NO: 247649 - DNA, 627 bp, Homo sapiens
  misc_feature: GYAE6OF02F7N3G.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgagtccgggggaggcctggtccagcctggggggtccctgagactctcctgtgcagcctccggacttccccttcagtacgttattggatgacttgggtccgccagctccgaggggaagggctggagtgggtggaccaacataaagcaagatggaactgccgtagtttacgtggactcgtggtgaagggtccgtttcacctatcctccaagacgaacaacgaccaaagaacttcaactgtatcctaacaactacgaacacgcctagagagtccgcaacggactaccgggaccttggtaactttacgtggtgacgtaagtagttagggtaaggtaaaaaggttaaggttggtacgttaggttaggttttaaggttcgggggacccgtaagggggacgtccccggttgggtaccttaaccccgg

SEQ ID NO: 247650 - DNA, 645 bp, Homo sapiens
  misc_feature: GYAE6OF02HU93B.17.28.C06.1.454.CMB.1.raw
  modified_base (390)..(390): a, c, t, g, unknown or other
  misc_feature (390)..(390): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgaggtccgggggaggcctggtccagccgtggggggtccctgagactctcctgtgcagcctccggacttccccttcagttagttattggatgacgttgggtccgccagacctccgaggggaggggtcgtgggaggtggggtcgccaacataaagcaagataggaactgaccgtaggttttacgnggtactcgtggtaggaacgggtcctttacacctattcctaccgagacgacgaaccgaccaaagaacttcactgtactactacaactagaactagcctagacgacgtcgacgaggaccgaccgggtccgttaggttacttacgtggtacgacgtagagttaggtaaggtaaaaagtacggtaggtacgttggtttacggttttaggtacgggggtaccgtaggggtaccggtaccccgttcgggtaccctacccgg

SEQ ID NO: 247651 - DNA, 851 bp, Homo sapiens
  misc_feature: GYAE6OF02IKFU7.17.28.C06.1.454.CMB.1.raw
  modified_base (254)..(254): a, c, t, g, unknown or other
  misc_feature (254)..(254): n is a, c, g, or t
tcagcgtagactagcacgaccggtgctcgatttagagctcacgtattgggtttgggggagcttcagctgtggtagagaagacaggattcaggacaatctccagcatggccggcttccctctcctcctcaccctcctcactcactgtgcagggtcctgggcccagtctgtgctgactcagcccaccctcagtcgtcgtcggggacccccgggcaggacgggtcaccatattcttgttctaggaaacagctccggnactctacaactaaactattttgactcggtaccagactaattcccgaggactccccggcccccgaccttcctctaatcctaagtacgtaaatcgattccacgtccggtccccgttcccggggtacctcgaccgtacttcgttcgtcggtcctcctagttcggccttcggacccttaaccctccgtacccgtaccccgtttccccgtacgtacccgtacttcgtacgggtcccgggggtacccgttacccggggtacccgggtaagggtaccgggttacgggtaacggttcccgttaggtttaaccgtttttaaacgttaccggttttcgggtacggtaccccggttaaccggggttagggaaccggtttacggtaaccttacccgggttacctttaacggggtaaccgggttttccggggttaacccgggtttacgggggttccggggacccgggggttaaccggggtacccgggtaacgggttcccggtaaacccggggttaaccccgttaaccccggtttaacgggtaccccggtacccggaacccgggtaacccgggttacccgttcccccggggttccccccgttaacccgggg

SEQ ID NO: 247652 - DNA, 870 bp, Homo sapiens
  misc_feature: GYAE6OF02J00JF.17.28.C06.1.454.CMB.1.raw
  modified_base (797)..(797): a, c, t, g, unknown or other
  misc_feature (797)..(797): n is a, c, g, or t
tcagcgtagactagcacgaccggtgctcgatttagagctcacgtattgggtttgggaggtctcagagaggaggcttagccctggactccaaggcctttcacttggtgatcagcactgagcacagacggactaccaccgtagtggtaggttcggggacttaggtaaccgttggggtttttcccttggttacgtccgttaggttttaacggaacggttcggttaccgaggttcggtacggtaacggttcccgttaagggttcggttacggacggggttacccggggggacgtacccggttacggtcccgtaccgggtcccgggttccggggggttacccctggtaaccggtacccttcgtccgttaggtccggaccgtccgtacccggttaccgggttaccctttaccccgtagtaacggttacgttacgttcggaaccgtaggttaccggttccggtacccgacgtacgtaccggttacgggggaagggtccggttggacggttacgggtcgtaaccgactaaacgtaacgaaccgagtaacgtcgtaacgtcgacggttacgttacggttacgacgtctcggtacggacgggtccgttaccacgactcgttccaagtacggacaacgtacccgaattacgtaactacgttacgtacgtaacctaccgaaacgtgacgagtacccgaggtagacggtcttaccgggaactaccgggacggtaccggttaccttaagttttaccacggggtattaccggggaggtaacttacgggtaaccggtaagtaacggttaccgngttaaccggggttacttttagggacccgggttaccgggacgtttaccggctaacccggttccgaccgttaccc

SEQ ID NO: 247653 - DNA, 715 bp, Homo sapiens
  misc_feature: GYAE6OF02H3GZ9.17.28.C06.1.454.CMB.1.raw
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtccgggggaggcctggtccagccgtggggggtccctgagactctcctgtgcacgcctccggattcccccttcagttagttacgttggatgtacgttgggtccgccagacctccgaggggaaggggcgtgggaggtggggtggacccaataagtaaacgacaaagtatagggaactggaccgtaggttttacgtggtactcgttaggtaggaacgggttcccgtttacacccgtatccctccgaagacgtaaccaaaccggacccaaaaggtaaactttaccgaacgttacgttactacctaacctaacgtagtaaaccacgaccgtaggagtaacgtcgacgaaggacccgaaccgggtccgttacgttaactttcgtggtcgcggaagacttaggtaaaggtaaaaacgttaaggtcgggttacttacgggtttagttttaagggttcggggtaccggtaaggggtacccggtcccggttacgggtacccgttaccccgg

SEQ ID NO: 247654 - DNA, 694 bp, Homo sapiens
  misc_feature: GYAE6OF02I2326.17.28.C06.1.454.CMB.1.raw
  modified_base (229)..(229): a, c, t, g, unknown or other
  misc_feature (229)..(229): n is a, c, g, or t
  modified_base (392)..(392): a, c, t, g, unknown or other
  misc_feature (392)..(392): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggtttccttgttgctgttttagaaggtgtccagtgtgaggtccagttggttgagtccgggggaggcctggtccngccgtgggggtccctgagactctcctgtgcagccctccggacttccccttcacgtagtttattgggatggtacttcgggtccgccagacctccgagggaaggggtctggaggtgggtggacccaacaataaacgcaagagtaggaactgccgtagttttacgnggacctgtgtaggaacgggtccgtttccaccgtatccgtaccgagaacgacgtaaaccgaccgaaaggtaactttaccgaacgttcgttactacctaaccctaaacgtaggaaacctcggtacccgtagaaacggtacgtacccgacacgaacccgccgggtaccgttagtacgttaaccgttggcggtaaccggtagtaagttgggtaaaggtaaaaacggttagttacgggtacttagggtttacgttttaggtccgggggacctaaggggtccctcccggttacggtcccgtaacccgg

SEQ ID NO: 247655 - DNA, 768 bp, Homo sapiens
  misc_feature: GYAE6OF02ICCHG.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggttttccttgttgcttgttttagaaggtgtccagtgtgaggtccagttggttgaggtccgggggaggcctggtccagccgtggggggtcctgagactctcctgtgcacgccgtccggtaccttccccgttcagttagttagttgggattcgaccgttcgggtcccgccacgtaccgtccgaagggggaggggtctggggaggtggggtcggaccaaacgaagtaaacgacaaaggtacgtacgggtaaactcggtacccggttaggttttaaccggtagggtaccttacggtggttacgggtaaacggggttccccgttttacgaccccgttatcccgttacccgaaggtaacgtaaaccgaaccgacccgaaagtaactttacaccgttagtaacctaacctaaccgaactagaacaacgtcctaggaacggtacgtcgacggaacgaccgtaacgggtcctttagtaacgtttacgttggacggtggtaaacgtacggttagttaaaccggggaaaattacggtaacggggtcctttagggtttaaggttttaccgggttcggggaaccggtacggggtaccggtcccggttacggtacccgttacccgg

SEQ ID NO: 247656 - DNA, 742 bp, Homo sapiens
  misc_feature: GYAE6OF02G046P.17.28.C06.1.454.CMB.1.raw
  modified_base (285)..(285): a, c, t, g, unknown or other
  misc_feature (285)..(285): n is a, c, g, or t
tcagcgtagactagcacgaccggtgctcgatttagagctcacgtattgggtttggggaggtctcagagaggaggcttagcccctggactccaaggcctttccacttggtgatcagcactgagcacagaggactcaccatggagttgggctgaactgggttttccttgttgctgtttagaggtgtccagtgtgaggtcctagttggttgaggtccgggggagccgtggtccagccgtgggggtccctgacgactctcctgtgcacgccctccggacttcccccttnagtagttattggatgtacgttgggcccgcacgacctccggaggggaacgggcgtgggaggtggggtcgacccgaaacaagtaaacgcgaaagacgtaggaactcggaccgttagttttacggtggtaccttgtacggtaggtaaacgggttccctttcaccctattccaccgaagacgaaccaacggaccaaagtaacttccacttagtaacttaccgaacctaaacgtacgtaacacgaccgttagaaggtacgtccgacgaacggtaccgaccgggtaccgttacggttaactttaccgttcggtaggtacggaacgttagttaacgggtaaaggttaaaaacggttaggttacggttaccggtttaggtttacgggttttaaggggttcccggggtaaccggggttaacggggtaaccggtcccccggtttacgggtaccccgttaaccccggg

SEQ ID NO: 247657 - DNA, 635 bp, Homo sapiens
  misc_feature: GYAE6OF02GO8VO.17.28.C06.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (259)..(259): a, c, t, g, unknown or other
  misc_feature (259)..(259): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagagggtcaccatatcttgttctggaaacngctccggcatctcaaactaaacnttttgctggtaccagcaattcccaggactccggcccccgatcctcatctatagaaatgactcatccgccccgtccggggtccctcgaccgtacttcgtctggcctcatcgtctcggcacctcacgccctccctcgaccctactcgacggttcgggccctcccgggtacgaggtactcgggacggtccttggtaacttttacttacgtgtcgacgtaccggtgggtacgttacgtacgacttccgtacgtaacggtacggttccgggttcggttacgggtcgggtacgggaccggtaacggaccggtccgtaacccggttaccgttaacgtaccgtacggacccgtaacggtaccgtcccggtacccgtaccccggg

SEQ ID NO: 247658 - DNA, 597 bp, Homo sapiens
  misc_feature: GYAE6OF02HM7E6.17.28.C06.1.454.CMB.1.raw
  modified_base (390)..(390): a, c, t, g, unknown or other
  misc_feature (390)..(390): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggttgaggtccgggggaggcctggtccagccgtggggggtccctgagactctcctgtgcagcctccggattccccttcagtagttattggatgacttgggtccgccagactccgagggaaggggctgggagtgggtcggccaaacgataaaagcaaagagtggaactcggaccgtagttttacgnggtactgtgtggaagggtccgtttcaccatctcagagacaacgcaagatcatgtatctacactagaacacgcctagagacgtcgcagaccacggccgtgtacttacgtgtcgcgagtatggtaaggtaaaaagtacgtaggtacttaggttagttttaaggttcggggaccgaaggggtacggtaccccggtggtaccgtaccccgg

SEQ ID NO: 247659 - DNA, 655 bp, Homo sapiens
  misc_feature: GYAE6OF02H8A0M.17.28.C06.1.454.CMB.1.raw
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgagtccgggggaggcctggtccagcctggggggtccctgagactctcctgtgcagcctccggacttccccttcagttagttattgggattggacctttgggtccgccagacctccgaggggaaggggctgggnggtgggtggccaanataaacgcaagatggaactgccgtagttttacgtggacttctggtgaacgggtccgtttacacctattctaccaggacgaacaaccgacgaaagaactttcactagtactcctaacaactacgaacagcctaggagacgtcgacgacgaacgaccgggtaccgtcgttaacttaccgttaggtcgacggtaggacttaggtaacgggtaaaaagtaggttagggtacttaggtttaggtttttagggttacgggggtaccggtaacgggggacggtccccggttcgggtaccgtacccggg

SEQ ID NO: 247660 - DNA, 637 bp, Homo sapiens
  misc_feature: GYAE6OF02I19WE.17.28.C06.1.454.CMB.1.raw
  modified_base (568)..(568): a, c, t, g, unknown or other
  misc_feature (568)..(568): n is a, c, g, or t
  modified_base (595)..(595): a, c, t, g, unknown or other
  misc_feature (595)..(595): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggcttaacgtggttttcgttgttgtctgttttagtaggtgtcagtgtgaggtccgtagttggttgagtccgggggaggccgtcggtccgagccgtcggggggtcccgtcgagactctcctgtgcacgcctccggtacttccccttcagtagtttagttggtagtgtacgttcggggtcccgaccagacgtacccgagggggaacggggctgggtaggtggggtcggaccaaacaagtaaagacgaagagtaggaaacgtcgtaccggttaagttttacggtaggtacctcgttggtaggaacgggttcccgttacacacttcctaccgagaagacaaccgcaaagtagttccaatgtatactaacaactcgaacagcctaggatacggtcgctaagaccgaccggtccgtagttaattccgngtgacgagtgtagtaagaaatgtggtntagttgttaggtcgggcgagggtactccgtggtacctccgtc

SEQ ID NO: 247661 - DNA, 734 bp, Homo sapiens
  misc_feature: GYAE6OF02H9MYI.17.28.C06.1.454.CMB.1.raw
  modified_base (250)..(250): a, c, t, g, unknown or other
  misc_feature (250)..(250): n is a, c, g, or t
  modified_base (577)..(577): a, c, t, g, unknown or other
  misc_feature (577)..(577): n is a, c, g, or t
  modified_base (632)..(632): a, c, t, g, unknown or other
  misc_feature (632)..(632): n is a, c, g, or t
  modified_base (644)..(644): a, c, t, g, unknown or other
  misc_feature (644)..(644): n is a, c, g, or t
tcagcgtagactagcacgaccggtgctcgatttagagctcacgtattgggtttggggtaggtctcagagaggaggcttagccctggactccaaggcctttccacttggtgatcagcactgagcacagaggactcaccatggagttggggctgaacgtgggttttccttgttgcttgttttagaaggtgtccagtgtgagtcagttggttgaggtcggggaggccgtggtccagccgtcgggggtccctgngactctcctggtcgcgacgtccgtccggtactttcccccttgtacgttagtttacgttggattcggtacgttccggggtcccgccgtacgtaaccgttcccggaagggggaacggggtcgtagggtagggttcggggtcggaccgaaacgtaagtaaaacgacgtaaagtagtacgggaactacggtaccgttaaggtttttacggacggtaccgttcgttgggttaacggacgggtttccgtttaccaccgtactccgtacgacgagaaccgtaaccgacgtaaacgtacttacgacttagtacttccaagtaacctacggaaacncgacgttaagacgttacgcggtaacgacgtacgacccggtcgtacttacgttacnggtagcgtaagnggttagaaagggtaaacgtggtacgttcgttaggtttacgttaggttccggggaacgtacggggtaccgtccgttggtacccgtacccgg

SEQ ID NO: 247662 - DNA, 817 bp, Homo sapiens
  misc_feature: GYAE6OF02HXTGN.17.28.C06.1.454.CMB.1.raw
  modified_base (278)..(278): a, c, t, g, unknown or other
  misc_feature (278)..(278): n is a, c, g, or t
  modified_base (392)..(392): a, c, t, g, unknown or other
  misc_feature (392)..(392): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagccgtgggggtccctgagactctcctgtgcagcctccggacttcccccttnagttagttattggatgacgttgggtccgccagacctcccgaaggggaaggggctgggaggtgggtcggaccaaacgataaaagcaaagagtaggaactgaccgtagttttacgnggacttcgtaggtggaaacgggtccgttttaccaaccgtattccgtaccgaaggaacgtaaccgaaaccggtacccgaaaacggtaactttaccgaacttacggttaaacttacccgttaaacctaaaccgttaacggaaaaccctaacggtacccgttaagggaaacggtaccggtaccggaaccgaaacgtaacccgggaaaccccggggtccgtttaacggttaaccttttaaccgttgggttaccggtaaccggtaaggtaacggttagggttaaaaggggtaaaaaaaacggttacgggttaacggggtaccgttttaggggttttaacggttttaacggggtttaccgggggggtaacccggtaaacggggggtacccggttacccccggtttaggggttacccccgttaacccccggg

SEQ ID NO: 247663 - DNA, 742 bp, Homo sapiens
  misc_feature: GYAE6OF02IHNYT.17.28.C06.1.454.CMB.1.raw
  modified_base (187)..(187): a, c, t, g, unknown or other
  misc_feature (187)..(187): n is a, c, g, or t
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (322)..(322): a, c, t, g, unknown or other
  misc_feature (322)..(322): n is a, c, g, or t
  modified_base (407)..(407): a, c, t, g, unknown or other
  misc_feature (407)..(407): n is a, c, g, or t
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaacttgggttttccttgttgcttgttttagaggtntcagtgtgagtctagttggtgaggtcggggagttttccnggtccagccggtgggggtccngacgctctctgtgcacgccctccggtacttcccccttanacgttaagtttattggaatggtacgtttcgggtccnccacgacctccgaagggggaagggctgggaggtgggtcgaccaaacaataaagcaaagagtaggaactgccgttaagttttacgnggtactctaggtacggtaacgggtccttttacgaccctagttccgtaccgagtaacgaaccgaacccgtaacccgtaaagtaacctttacaacgtttagtaacttaaccgtaaacctaaaccgtaaggaaaccgtaccgtccgttaggaacggtacggtaccgacgaacggaaaccggtccggtaccgtttagttaacgtttaccgtggtacgacggtaagtagttaacgggtaaagggtaaaaaacgttgggttacgggtacgtttacgggttttaggtttacgggttcgggaaccggtagggtacccggtacccggttcggtaccgtaccccg

SEQ ID NO: 247664 - DNA, 752 bp, Homo sapiens
  misc_feature: GYAE6OF02IBEGA.17.28.C06.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgcccaccctcagtcgtccgtcggggacccccgggnaggacgggtccaaccattacttcttgttcgtaggaaacngctccggntactctacaactaaacttnttttcgctaggtacagactaacttcccgaggtactaccccggccccctactcctacacttactaataagaatacgactccgtacgtcccgggtcccgttcccggggtctacgtaccgtactttccgtcgacggtcctctagtcggtctcgactacctcgaccgtcctcccgacgactcgtcggtacgggttcccggccgtacccgggtcgtaaggacgtcgggtacggtacgttacgttaagtttacgttacgtccgtacggaccgttacgggtacgggtactaccgtaaccgttaccggtccgtttaaggtcgggttcccgggtttaaccgggggttcgggtaccgggggtaaaccggccggggtaaccggttcgggtacccggttacgggtaaccccgttaaacggtcccggttaccgacccggggaaccccgttacgggttacccctcccccgggtaccccggttaccgg

SEQ ID NO: 247665 - DNA, 606 bp, Homo sapiens
  misc_feature: GYAE6OF02JG1LC.17.28.C06.1.454.CMB.1.raw
  modified_base (221)..(221): a, c, t, g, unknown or other
  misc_feature (221)..(221): n is a, c, g, or t
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (446)..(446): a, c, t, g, unknown or other
  misc_feature (446)..(446): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgagtccggggnggcctggtccagccgtgggggtccctgagactctcctgtgcagcctccggattccccttcagtagttatggatgacttgggtccgccagacctccgaagggaggggctggtaggtgggtggccaacgataaagcaagatggaactgaccgtagtttacgngctacgtgtcgaaggtccgttcacgatcnccagacacacncaagatcatgtatcaacactgaacngcctgacgtacgtcgatacgacgacggcctagttacttacgtcgtagacggtagtactagtaagggaaaaacgtaggttcggtaacgttggtttacggtttttaaggttaccgggggaccgtaaggggtaccttcccgggtggttaccccggtaccccgg

SEQ ID NO: 247666 - DNA, 625 bp, Homo sapiens
  misc_feature: GYAE6OF02G8W50.17.28.C06.1.454.CMB.1.raw
  modified_base (309)..(309): a, c, t, g, unknown or other
  misc_feature (309)..(309): n is a, c, g, or t
  modified_base (360)..(360): a, c, t, g, unknown or other
  misc_feature (360)..(360): n is a, c, g, or t
  modified_base (382)..(382): a, c, t, g, unknown or other
  misc_feature (382)..(382): n is a, c, g, or t
  modified_base (407)..(407): a, c, t, g, unknown or other
  misc_feature (407)..(407): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtagaggtccgggggaggcctggtccagccgtggggggtccctgacgactctcctgtgcagcctccggattccccttcagtagttattggatgacttgggtccncagacctccgagggaacggggctggaggtgggcgccaacagtaaagcaagngtcggactgccgtagtttacgnggactcgtgtgacggtccttcactntcctccagacgacacgcaaagtatacactgtaactctaacaacgtacgaaacacgacctaggagtacgtaccgcaacggaccgacgggtccgttagttactttacgtggtacgtaggagtacgttaggtaaagggtaaaacgttggtaaggtcgttaggttacgttttagggtacggggaccggtaaggggtaccgtcccggtggtaccctaccccgg

SEQ ID NO: 247667 - DNA, 676 bp, Homo sapiens
  misc_feature: GYAE6OF02HGJ12.17.28.C06.1.454.CMB.1.raw
  modified_base (352)..(352): a, c, t, g, unknown or other
  misc_feature (352)..(352): n is a, c, g, or t
  modified_base (415)..(415): a, c, t, g, unknown or other
  misc_feature (415)..(415): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttagaggtcggggaggccgtggtccagccggtcgggggtccctgagactctcgtgtgcgcgtccgtccggtacttccccttcgagttagttattggatgtacgttcgggtcccgccgagacctcggaaggggaacggggcgtagggnggtggggtaccggaccaaacgagtaaagacgaaaggataggactgaccggttagttttacggnggtactacgtggtacggtaacggtcccgtttacacctactcctacgagacgaccgaacgaccaagtaactctacttagtactacaactaactagaaacgacgtaccgtagacgacgtccgaacgacggaaccgaccgggtacgttacgtaactttcgtaggtcgaggtacgtagtagggtaaaggtaaaacggtggtacggtagttggttaggtttaggttcggggacgtacggggaccgttcccgtaggtccgtaccccg

SEQ ID NO: 247668 - DNA, 589 bp, Homo sapiens
  misc_feature: GYAE6OF02FV83C.17.28.C06.1.454.CMB.1.raw
  modified_base (321)..(321): a, c, t, g, unknown or other
  misc_feature (321)..(321): n is a, c, g, or t
  modified_base (388)..(388): a, c, t, g, unknown or other
  misc_feature (388)..(388): n is a, c, g, or t
tcagcgtagactagcacgaccggtgctcgatttagagctcacgtattggggtttggggaggtctcagagagggaggcttacgtcccttgggactccaaggtcctttccacttgggtgatcaggcacctgagcacagaggactcaccatggagttggggctgaactgggtttccgtgttgctgttttagaacggtgtccagtgtcgaggtccagttggttgagtccgggggagcctaggtccagcctggggggtccctggagacctctcctgtgcagcctccggattccccttcacgtagttatggatgacttggggtaccncagctccgagggacgggctggagtgggtcggtcaacgataagcgaagatggaactgccgagtttacnggactgtcgtgaacggtcgtttcacctagtcctcccgagacgacaacgccaagaacttcacctgtactctacaactgaacagcctggatgtcgatacgacacggtccgtagtattaccgtgtcgcgagtacgtgtaacggaaagttgtagggcttaggttacgtttaggttcggggactagggactcccgtgtcctacccg

SEQ ID NO: 247669 - DNA, 637 bp, Homo sapiens
  misc_feature: GYAE6OF02JHTBT.17.28.C06.1.454.CMB.1.raw
  modified_base (412)..(412): a, c, t, g, unknown or other
  misc_feature (412)..(412): n is a, c, g, or t
  modified_base (454)..(454): a, c, t, g, unknown or other
  misc_feature (454)..(454): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccgggggagcctggtccagccgtggggggtccctgagactctcctgtgcagcctccggacttccccttcagtagttattggatgtcgttgggtccgccagacctcgagggagggctggaggtgggtcggccaacaataaagacaagagaggaactgaccggtagttttacgtggtactctggtggaacggtcgtttcactntctccagacgacacgacaagaattcactgtactctacaactnaacagcctaggagtagtccgacaagaccgaccgggtctaggtttaacttacgttaggtcgacgtagtagttggttaaaggggaaaaagttagttacgggtacgtttaggttagggttttaacggttaccggggggaccgtaacggggtaaccgggtccccgttacgggttacccgtaccccgg

SEQ ID NO: 247670 - DNA, 730 bp, Homo sapiens
  misc_feature: GYAE6OF02JDVOT.17.28.C06.1.454.CMB.1.raw
  modified_base (297)..(297): a, c, t, g, unknown or other
  misc_feature (297)..(297): n is a, c, g, or t
tcagcgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctgggacccccgggcaggagggtcaccatatcttgttctgaacagctccggcatctcaactaaactattttgcttggtaccagctaattcccgagtactcccggccccccgatccctnactcctataacgaaattgatcacgtccggtaccctccggggtccctacggacccgtattccgtcgtcggctacctactggtcccgtaggtccaaccctcaacgtcccgtacccttacgaaccacgttccgacgggttcgggtcccgttacccgggttacccggaagggtacgttcgggaaccgggtcttagggtaaacttttaacgtttacctcgggttacgaccggttaacccggtgggtacgtacgaactaccgtcccgttagaacggttccggttccgggttacgggttaccggggacgggtaccggggaactcgggacgttacgggtacccctacggttagtaccggaccctaccggtaacggtccctcccgtaccccggttcggtacctaaccggttccgtttacccggttcccccgccccttacccg

SEQ ID NO: 247671 - DNA, 655 bp, Homo sapiens
  misc_feature: GYAE6OF02G2YAG.17.28.C06.1.454.CMB.1.raw
  modified_base (283)..(283): a, c, t, g, unknown or other
  misc_feature (283)..(283): n is a, c, g, or t
  modified_base (398)..(398): a, c, t, g, unknown or other
  misc_feature (398)..(398): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggattcccccttnagttagttagttggatgacgttgggtccgccagacctccgagggaaggggctagggaggtgggtggaccgaacaagtaaagcgtaagagtcggaacgtggccgtagttttacggnggactgtggtacggacgggtcccgtttacacctagtcctaccgagacgaacgaaccgaccaaagtaacttaccgactgttacttactaacctaacgtacgaacacgtaccgtgaacgaggtccgacgacggaccgaccgggtccgtcggttattacgtgtcgcgagagtaggtaaggtaaagtaagtaggtaccgtggttaggtttaggttacggggtaccggtagggtaccggtcccggttacggtcgtaccccgg

SEQ ID NO: 247672 - DNA, 605 bp, Homo sapiens
  misc_feature: GYAE6OF02HPJEP.17.28.C06.1.454.CMB.1.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (396)..(396): a, c, t, g, unknown or other
  misc_feature (396)..(396): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (513)..(513): a, c, t, g, unknown or other
  misc_feature (513)..(513): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggttttccttgttgctgttttagaaggtgtccagtgtgaggtccagttggttgaggtccgggggaggccgtggtccagccgtggggggtccctgagactctcctgtgcagcctcggacttccccttnagtagttattggatgacgttcgggtccncacgactccgaggggaaggggtcgtgggaggtgggtacggccaacgaagtaaagcgaagatcgggaactggaccgtagttttacgnggtactcgtggtaggaacgggtcctttacacctactctcagacacaacgcaaagtatcatgtatctaacactagaacngacctgaagngtcngacgacgcggcctagtagtactcgngacgtagagttaggtaacggaaagtacgtggtcgttagggttagtttaggttgggggacctaggggtaccgtccggttcggtacctacccgg

SEQ ID NO: 247673 - DNA, 721 bp, Homo sapiens
  misc_feature: GYAE6OF02FP4AT.17.28.C06.1.454.CMB.1.raw
  modified_base (138)..(138): a, c, t, g, unknown or other
  misc_feature (138)..(138): n is a, c, g, or t
  modified_base (341)..(341): a, c, t, g, unknown or other
  misc_feature (341)..(341): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccanggagttggggctgaactgggttttccttgttgctgttttagaaggtgtccagtgtgaggtccagttggttgagtccgggggaggcctggtccagccgtggggggtccctgagactctcctgtgcagccctccggacttccccttcagtagttattggatgacttgggtccgccagacctccgaggggagggctgggagtgggngaccaacagtaagacaagataggaactgaccgtaggttttacgacggtactctgtaggaacgggtccgtttacacctatcctaccaggaacgaccaaccgaccaaacgtaacttccgacttagtactaccgtaaacctaacgtacgaaacaccgtacccgttaggaacggacggttacggaccgaacggaaccgtaaccgggggtacccgttagggttaaccttttaacgtacggtacgggtacgtaagggtactttaaggggtaaacgggtaaaaaggttaacggtgggtaactttgggtttaacggttttacgggtttcggggggaacccgggttaaggggtacccggtcccgggttacgggttaccccgtaccccgg

SEQ ID NO: 247674 - DNA, 640 bp, Homo sapiens
  misc_feature: GYAE6OF02IGVV8.17.28.C06.1.454.CMB.1.raw
  modified_base (389)..(389): a, c, t, g, unknown or other
  misc_feature (389)..(389): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggattccccttcagtagttattggatgacgttgggtccgccgagactcccgaaggggaaggggtctgggagtggggtgaccaacataaagcaagataggaactgaccgtagttttacgngactcgtgtgaaggtccgtttcactactctacgagacgacaacgacaaagtactaccatagtactacctaacaacgtacgaacacgccttaggacgacgtcgacgaacgaaccgaccggtaccgttagttaacgttacgtcgtaggacgtaagagtaggtaaggtaaaaacgttgacggtagttacggtttaggttttaaggtcggggaccgtaacggggtacgtaccccggttcggtacccgtaccccgg

SEQ ID NO: 247675 - DNA, 689 bp, Homo sapiens
  misc_feature: GYAE6OF02IIQLM.17.28.C06.1.454.CMB.1.raw
  modified_base (196)..(196): a, c, t, g, unknown or other
  misc_feature (196)..(196): n is a, c, g, or t
  modified_base (423)..(423): a, c, t, g, unknown or other
  misc_feature (423)..(423): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaacttgggttttccttgttgctgttttagaaggtgtcagtgtgnggtcagttgtgagtcggggagctggtccagccgtgggggtcctgagactcctcctgtgcagcctaccggacttcccctcagttaagttagttggatgtacgttgggtcccgccaagtactcccggaagggggaacggggcgttacgggaagggttcggggtacggaccaaaacgaagtaaaaacgcgaaaagacgtaggaaaccgtggaccgttaagttttaccggnggtacgtctaggtacggaacgggttccgtttaacaacctattccgaccagaacgaaccaacgacctaaaagtaacttacaactagtaactactaacgtaaactacgtaaacacgacctagaagtagtacgcaacgaccgtacggtccgttagttaacttacgtcggtacgacgtagtaagtaggtaaggtaaaagtaagtaggtacgtaggttgtttaaggttacgggaccggtaagggtacggtcccgttacggtacctacccgg

SEQ ID NO: 247676 - DNA, 752 bp, Homo sapiens
  misc_feature: GYAE6OF02JB467.17.28.C06.1.454.CMB.1.raw
  modified_base (211)..(211): a, c, t, g, unknown or other
  misc_feature (211)..(211): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggtttccttgttgctgttttagaaggtcgtccagtgtgaggtccagttggttgngtccggggaggcctggtccagccgtgggggtccctgcgactctcctgtgcacgcctccggtaccttcccctctagttagttagttggtagtcgtacgttcgggtcccgacgacgtaccgtaccggaaggggtaacggggtcggtacggggtagggttcggggtacggtaacccgaaacgtaaagtaaaacggaaccgtaaaggtaacggtacgggtaaaccgtacggttaccggtttaacgggttttacggtacggtaccgttacgtttagggtacgggtaaccgggttcccgtttaccacccttacttccctaccgaacgaacgaaccgaaccgaaccgtaaagtaacttacgtacgttactaacttaacctaactaactacgaaccacgtaccgtaggtacgtacgtaccgacgacgaccggtaccggtaccttacgttacgttacgtgtacgagtagtagtaggtaaggtaaagtagtaggtgttaggttagtttacggtcgggacgtagggtccgtaccggttcggtacccgtaccg

SEQ ID NO: 247677 - DNA, 847 bp, Homo sapiens
  misc_feature: GYAE6OF02JOISZ.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttcctgttgctgttttagaggtgtccagtgtgaggtccagttggttgagtccggggaggcctggtcagccgtgggggtccctgagactctcctgtcgcacgccgtccggtacttccccttctacggttattagttcggattcggtacgttcggggtacccgcgacgtacccgttaccgggaggggaacgggggtcgtagggagggttcgggggtacggacccgtaacgtaaacgtaaacggacctaaagggacgttaacgggaaaccttcggtaccggtttaaacggtttttaaccgggggtggtaacctttcggtacggttacggggtaaaccgggttccccgtttttaaccgaacccgtacgtttcctacccgggaaggtaaccgtaaccgtaaacccggtaccgtaaacggttaacttaccgtaaccggttacgtttaacgttaccctaaacgttaaccgtaacggtaaaccgtaccggtcccggttaagtaaccggtaaccggttaccgaacccgacgggaaacccgacccggggttcccgtaagtttaaccgttaccgttggtaccggagtaacgtgttaacgggtaaggtaaaaggttacggtacggtacgtttaggttacggttttagggacggggtacctaacggggtaccgtaccccggttaggttacccgtaacccgg

SEQ ID NO: 247678 - DNA, 706 bp, Homo sapiens
  misc_feature: GYAE6OF02FNI1C.17.28.C06.1.454.CMB.1.raw
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaggtgtcagtgtgaggtcagttggtgaggtcggggagcctggtccagccgtcgggggtccctgagactctctgtgcacgcctccggacttcccctnagttattagtggatgtacgttgggtccnccagactacgagggggacgggcgtgggaggtggggtcgaccaaagaagtaaacgcaaggagtaggtaactcggtaccggttaaggttttacggacggtaccttcgtggtacggtacgggttcctttacacctacgtcctaccgaaggacaccgtaaaccgacaaagggttataccctaacgttagtaaccttacctaaaccacgttacgaaactcgcccttaagggacgtacggtccggaaccgtacggaaccggtcccgggtactttaggttaaccttcgtggtaccggaaggtagtaaggttagggtaaagtaaaaaggttcggttcggtacggttaggttaggttttacgggacggggaccggttaacggggcccttccggttacggttcccctacccggg

SEQ ID NO: 247679 - DNA, 815 bp, Homo sapiens
  misc_feature: GYAE6OF02HPK23.17.28.C06.1.454.CMB.1.raw
  modified_base (194)..(194): a, c, t, g, unknown or other
  misc_feature (194)..(194): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaggtgtccagtgngaggtccaggttgttggaggtccgggggaggccgtggtccacgccgtcggggggtccctgacgactcctcctgtgcacgcctccggtaccttccccttgagttagttagttggatggtacgttcggggtcccgccacgtaaccgtccgaaggggaacggggtccgttggggacggttggggtcgggaacccgaaacgtaaagtaaaacggacgaaagtagtaacgggaaccgtcgggtacccgtttaggtttttacggtacggttaccttacggttaggtacggtaacgggttcccgtttacacccgtacttacccgtaccgtaaggaaccgtaaccgaaacccggtaacccgtaaaagtaactttaccgtaacgttacgttaacttaaccttaaacccaaccgttaacgaaccgtaacgaccgttaaggaacggttacgccggtaacgaacggtaaccggtaccgggtaccggttatttaacgtttaccgtgggttacggcggtaagtgttaacgggtaaagggttaaaagttacggttaggttaccgtttagggtttaccggttttaggtacgggaccggtagggtacccgtaccgggttccggtaacccgtaccccgg

SEQ ID NO: 247680 - DNA, 794 bp, Homo sapiens
  misc_feature: GYAE6OF02IKNN2.17.28.C06.1.454.CMB.1.raw
  modified_base (187)..(187): a, c, t, g, unknown or other
  misc_feature (187)..(187): n is a, c, g, or t
  modified_base (274)..(274): a, c, t, g, unknown or other
  misc_feature (274)..(274): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgtgctgtttagaggtgtcagtntgagtcagttgtgagtcggggagctggtccagccgtgggggtccctgacgactctccgtgtgcacgccctccggactttcccccttnacggttaacgtttagttcggattcggaaccgtttggggtcccgaccccgaaggtaacccttccccggaaggggggaaaacggggggtccgttggggaagggttcggggggttaggacccccgaaaaaccgtaaagttaaaaaacgggaccgtaaaaaggtaacgttaacggggaaaaccgttcgggtaccccggtttaagggtttttaacccgggttagggtacctttccggtttagggttaagggaaaccgggggtttcccgttttaccgaaacccttattaccccgtacccgtaaggtaacgaaccggtaaacccggaccgtaaaaagtaaacctttaccgacgttagttaaacgttcctaaaaccgtaaagtacgtaaacacgtcctaggcgtacgtcgacacgaccgcggtcgtacgttattacgtgacgtcgaagattagaaggtaaaagtggaagtccgttaggttagttttagggtacggccggtaagggccgtaccgtcgggtccctaccgg

SEQ ID NO: 247681 - DNA, 680 bp, Homo sapiens
  misc_feature: GYAE6OF02HHEC5.17.28.C06.1.454.CMB.1.raw
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (384)..(384): a, c, t, g, unknown or other
  misc_feature (384)..(384): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtttccagtgtgaggtccagttggttgagtccgggggagcctggtccagcctgggggtccctgagactctcctgtncagccgtccggacttcccccttcagttagtttattggaatggacttgggtccnccagacctccgagggaaggggctggaggtgggtcgccaacataaagcaagatggaactgccgtagttttacgnggtactcgtggtggaagggtcccgtttacacccgtaagttcctacccgaaggtacgaaccgaaccggaccctaaagaaacttttccgaaccgtttgtaaccttaactaacctaaaccgttagaaaccgtaggtacccgtaggaacggacgttcccgacgacggaccgacgggtcccgtagttacttacgtgttggacgtagacgttagggtacgaaaagttacggtggtacttggttacggttttagttcgggggacctagggggtacctccccggttaggtccgtacccggtccc

SEQ ID NO: 247682 - DNA, 620 bp, Homo sapiens
  misc_feature: GYAE6OF02FKMMP.17.28.C06.1.454.CMB.1.raw
  modified_base (381)..(381): a, c, t, g, unknown or other
  misc_feature (381)..(381): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaggtgtccagtgtgaggtccagttggtgaggtccgggggaggcctggtccagccgtggggggtccctgagactctcctgtgcagcctccggacttcccctcagttagttattggatgtacttgggtccgccagacctccgaggggaaggggctgggagtgggtggccaacataaagcaagataggaactgccgtagtttacgnggactctgtagaagggtccttcaccatcgtccagacgacaacgaccaaagtaacttcaacttcgtatacctaaccaactagaaacagccgtagagacgtccgacagaccgtaccggcgttgtacttacgtgtggcgtaagtacttagggtaacggtaaaaaggtggtaggtacgttggtttagtttaagggttcggggtaccgaggggtaccggtccccgttagggtacccctacccgg

SEQ ID NO: 247683 - DNA, 766 bp, Homo sapiens
  misc_feature: GYAE6OF02JS8QG.17.28.C06.1.454.CMB.1.raw
  modified_base (337)..(337): a, c, t, g, unknown or other
  misc_feature (337)..(337): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccctggttgcttggttttagaaggtgtccagttgtgtaggtccgtagttggttgaggtccgggggaggcctggtcccagtcccgtggggggtccctgacgtacgtctccgtaggtgacacgcctccggtacttcccccttccgagttacgttattggtactgtacgttgggtccnccgagtactccggagggacgggcgttggagtgggtcggaccgaactaataaacggacaaggatacgggaactcgccggtagttttacgtcgacttcgtgtacggtaacggggtccctttagaccctatccgttaccgaagtcgaaacctaccggaccaaacgtaaacgtacgtaccgttagttaactcttaaaccgaacgtaacgtaaaccgtacgtacccttacgggaacgaaccggtttccgaacgtaacgtaaccgaccgggttacccgttagggtttaaactttaacccggttggtaacccgtacggtaaggtacgttaggtaaaaggtaaaagggttagttaccggttaggttaccgttttagggtttaaggttaccgggaccgggtaaagggtcccggtaaccgttcggtacccgttacccgg

SEQ ID NO: 247684 - DNA, 649 bp, Homo sapiens
  misc_feature: GYAE6OF02HI4FN.17.28.C06.1.454.CMB.1.raw
  modified_base (185)..(185): a, c, t, g, unknown or other
  misc_feature (185)..(185): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
  modified_base (460)..(460): a, c, t, g, unknown or other
  misc_feature (460)..(460): n is a, c, g, or t
tcagcgtagactagcacgaccggtgctcgatttagagctcacgtattgggtttggggaggattcaggacaatctccagcatggccggcttccctctcctccgtcaccctcctcactcactgtgcagggtcctgggcccagtctgtgctgactcagccaccctcagtgtctcggggacccccgggnaggagggtcaccatatcttgttctggaaacagcctccggcatctacaactaaactatttttcgctcgggtaccagcaacttcccgaaggactccggcccccatcctcatctatacgaatgatcatccggcccgtccggggtccncgacgattctcgtggctaccatgtcgtggacaccgtnacgtccctcctagacccatcgagggttcggcccgtacgggtaccgaggagtggaacgggtctaggtactttaactgtcggttcacgtaccgggngggtatcggactctcgttagacggttggtccgggttggtaccgggaggacgggaccgaggtcctacggtaccgtaccgttaaggtccgacggtacccgaagggtcccgtcccgccccggttcgtacccgtcctttccggtcccggttcccccggccctttcccgtaaaccgttcgtcccgttaaccggg

SEQ ID NO: 247685 - DNA, 813 bp, Homo sapiens
  misc_feature: GYAE6OF02INUXP.17.28.C06.1.454.CMB.1.raw
  modified_base (430)..(430): a, c, t, g, unknown or other
  misc_feature (430)..(430): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgcttgttttagaaggtgtccagtgtgagtccagttggttgagtcgggggaggcctggtccagccgtggggggtccctgagacgtctccgtgtgcgacgtccgtccggtactttccccttacgaagttagttagttggtacgtcgtacgtttcgggtccgactaggtacctccgaaggggaacgggtctgggacggtggggtacgaccaagtaagtaacggacgaaaggagtaggaaactcggtacgttaaggttttaccggnggtaaccttcggttacggtaggaacggggttcctttacgacccgttactccgttaccgaacggactaaccgaacccggtaccaaaacgttaacggttccaaccgttagtaacgttacctaaaccgaacgttacggtaaactaccggtacctacggtagaaccgtcgaccgaacgtaccggaccgggtaccggtttagtaaacgttttcggtcctaacggtaccgttaaggaacgttacggtttaaacggggaaaacgtttaaacggtcggggttaacgttttaccgggttttaggtttaaacgggggtttacccgggggaacccgggttaaacggggtacccccggttacccgggtttaccggggtaccccctttaacccggg

SEQ ID NO: 247686 - DNA, 628 bp, Homo sapiens
  misc_feature: GYAE6OF02G5QEK.17.28.C06.1.454.CMB.1.raw
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (495)..(495): a, c, t, g, unknown or other
  misc_feature (495)..(495): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgagtcagttggtgagtcggggagcctggtcagccgtggggggtccctgagactctcctgtgcagcctccggacttccccttaagtacgttattggatgacgttgggtccgccagactcccgtaagggggaacgggggctacgggaggtcggggtggacccaacgaataaaacgcaagagtacggaactgccgtaagttttacgnggtacctntggtaggaacggtccgtttcgacctatcctaccagacgacaacgccaaagacttcatgtanctaanaactagaacacgctagagacgtcgngaacgacgacggtcgtagtagttacgtgtacggcgaagtagtaggtaaggtaaaaagtaggtcggtacgttaggttagttaggtttcgggggacttaggggacgtcccggtacgggttacctacccgttcccg

SEQ ID NO: 247687 - DNA, 575 bp, Homo sapiens
  misc_feature: GYAE6OF02HEPVF.17.28.C06.1.454.CMB.1.raw
  modified_base (352)..(352): a, c, t, g, unknown or other
  misc_feature (352)..(352): n is a, c, g, or t
  modified_base (384)..(384): a, c, t, g, unknown or other
  misc_feature (384)..(384): n is a, c, g, or t
  modified_base (462)..(462): a, c, t, g, unknown or other
  misc_feature (462)..(462): n is a, c, g, or t
  modified_base (554)..(554): a, c, t, g, unknown or other
  misc_feature (554)..(554): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggacttccccttcagttagttattggatgacttgggtccgccagacctccgaggggaacggggctgggaggtgggtcggccaanataaagcaagatggaactgccgtagtttacgngactctgtgaagggtcctttcacatctccagacgacaacgcaagaactcactgtatctacaactgaacagcctagagngtcgcagaccacgggccgttagtattacgtgtagcgtagtatggtaaggaaaagtatggcttaggttgttttaggtggggtaccaggggccncccggttagggtcctacccgg

SEQ ID NO: 247688 - DNA, 619 bp, Homo sapiens
  misc_feature: GYAE6OF02J0SQ5.17.28.C06.1.454.CMB.1.raw
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
  modified_base (504)..(504): a, c, t, g, unknown or other
  misc_feature (504)..(504): n is a, c, g, or t
  modified_base (535)..(535): a, c, t, g, unknown or other
  misc_feature (535)..(535): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagagtgtccagtgtgaggtccagttggttgagtccgggggaggcctggtccagccgtggggggtccctgagactctcctgtgcagcctccggacttcccctnagtagttatggatgacttgggtccnccagctccgagggagggctggaggtgggtgaccaacagtaaacgcaaggatggaactgaccgtagttttacggnggtactcgtggtaggaacgggtccctttanaccctagtcctcgaagacgtaaccaacgtccaaagtaattccaattgtaacttacctaacaaacttagaaaccctacgaccgtgaacgtagtaccgngaacgaccaccgggtcctagttactttacgngttcgacgtagcgttagaaggtaaaagtgtcgattaggttacgtttaagtcggggtacaggggtccgtcgttcggcctacccgg

SEQ ID NO: 247689 - DNA, 785 bp, Homo sapiens
  misc_feature: GYAE6OF02GL78J.17.28.C06.1.454.CMB.1.raw
  modified_base (552)..(552): a, c, t, g, unknown or other
  misc_feature (552)..(552): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacgtgggttttccttgttgcttgttttagaaggtgttcagtgtgaggtcagttggttgaggtccgggggaggccgtggtccaggccgtcggggggtccctgagactctctgtgcacgcctccggacttccccttctagtagttagttggtatggtacgttgggtcccgccgagacctccggaagggggaaggggtcgtagggaggtggggtcggaccaaacaagtaaaggacaaggaagtacggaacgtcggtaccggttaggttttacggtcggtacttcgtaggtacggtaacgggttccctttacaaccgtacttcccgtaccgaacgaacgaacctaaaccgaccgtaaaagtactttacaccttagtaactacctaaccaaacgtacgtaaaccngtacccgtagacggtagtacccgacggtaacggaacccgtcgggtaacccgttaggtttaactttaccggtcggttcggaacggtaacggtaggttaaggttaaacggggtaaaaaacggtttgttaacggggtacgtttaacgggttttaacggtttttagggggttaccggggtacccgggtaaaggggttccccgtacccggggtttaccgggtaccccgttaccccggg

SEQ ID NO: 247690 - DNA, 667 bp, Homo sapiens
  misc_feature: GYAE6OF02FFM5O.17.28.C06.1.454.CMB.1.raw
  modified_base (275)..(275): a, c, t, g, unknown or other
  misc_feature (275)..(275): n is a, c, g, or t
  modified_base (336)..(336): a, c, t, g, unknown or other
  misc_feature (336)..(336): n is a, c, g, or t
  modified_base (386)..(386): a, c, t, g, unknown or other
  misc_feature (386)..(386): n is a, c, g, or t
  modified_base (497)..(497): a, c, t, g, unknown or other
  misc_feature (497)..(497): n is a, c, g, or t
  modified_base (551)..(551): a, c, t, g, unknown or other
  misc_feature (551)..(551): n is a, c, g, or t
tcagcgtagactagcacgaccggtgctcgatttagagctcacgtattgggtttggggaggtctcagagaggaggcttagccctggactccaaggccctttccacttggtgatcagcactgagcacagaggactcaccatggagttgggctgaactggttttcctgttgctgttttagaaggtgtccagtgtgaggtccagttggtgagtccggggaggcctggtccagccgtgggggtccctgagactctctgtgcagccctcggacttcccctnagttagttagtgtatgtacgttgggtcccgcagacctcgaggggaagggctggaggtgggngaccaacaataaacgcaaggagtaggaacgtgaccgttagttttaccggnggtacctgtaggtacggtaacgggtccctttaccgaactactcccgtaccaagtacgaacctacggacctaagtaacttccacttagtactacctaacaacgtacgtaacncgtacctagtacgtacgtacgacgacgaccgtaccgggtcgttagttacttagngtacggacggtagtaaggttaggaaaggtaaaaggttcgagggtacttggtttaggtttaaccggttcggggaccggtaaccggggctaccccggttacggtacccgttaccccgg

SEQ ID NO: 247691 - DNA, 696 bp, Homo sapiens
  misc_feature: GYAE6OF02JBW6H.17.28.C06.1.454.CMB.1.raw
  modified_base (288)..(288): a, c, t, g, unknown or other
  misc_feature (288)..(288): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgtctgtttagaggtgtccagtgtgaggtccagttggttgaggtccgggggaggccgtggtccacggtccgtcgggggtcctgagactctccgtgtcgcagccgtccggtacttccccttnacggtagtttattgggtactggtacgttcgggtccgccgagaccgtccggaagggggacgggcgtgggtacgggtgggtcggaccaacaagtaacgacaaggatacgggaaactcggtacgttacggtttacggngtaactcgttacggnggtaacgggtcctttaccacctacgttccgaccgagaacgtaaccgaaacgacccgaaacgttaacgtacaacttggtaactacttaaaccgtactagaaaccagtcctaggaacgacgtcgacaacgaccgtacgggtcgtagttaattaccgtgtacgcggtaagtagttagaaagggtaaaagtgtaggttacgtggtttacgtttagggtcggggttacgacgggtaccggttccggtacccggacgttccccg

SEQ ID NO: 247692 - DNA, 733 bp, Homo sapiens
  misc_feature: GYAE6OF02I9ROY.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggtttccttgttgctgttttagaaggtgtccagtgtgaggtccaggttggttgaggtccgggggaggcctggtccagccgtgggggtccctgagactctcctgtcgcacgcctccggtacttcccccgttctagttacgttattggatggtacgtttcgggtccgccagacctacggaacgggggaacggggctggggacggttggggtcggacctaaacaaagtaaaggaccaaggtactagggaaacgtcggtaccggttaaggttttacggtacgggacttccgtgggttaacggtaacgggttcccgtttaacacccgtagttccctccgaagtacggaccaaccggaccaaagtaacttacaccgttagtacttaccgtaacacgtaactaacgacgtacctaggacgacgtacacgaacgaaccggacgggccgttaacgttacgtacgttcggacgtaggaacgtgtaggtaaaggtaaaaaggtggtaacgggtcttaaggtttacggtttaacgggtcggggaccggtaggggaccggttcccggttacggttcccggttaacccgg

SEQ ID NO: 247693 - DNA, 939 bp, Homo sapiens
  misc_feature: GYAE6OF02HNU7M.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacgtgggttttccttgttgctgttttagaaggtgtccaggtgtgaggtcctagttggttgaggtccgggggaggcctggtccagccgtgggggtccctgagactctcctgtgcacgccgtccggtacttcccccttgagttagtttacgttggtagtgtacgttcgggtcccgccaaggacctcccgaagggggaacgggggcgtagggtagggtggggtacggaccctaaacgtaagttaaaaacggcgaaaacggtaagttacggggtaaaccttacgggtacccggtttaagggtttttaaccgggttacggtaaccgtttcgttacgggttacgggtaaacggggggttccccgttttacccgaaacccgttacgttaccccgttacccgaacgggtaaaccgaaaccgaaacccggtaacccgtaaaagggttaaacctttacccgaaacgtttgtaaacccttaaccgttaaacccgtaaaccgttaacggaaaacctaccgttacccgtaagggtaaccggtacggtaacccggtaccgaaaacgggaaaccccggtacccgggggttacccgttagtttaaacccgttttaaccgtggggtttaccggaccgggtaaaggttacggtttaagggggtaaaaagggtaaaaaaggtttaacggttaggggtaccttttaaggggttttaacggtttttacgggggttaccgggggtaaccggtaacgggggggttaacccctccccgggttaccgggggtttaacccccgtacccccggg

SEQ ID NO: 247694 - DNA, 735 bp, Homo sapiens
  misc_feature: GYAE6OF02HUKDD.17.28.C06.1.454.CMB.1.raw
  modified_base (124)..(124): a, c, t, g, unknown or other
  misc_feature (124)..(124): n is a, c, g, or t
  modified_base (219)..(219): a, c, t, g, unknown or other
  misc_feature (219)..(219): n is a, c, g, or t
tcagcgtagactagcacgaccggtgctcgatttagagctcacgtattgggtttggggaggtctcagagaggaggcttagccctggactccaaggcctttccacttggtgatcagcactgagcanagaggactcacatggagttgggctgaacttgggttttccttgttgcttgttttagaaggtgtccagtgtgaggtcagtttggttgaggtcggggnggccgtggtccaggccgtgggggtccctgacgactctcctgtgcacgcccgtccggactttcccccttcgagttagtttaattggatggtacgttacgggccgaccacgaccgtccggaaggggaagggggtcgtagggaggtcggggtacggaccaaacgtaagtaaaagacgaaagagtaggaacttcgaccgttaggtttttacggtgggacctttgtacggtaggaacgggttccttttaccgaccgtacgtccctaccgaaggaacgaaccgtaaacccgaaccgtaaaacggttaaccttaacttaaccgttggtaaacttaccttaaacctaaactaacggaaaccgtacgtaccgtagaaggtaacggttccgacgaaacgtaaccgaccgggtcgttaggttactttacgtcgtagacggtagtagtaggtaaaggtaaaagtgtaggtcttaggtttaggttggttacgggacggtaggtccgtaccggttcggtaccgtacccgg

SEQ ID NO: 247695 - DNA, 690 bp, Homo sapiens
  misc_feature: GYAE6OF02HHXYB.17.28.C06.1.454.CMB.1.raw
  modified_base (257)..(257): a, c, t, g, unknown or other
  misc_feature (257)..(257): n is a, c, g, or t
  modified_base (427)..(427): a, c, t, g, unknown or other
  misc_feature (427)..(427): n is a, c, g, or t
  modified_base (592)..(592): a, c, t, g, unknown or other
  misc_feature (592)..(592): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgtgctgttttagaggtgtcagtgtgaggtccagttggtgagtccggggagcctggtccaggccgtggggggtccctgagtactctcctgtncacgcctccggacttccccttgagttagtttatggatggtacgttcgggtacccgccacgtacctacccggaaggggaacggggcgtaggggtaggttgggggtacggaccaaaacgtaagtaaaacggctaaagacgtaggaaacctggaccgttaaggttttaccggnggtacttcgtggtacggtaacgggtccgtttacgacctagtccctaccgtagaacaaccgaaaccgccaaagtaacttcacttgtattacctaactaatacgaacgacgaccttagacgtagtacgacgaagaccgtacgggtccgtagttacttaacgtggtanacggtagtagttacggaagggtaaaacgttaagtggtacgttaggtttagtttagggtcgggacggtacgggtacgtcccggttaggtccccgtaccg

SEQ ID NO: 247696 - DNA, 847 bp, Homo sapiens
  misc_feature: GYAE6OF02IDGCP.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgtgtcttgttttagaggtgtccagtgtgaggtccagttggttgaggtcgggggacgccgtggtccagccgtggggggtccctgacgtactcctaccgtgtcgacgacgcccgtacccggtaccttcccccgtttacgacggttagtttaagtttcgggaagtcggtaacgtttccggggtcccgtaccgaacggtacgtacccggaagggggtaacggggtcgtaggggagggttggggtaccggaccgaaacgtaaagtaaacggaacgtaaagtagtaccgggtaaacgtcgggtaaccggtttacgggttttacggtacggtaacttcgtagggttacggaaacggggtttcccctttaccgaccttacgttacctaccgaaacggtacgaaacccggtaaccgaaccgaaacgttaaacgttaccctaagttacggttacttaaccgtaacgtaaactaccgaaacgtccggtaacgtaggaacgtacggtaccgtacgtaccgaaccggtccgggtaccgttaggttactttacgtcggtacggtacgtaagtaggttaacggtaaaaggttaaaaggtaggttacggttacgttcgggttttaaggtttacgggttaccggggttacggaaccggggttaccggttcccggttacccggtccggtttaaccccgg

SEQ ID NO: 247697 - DNA, 1054 bp, Homo sapiens
  misc_feature: GYAE6OF02I8G3R.17.28.C06.1.454.CMB.1.raw
  modified_base (494)..(494): a, c, t, g, unknown or other
  misc_feature (494)..(494): n is a, c, g, or t
tcagcgtagactagcacgaccggtgctcgatttagagctcacgtattgggtttggggtaggcttcagctgtggtagaagaagacaggattcaggacaatctccagcatggccggctccctctctcctcacctcctcactcactcgtgctagggtccgtcgggccctaggtctcggtgcgtcgactcacgtcccaccctctagtcgtccgtcggggaacccccggcgaacgacgggtccaactattacgtcctttacggttcctacggaaacctagtacctccggctacttaccgtacctaaaaccgttaaacttaacgttttttaggaccgttacggtaacctaccgtaacgtaaactttccccgaacggggtacctaacccggccccccccggtaaccgttcccctacctaactacgttaacgttaacgaaaactttcgggaacttcctaaacgttcccggggacccccggttaccccgggggttacccccgnttttaccggtacccgttacggttaccgttcccttaccgggtacgtttccccgacggttaccggttacccgttccgggacccttaccccggttacccctaaccgggtaccccctacccgttaccggtaacccgtacgggttaccccgtaaccggggttacccggggaaccggttacccgggttacccgggtaaacgggggttaccttacgggtaaacggtttaccggttttaacgggtaacggttttaccggttaaccgtttaccgggtttacggggtaacccggtttaacccgggttaacgggttaacccggtttccgggtaaaaccggttaaccggtttcccgggttaaccgggtttaaacggttcccgggggttaaccgggttacgggggtttaccccggggaccgggggttaaccggggtaaccccgggtcccgggttaacccggttaaaccgggttacccccggttaacccggttaacccgggtaacccggtaacccgggtttaacccccgggtaaacccccggggttaccccggttacccgggtaacccccccgg

SEQ ID NO: 247698 - DNA, 673 bp, Homo sapiens
  misc_feature: GYAE6OF02H6G1U.17.28.C06.1.454.CMB.1.raw
  modified_base (566)..(566): a, c, t, g, unknown or other
  misc_feature (566)..(566): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggaggttggggctagaacgttgggtttttccttgttgtcttgttttaagaggtgtcctagtgtggacgtccgagttggttaggacggtccggggagccgtggtaccaggtcccgggtcgggggtcctaggacgtactctccgtgtcgcacgtccgtccgtacttcccctgagttagttagtgatgtacgtcggtccgcgagaccgtcgacgggaggcgtaggtaggtggtcggaccaacgtaaagtaacgactaagtgtacggtaacgtcggtaccgttaggttacgcgactgtcgtaggacggttaccttcgactagtccgtacagactacgacgacaagtactcgagtgtactactacaacgtgaacgtcgcagagtcgtagaccgtagaccgtacgccgttagtactcgtagtacgacgtaacgngtaacggtaacggtaaagtcggtacggttagtttacggttaggtttaacgggttggggaacccgggttaacggtccccggttacccggttccggtaacccttcccgg

SEQ ID NO: 247699 - DNA, 710 bp, Homo sapiens
  misc_feature: GYAE6OF02JJZQC.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttcctgttgctgtttagaggtgtcagtgtgaggtcagttggtgaggtcggggagcctggtccagccgtgggggtcctgagactctcctgtgcacgcctccggacttcccctcagtagttagttggatgtacgttggtccgctagcctcgagggaggtctaggaggtgggtcggaccaacgtaagtaaacgacgaaacgtagtacggaaactcggtacccgttaaggttttaccgggaggtaccttcgttcggtaacgggtaaccgggttcctttaccgacctacttccgtaacctaaggaacgtaaccaaccggtaccgaaacggttaaacttccgtaacgttacgtttaacgtaccttaaacctaacgtaacgtaaacgtacgtacccgtacgtaggaccgttaccggacgacggtaccgacccggtacgttagttacgttgtacggtcgacggtacgtagtaggtaaggtaaaagtaggtaggtacgttggtttagtttacggttacggggaccggtacgggtaccgtcccggttcggtacccgtaccg

SEQ ID NO: 247700 - DNA, 655 bp, Homo sapiens
  misc_feature: GYAE6OF02GOPLO.17.28.C06.1.454.CMB.1.raw
  modified_base (185)..(185): a, c, t, g, unknown or other
  misc_feature (185)..(185): n is a, c, g, or t
  modified_base (268)..(268): a, c, t, g, unknown or other
  misc_feature (268)..(268): n is a, c, g, or t
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
  modified_base (480)..(480): a, c, t, g, unknown or other
  misc_feature (480)..(480): n is a, c, g, or t
  modified_base (501)..(501): a, c, t, g, unknown or other
  misc_feature (501)..(501): n is a, c, g, or t
  modified_base (559)..(559): a, c, t, g, unknown or other
  misc_feature (559)..(559): n is a, c, g, or t
  modified_base (612)..(612): a, c, t, g, unknown or other
  misc_feature (612)..(612): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggtttccttgttgctgttttagaaggtntccagtgtgaggtcctagttgggttgaggtccgggggaggcctggtcccaggccgtggggggtccctgagactctcctgtgcngcctccggacttccccttacagtagttattggatgtacgttgggtccnccgagactaccgaggggaacgggctgggagtgggtgaccaanagtaaagcaagagtacgggaactcggccgtaaggttttacgtacgggtacttcgtgtaggtacggggtcctttaccgacctatccctacaggacgaacaacgacccaaaggaacttcacgtntacgttactaacgactagaancgttacctgacgtgtaccacgaagaccggaccggtaccgttcgttaattccgtgtcgngtagattacgaagggtaaaagtacgtagggtacttaggttaggttttaacggnggggtaccggagggtaccggtccgttacgggtcccgttacccg

SEQ ID NO: 247701 - DNA, 710 bp, Homo sapiens
  misc_feature: GYAE6OF02IK3CC.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgtaacttgggttttccttgttgtctgttttagaggtgtcagtgtgagtcagttggttgaggtccggggagccgtggtccagccgtgggggtccctggacgactctcctgtgcagccctccggacttccccttcgagttaacgttattggattgacgttcgggtccgccacgacctcccgaggggaaggggcgtagggaggttggggtcggaccgaaacgtaagtaaaacggacaaaggagtacgggtaacctaaccggttaagtttttaccgggtacggtaccgttcgttaggtacggtaacgggtcccgttttaccacccgtacgttccgttacccgaaggtaccgaaccgaacccgtacccgaaagtaacttactaaccgttgttaactccgtaaccaaccgttacgaaccttacgtaccgtagaacgacgtccgaccagaccgacggtaccgttgttaacgttacgcgtagacgtagtagtagtaagtaaaagtagtacggtagtgttacgttaggtaccgggccgtaggggtaccgtcgtacgggtccgtccgtccc

SEQ ID NO: 247702 - DNA, 789 bp, Homo sapiens
  misc_feature: GYAE6OF02GA3WP.17.28.C06.1.454.CMB.1.raw
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggccctagtctgtnctgactcagcccaccctnagtgtccgtcgggacccccggntaggcggtcaactgttactcgttgttcaggtaaacagcctaccggactattccgaactaaactaactatttttacggcgttacggtaaccagtcctaacttcccgaaggtcctcccggaccccccgtacttcccgtactacttacctaagtaaacgtaagtgtaactccggtaacggttccccgggtacccccggttccccgggggtcccttacggtaacccgtactttcctaccggttcggtacctcgttaacgttggtccgtacggtaccctacccggttacacccggttccctacccgtacgacctacgtacgtaacgggtccggtaccgtacccgggtccgtaaggtacggtacggtacgtacgttacgttacgtttacgttaacggttcgtacggtaccgtacccgggttaggtacggttacgaccgttaacgtaccggttaaagggttaccggtttccgggtaccgggttcgggttaccggaggggtaccggtaccggtaacggtccgttacccggtaccgttacggtaaccgtcggacgacccggtacgacccggttccgtccccgtaccgg

SEQ ID NO: 247703 - DNA, 789 bp, Homo sapiens
  misc_feature: GYAE6OF02FU77P.17.28.C06.1.454.CMB.1.raw
  modified_base (188)..(188): a, c, t, g, unknown or other
  misc_feature (188)..(188): n is a, c, g, or t
  modified_base (232)..(232): a, c, t, g, unknown or other
  misc_feature (232)..(232): n is a, c, g, or t
tcagcgtagactagcacgaccggtgctcgatttagagctcacgtattggggtttggggaggattcaggacaatctccagcatggccggcttccctctcctcctcaccctcctcactcactgtgcagggtcctgggcccagtctgtgctagactcagccaccctcagtgttccgtcggggacccccggntagtagggtcaccatatcttgtctggaaacagctccggctatcncaaactaactgtttgcgtggtaccagctaactccaggatcccggcccccgactcctacattctaacgtaataaactgaactcacggtccccggtccccgggttcccgggtccgtacgtaccgttacttacggtcggtcggtaccctatacgggttccgtacggttacggaccttacccgtacgggaccttccccgttccgtaaccgtaacctacggttacgaggggttccgtacccggttacccggtacggggtaacgacggtacggtcgggtacggtacggtttaaatttaccgtttacgtacgtaccgtacccggtacgggtaggtacgtacgtaaccgtacggttacgttaacggtaacggttccgggttacggttacgggttccggggaacgggtacgggtaccgacggttacggtaacccgtacgtaacccggtagtacccgtaccgaccggtaccggccttaccccgggaccctttacggtaaccctttaccgttcccgtacccgttcccctccccggttacccttcccggtacgttacccggttaccggg

SEQ ID NO: 247704 - DNA, 766 bp, Homo sapiens
  misc_feature: GYAE6OF02IV5WK.17.28.C06.1.454.CMB.1.raw
  modified_base (254)..(254): a, c, t, g, unknown or other
  misc_feature (254)..(254): n is a, c, g, or t
  modified_base (613)..(613): a, c, t, g, unknown or other
  misc_feature (613)..(613): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcgttgttttagtaaggtgtccagtgtgaggtcaggttggttggacggtccggggagccgtggtccagccggtcgggggtcccngacgtctcctccgtgtcgcgacgtcccgtccggtacctttccccttacgtaggttagttacgttggagttcgtaacggttcggcccgacacggtaccgtacggaagggggtacgggcgtgggtagggtggggtcgaacctaaagtaacgtaaacgacgaaggtacgtacggtaacgtcggtaccggtttaggttttaaccggtggtacgttcgtgggtacggtaaccggggttcccttaacgacctcttacctaccgtaaggacgaacccgaaacgaccgtaaaataccttcgaacttgtaaaccttacaaaccgaagttaacgaacgtaaccggtacgttaccgaaggtcctaccggngaaccggtaaccgtcggtacccgttaattacggttacgttgggtcgtaaaggataacgttagggttaaaacggtaaacgtggttacggtcgtttaaggttacggttcggggtacgggtacgaccgggtcgtaaccggtcggttacccgtaccg

SEQ ID NO: 247705 - DNA, 805 bp, Homo sapiens
  misc_feature: GYAE6OF02H3V4U.17.28.C06.1.454.CMB.1.raw
tcagcgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctcgggaccccgggcagagggtcaccatatcttgtctggaaacagctcggcatctacaacgtaaactatttttacgctaggtaccagctaattccccaggactccggccccccgactccctacatctaataagaaactgactcatccggcccgtccggggtccctcgtaccgtacttcctcgtggcctccattcgtcgtaggccaccctacgacgtccctacccgtacgacctactccgaggtccgggtacccgttacccggggaccggaagggtacgttacgggacggtaccgtaagttaccgttttaacgttaacgttccgggtacgtaacccggttacccggggttagggtaacttaccgggaacctaaccgttcccggttacggttaacgttcggggtttacccgggtttacgggtttaccgggggacccgggttaaacgggggcccgaaaccggggttcccgttaacgggtacccccggtttaaccggtaaccgggttacccgaacccgggaaccccggtaaggggttccccgttacccccgggtacccccggttaccggggttacccacccgttttcccccggtttccgtttaccccccccgacccgttttaacccccgg

SEQ ID NO: 247706 - DNA, 941 bp, Homo sapiens
  misc_feature: GYAE6OF02I0YWK.17.28.C06.1.454.CMB.1.raw
  modified_base (222)..(222): a, c, t, g, unknown or other
  misc_feature (222)..(222): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccaaaatggagttggggctagaacgttgggttttccttggttgtcttgtttagtaaggtgtccagtgtgaggtcgtagttggttggnggtccgggggacgcgtggtccgagccggtcgggggtcccgtgacgacctcctccgtgtgcgacgcccgtccggtaccttccccttacaaggtttagttagttaggtacgttaggtaccggttcggggtacccgtaccggaacggtaacccgtaccccgggaaagggggggtaacgggggtcggttacgggggtaaggggttcgggggtaccgggaacccgaaaacgaaaacgtaaaaaggaccgtaaagggtaacggttaacgggtaaccgtacggggtaccggtttaaacggttttaccggggttagggtacccgtttacggttacgggttaacggggtaacgggggttacccctttaccgaaaccctttaccgtaccgtaacccgtaaggaacccggtaaaccgaaacccgaaccgtaaaaacgttaccgtttacgtaactttgtttaaaccgtaccgtaaacctaaaaccggtacgtaaacgtcccggtaaccgttaagggaacgtaccggtccggaacgaaccgtaaccggtaccggtcgttaaaccgttacgtttcgggtaagtggtaaaccgtaagttaaggtaaggttaaaagggtaaaagttacgggttaggtacgggttttaggtttacgggtttttaacggggtacccgggggttaacggtacccgggtaccgggtttaaccccgggttcgggtacccccgttacccgg

SEQ ID NO: 247707 - DNA, 827 bp, Homo sapiens
  misc_feature: GYAE6OF02F2DYN.17.28.C06.1.454.CMB.1.raw
  modified_base (699)..(699): a, c, t, g, unknown or other
  misc_feature (699)..(699): n is a, c, g, or t
  modified_base (706)..(706): a, c, t, g, unknown or other
  misc_feature (706)..(706): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttggttttccttgttgcttgtttagaagtgtcagtgtgaggtcagttggtgaggtccggggaggccgtggtccgacggccggttcggggggtccctgacgacctctccgtgtgcgacgcccgtccggtaccttccccgttacgtagttacgtttagttggtagttcggtacgtttcggggtcccgccgtagtaccgtacccggaaggggggaacggggtacggttcggggagggttcggggggtacggaaccccgtaaaacgaacgttaaaaggacgaaaaggtagttaacgggtaaaccgttacggtaccggtttaagggtttttacggtacgggttacttcgttagggtacggtaacggggttacccgtttaccgacctacttcccgtaaccgaaggtaacgaacccaaaccggtacccgaaaagttaccttctacgttaacgttacttacctaaacctaaccgtacggaaacgtaccgtccgttacggacgtacgtcccggaataccgggacctacgggtaccgttaggttactttaccggnggtacgngtaacggttagtagggtaaaaggttaaaaggttcggtaggttcgttaggttttacgggttttaacgggtcggggaaccggtagggggtaccctcccgggttttaggccccgtttaacccgg

SEQ ID NO: 247708 - DNA, 700 bp, Homo sapiens
  misc_feature: GYAE6OF02H7YN7.17.28.C06.1.454.CMB.1.raw
  modified_base (251)..(251): a, c, t, g, unknown or other
  misc_feature (251)..(251): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (476)..(476): a, c, t, g, unknown or other
  misc_feature (476)..(476): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
tcagcgtagactagcacgaccggtgctcgatttagagctcacgtattgggtttgggggagcttcagctgtggtagagaagacaggattcaggacaatctccagcatggccggcttccctctcctcctcaccctcctcactcactgtgcagggtcctcgggcccagtctgtgctgactcacgcccaccctcagtgtcgtccggggaccccgggcaggtacgggcacattactctttgttaccgtaggaaacncgtccgtaccggctactcgtaacaaaccttaaactagtttttcgccgtaggtaccacgactaaacttccgaacggtacgtccccggccccccgttactccctacacttactaactagtaaacgtntaactntacggtcccggtccccgtcccgggggtctaccggaccgtacttccgttcgtcgtccgttaccgatttcggtcgttaccaccgttaccacgtccnccccgttctaccgaacctacgtacgtggtaccgggtccgttccgggtaccggagtaggcggtacgtcgtagtaactttacgtacgttcggttacgcgtacgggngtacncgtacgacttcgtacgttaggtacggtccggttggtccggggacggacggtccgcggtacgaccgttaccgaactttacggacgacccacggaccgtcgtcccggtacccgtccg

SEQ ID NO: 247709 - DNA, 691 bp, Homo sapiens
  misc_feature: GYAE6OF02G1YLD.17.28.C06.1.454.CMB.1.raw
  modified_base (265)..(265): a, c, t, g, unknown or other
  misc_feature (265)..(265): n is a, c, g, or t
  modified_base (429)..(429): a, c, t, g, unknown or other
  misc_feature (429)..(429): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtccagttggttgaggtccggggagcctggtccagccgtggggggtccctgagactctcctgtcgcngccctccggactttccccttcagttagttattggattgacgttgggtccgccagcctccgaggggacgggcgtgggaggtggggtcgaccaacagtaaagctaaaggataggaactcgaccgttaggtttacgtggactcgtgtacggacggtccttcaacctntcctcaagacgaaccaacgaccgaaagtacttacacgttagtacttactaactaactagaaccacgccctaagacggacgttccgacaacggaaccgacggtaccgttagttaaccgttacgttggttacgacggtaacgtagttacgggtaaaggtaaaaacggtttaggtacggttacgttagggttttacggtttaagggttaccggggtaccggtaaggggtacccggtcccggttacgggtacccgttaaccccggg

SEQ ID NO: 247710 - DNA, 806 bp, Homo sapiens
  misc_feature: GYAE6OF02GXHP5.17.28.C06.1.454.CMB.1.raw
  modified_base (292)..(292): a, c, t, g, unknown or other
  misc_feature (292)..(292): n is a, c, g, or t
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgtgctgactcagccaccctcagtgtctcgggacccccgggcaggtagggtccaccatactcttgttcgtaggaaacagctccggcatctacaactaaactattttgctcggtaccagactactcccaggtactccggcccccgactcccncactctagtaataaatgtatcacgttccggaccccgttcccggggtccctacggtaccctattcctcgtacgggtcccttcctaacgttgtccgttggaccctaccctacgaaccgtccccgttacccctacggtaccccgacttacggtaacggttccggggtcccgtacccggggttaccgacggggtaacgtcggggtaaccggccgtttaaggttaacgttttaacgtttaccggttacgggtcggtacccgtaacgggttacgggagttaaccggacgtacctttccgtaagggttaacgttccggggtttccgggttcgggttaccggggaccgggtacggggtacccgtacgggtaccgttaccggtaccgttaacccggttaagtcccgtaaccggacccggtacggacccgttcccggtacccccgttcggtacccgttaccttacccgggttcccttcccccgggtcccctttaccccgtaccgttacccgtaccgtacccggg

SEQ ID NO: 247711 - DNA, 686 bp, Homo sapiens
  misc_feature: GYAE6OF02HNMIA.17.28.C06.1.454.CMB.1.raw
  modified_base (185)..(185): a, c, t, g, unknown or other
  misc_feature (185)..(185): n is a, c, g, or t
  modified_base (221)..(221): a, c, t, g, unknown or other
  misc_feature (221)..(221): n is a, c, g, or t
  modified_base (457)..(457): a, c, t, g, unknown or other
  misc_feature (457)..(457): n is a, c, g, or t
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgtgctgactcacgccaccctcagtgtcgtcgggacccccgggnaggacgggtccaaccatatctttgttctaggaaacngcgtccggcactctacaaactaaactattttcgctggtaaccagctaacttcccgaggactccggaccccccgtacttcctaccattactagtaacgaaagttcaatcacgtcccgggtccccggttccggggttcccacggtaccgtactttctcgtcggtcctctagttcgtctcggtccacctcgccgtcctccgacacctatcgaggtcggtcccgtaccggtcgacggtgngtacgtcgtagttaagttactacgtggtacgaccgtcggtagggtactacgtactacttcgttagtacgttcgggttccggttggtacgggaccgggtacggccgtaggtccgtaccggtaccgttactaacgcgtaccgaccggtaacggccgtcccggtcccgacggttccctaccgttccgttcccgtccccgtacccgttccgtacctaccggttacctaccggg

SEQ ID NO: 247712 - DNA, 623 bp, Homo sapiens
  misc_feature: GYAE6OF02FTU7W.17.28.C06.1.454.CMB.1.raw
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
  modified_base (471)..(471): a, c, t, g, unknown or other
  misc_feature (471)..(471): n is a, c, g, or t
tcagcgtagactagcacgaccggtgctcgatttagagctcacgtattgggtttgggtaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggacttccccttcagttagtttattggatgtacgttcgggtcccgccagacctccgagggggaagggcgtagggaggtgggtggaccaanataaagcaagatggaactgcgtagtttacgngtactntggtggaacggtccgttcacnctctccagacgacaacgacaagtattcacgtntactactaactaactgtaaacncgaccgttgacgtagtacgcaacggacaccggtccgttagtacgtttacgtgtcgagagtagtggtaaggaaaagttgtaggtcgttaggtttagttttaggttacggggtaccggtaacggggtaccgtccggttacggtccgtaccccgg

SEQ ID NO: 247713 - DNA, 849 bp, Homo sapiens
  misc_feature: GYAE6OF02FZKGM.17.28.C06.1.454.CMB.1.raw
tcagcgtagactagcacgaccggtgctcgatttagagctcacgtattgggtttggggaggtctcagagaggaggcttagccctggactccaaggcctttccacgttggtgatcagcactgagcacagaggactcaccgatcggagttcggggcttgtaactgggttttccttgttgtctcgttttagaggtgtccagtgtgaggtccaggttggttgaggtccggggagtcctggtccagtccgtgggggtcctgacgtactctccgtgtagccgagtccgtcgtacttccccttacgtaagttagttactggtactagtacgttcggtccgccgtagtaccgtccggtaaggggaacgggggtctacgggagggtacggggtccgggaacccaaacgtaacgtaaaaggctaaaaggtacgtttaacgggaaccgttacggtaccggttaaacgggttttacggtacgggtaacctttaccggttaggtacgggttaaaccggggtacccttttcgaaacccgttcgtaccctaccggaaacgtacggaaacccgtaaaccggacccgtaaaaggtaacttttcgaaaccgttcgtaacttaacccgtaaacgaaccgttacgtaaacgtcccgttaccggtaggttaacgtaccggtacggaaccaaaccgggtaccgtacccgggtaccgttacgttaaacgtttacccgtgtaaccgtccgggttaaagtacgggtacggtaaaaggtaaaaacggttcgtaacggacggtttgtacgggtttttaacgggcgggaccggttaacggggacccgtttacccggttcgggtaccccgttacccccg

SEQ ID NO: 247714 - DNA, 1016 bp, Homo sapiens
  misc_feature: GYAE6OF02IF5PX.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggagcctggtccagccgtggggggtccctggagatcctcctgtcgcacgcctacccggtacttcccccttgaggttaagtttcgttagggattcggtaacgtttcggggtccccgaccgacggtaacccgttcccggaagggggaaacggggggtccgttagggggaacggttcggggggttccggaaccccttaaaacgaaacgttaaaaaacggggccctaaaaaggtaacggttacgggtaaaacccgtcggttaaccccgggttttaacgggtttttaaaccggggtcggggtaaacccgtttccgttaaggggttaccgggtaaaaaccggggggttttcccccttttaaacccgtaaacccggtaaaccctttcccgttaacccgggaaaggtaacccggttaaaacccggaaacccggggtttaaaacccaaaacgggtaaaacccttttaaaccgtaaccgtttaaacggtttaaacctaaccggtttaaacccaaaccgttacgggtaaaaaccctaacggtccccgttaagggtaaccgggtacgttaccgggaaccgaaaccgggaacccggtaaacccggggccggttttaaaccggttaagttttaaccccggtagggttaggaacccggttaagggtaaacgttagggggtttaaaacgggaaaaaacgttacggttacggggttacgtttaacgggttttcggttttaaacgggtttaccgggggtaccgggttaaccggggaccgggtttacccccggttcgggttaacccccgttcccccggg

SEQ ID NO: 247715 - DNA, 843 bp, Homo sapiens
  misc_feature: GYAE6OF02GMBWL.17.28.C06.1.454.CMB.1.raw
  modified_base (210)..(210): a, c, t, g, unknown or other
  misc_feature (210)..(210): n is a, c, g, or t
  modified_base (285)..(285): a, c, t, g, unknown or other
  misc_feature (285)..(285): n is a, c, g, or t
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgnggtccgggggaggcctggtccagccgtggggggtccctgagactctcctgtgcacgcctccggacttcccccttntagtagttattggtatggtacgttgggtcccgccaacggactcccggaagggggaacgggggcgtggggaggttgggggtacgggacccaaacgaagttaaaaacggccgtaaaaggtaacgtacgggtaaaccgttcggtacccggttaaaggggttttttaaccgggtcgggtacctttacggttagggttaagggtaaccgggggttcccgttttacccgaacccgttaattccccgtacccgaaagggtaacccggtaaaccgaaaacccgggtaacccgtaaaaaggttaaacctttaccgaaaccgtttgttaaactttacccgtaaacctaaaccgttaacgaaacgtaccggtcccgtaggaacgtacggtaccgacaacggtaaccggcccgggtaccgttaggtttaaccgtttagttcggtacgacgggaagttacgtagggttaaacgggaaaaagggtttaagttacgggtacgtttggtttaggttttacgggttcgggggaccgtaacggggtaccgtccccggttggtaccccgttacccgg

SEQ ID NO: 247716 - DNA, 669 bp, Homo sapiens
  misc_feature: GYAE6OF02H7HHQ.17.28.C06.1.454.CMB.1.raw
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
  modified_base (484)..(484): a, c, t, g, unknown or other
  misc_feature (484)..(484): n is a, c, g, or t
tcagcgtagactagcacgaccggtgctcgatttagagctcacgtattggggtttggggaggtctcagagaggaggcttagccctggactccaaggcctttccacttggtgatcagcactgagtcacagaggaactcaacccatggagttggggctgaactgggttttcctgttgctgttttagaaggtgtccagtgtgaggtccagttgtgaggtcggggaggctggtcagccgttgggggtcctgagactctcctgtgcacgcctccggacttccccttnacggttagttagttggatgtagttcgggtccnccgtaggacctaccggaggggagggtcgtaggacggtggggtcgaccgaactaagtaaacgctaagagtacggtaactcgtacgttagtttacgtgtactacggtagtacggaacggtccgtttacactactcgtacgagacgaacgaacgctaaacgacttactacgtanactactacaactagaacacgtcgagtacgaacgtccgacgtacgaccggacggtaccgtagttaaccgtacgtagtacgtcgaacgtagttacgaaacgggttaaaagtcgtacggtaacgttgtttaaggttcgggtacgggaccggtacgggcccgttaaccggttacggaccgtaaccccgg

SEQ ID NO: 247717 - DNA, 716 bp, Homo sapiens
  misc_feature: GYAE6OF02HKH77.17.28.C06.1.454.CMB.1.raw
  modified_base (266)..(266): a, c, t, g, unknown or other
  misc_feature (266)..(266): n is a, c, g, or t
  modified_base (326)..(326): a, c, t, g, unknown or other
  misc_feature (326)..(326): n is a, c, g, or t
  modified_base (354)..(354): a, c, t, g, unknown or other
  misc_feature (354)..(354): n is a, c, g, or t
tcagcgtagactagcacgaccggtgctcgatttagagctcacgtattgggtttggggaggtctcagagaggaggcttagccctggactccaaggccctttccacttggtgatcagcactgagcacagaggactcaccatggagttggggctgaacgttgggttttccttgttgtcttgttttagaaggtgtccagtgtgaggtcctagttggtgaggtccggggacgccgtgtccagtccggtgggggtccctgacgactctcctngcacgcccgtccgtaccttccccttacagttagttagttggatcgtacgttcgggtcccnccagacctccgaagggggaacgggtcgngggtaggtgggtcggaccaacgtaagtaaaacgacaaagtgtacggaacttcggacgttacgtttacggacgttacttcgtaggtacggtacgggttccgttacaacctgttacctacgaaggtacaaccgaccgtaacaaagtacttaaccagttcattaccaaacgtaactcgaaacgtcgtacctaacgagtcgtaccgaagtaccggaaccgtccggggtaacttagttaacttacggtccggtacacgggtaataagttaacgggtaaaggtaaaacgttaaggttggtaccgttttagggttagttacggggttacgggaccggtaaggggttactcccgggtcgtacccgttacg

SEQ ID NO: 247718 - DNA, 904 bp, Homo sapiens
  misc_feature: GYAE6OF02HHYAF.17.28.C06.1.454.CMB.1.raw
  modified_base (187)..(187): a, c, t, g, unknown or other
  misc_feature (187)..(187): n is a, c, g, or t
tcagcgtagactagcacgaccggtgctcgatttagagctcacgtattgggtttggggaggtctcagagaggaggcttagccctggactccaaggccctttccacttggtgatcagcactgagcacagaggactcaccatggagttggggctgaacttggttttccttgttgtcttgttttagaggtntcagtgtgagtcctagttggttgacggtccggggagcctcggtccaggccggtcggggggtccctgacgtactcctcctggtcgccacgtccctaccggtacctttccccgttagtacgttagtttagttggatcgtacgtttcgggcccacgacgtacctaccgggaggggaacgggtcgtagggtacggtcggggtaccggaacccgaaataaagtaaacggaacgaaaggtaacgttacgggaaccgttcggtaaccggttttacgttttacgggaggttaccttacggttaggttaacggggtaaccggtttacccgtttacccgtaacccgtacgttaccctaccggaaggtaaccgaaccgtaaacccgaaccgtaaagttaaccttacctacggttactaacttacctaaaccgtaaccgtaggtaaaccgtaccggtacccgttaagggtaaccgtacggtaacccgtaccgtaaaccgggtaaccccgggtaccggtaccggttttacgtttaacccggttttaagtccggggttaccggaaacgggtttaaggttaagggtacgggtaaaaaccggtttaaaaggtttaacgggtcggtttaccgggtttttaagggtttacggtttttaaacggggggtccgggttaaacccccgggtaggggttacccccggtacccgggtttttacggacccccgttacccggg

SEQ ID NO: 247719 - DNA, 843 bp, Homo sapiens
  misc_feature: GYAE6OF02FN6SK.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgtcttgttttagaaggtgtccagtgtgaggtctagttggttgaggtccggggagccgtggtccagtccgtcggggggtccctggagactcctcctgtcgcacgtcctccggtaccttccccttctagttagtttagttaggtagttacgtaccgttcgggtcccgccgtacgaccgtaccggacgggggaacgggtcgtaggggtaggtggggtcggacccgtaacgaaagtaaacggacaaagagtacggaactcggaccggttaagtttaccggtaggtaccgttcgtggtacgggtaaccgggttcccgtttaaccgacccgttactacccgtaccgtaacggtaaccgaaaccgaaacccggtacccgaaaagttaaactttacccgtaacgttacgtaaccttaaccgttaaaccctaaacgttaacggaaaccgtaaccggtcgtaacggacggtacggaccgaaccgacggaacccggtaccgggttaaccggttacgtttaacgttaaacggttcggtacggaaccggtaaggtaacgttagggtaaaacgggttaaaaaggttacggttacggtaggttttaggtttaaccggtttttagggggtaccgggttaccggtaacggggtacccgttcccggggttaccggttacccgttaccccggg

SEQ ID NO: 247720 - DNA, 775 bp, Homo sapiens
  misc_feature: GYAE6OF02JVZHK.17.28.C06.1.454.CMB.1.raw
  modified_base (258)..(258): a, c, t, g, unknown or other
  misc_feature (258)..(258): n is a, c, g, or t
tcagcgtagactagcacgaccggtgctcgatttagagctcacgtattgggtttggggaggtctcagagaggaggcttagccctggctccaaggcctttccacttggtgatcagcactgagcacagaggactcaccatggagttggggctgaactggttttccttgttgctgttttaggagtgtcagtgtgagtcctagttggttgacggtccggggaggccgtgccaggccgtgggggtccctgagactctctgtgcngtcctccggtacttccccttgagttagtttattggaattcgtacgtttcgggcccgtaccgtagtaccgtaccggaggggaacgggtcgtgggtaggtcggggtccggaccaaacggtaagtaaaaggccaaaggtacgtacggaacgtcggtaccggtttagggtttaccgtaaggtcctcgttaggttaagggtaccgggttacgttccgaaccttagttccccgtaacacggtacgtaaccgaaccgtaccggaaacgttaacttaactacgttacgttacgttacgttaaccgaacctaggtaaacctaccgaccgttacgacgtaaccggtcgaaccgacgtaaccgaccggtacgttccgtaagtttaccgtgtacggtaccgtaagtaccgttaaggtaacgggtaaaacgttaaacggttcggttacgttaaggtttaacggttttggttaacccgggttacggtaaccggggtaaccgccccgggtttacgggttacccttaccccgg

SEQ ID NO: 247721 - DNA, 750 bp, Homo sapiens
  misc_feature: GYAE6OF02HQB59.17.28.C06.1.454.CMB.1.raw
  modified_base (258)..(258): a, c, t, g, unknown or other
  misc_feature (258)..(258): n is a, c, g, or t
  modified_base (644)..(644): a, c, t, g, unknown or other
  misc_feature (644)..(644): n is a, c, g, or t
  modified_base (671)..(671): a, c, t, g, unknown or other
  misc_feature (671)..(671): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaacgttggttttccttgttgcttgttttagaggtgtcagtgtgagtctagttggtgaggtcgggagccgtgtcagccgtggggtcctggacgactctcgtgtcgcacnccgtcggtacttccccttgacgttagttattaggatcgtacgttcggccgacacgtacctaccggaaggggacgggtcgtagggtaggtcgggcggaaccaacgtaaacgtaaacgacgaaaaggtagtacgggtaaactcggtaaccgtttagggttttaaaccggacggttaccttgttaggttacgggtaacgggttcccgttttacaaccctaacgttccgtaccgaagtaacgtaaacctaaccggtaaaccaaagttaacgttacccaaagttgtaaactactaaacctaaagtacgaacgtacgaccgtagtaacgacgtccgaacgaaacggtccggaaccggtccgtaattacgttaaccgtgtaacggacggttanaaggttacggtaaaaggtaaaaggttntacgggtatttaccgggtttagttaacggggtggggtaccccgtgggtaaaccgtcccggttagttacccggtacccgg

SEQ ID NO: 247722 - DNA, 820 bp, Homo sapiens
  misc_feature: GYAE6OF02JFCYP.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaacttgggttttccttgttgcttgtttagaaggtgtccagtgtgaggtccagttggtgacggtcggggagcgtggtcagccgtggggtccctgagactctcctgtgcacgccgtccggacttccccttcgagttattagttcggatcgtacgttcgggtcccgaccacgtacctcccgaagggggaacgggtcgtagggtaaggtcgggggtacggaccctaaaacgtaacgtaaaaggaccgtaaaagtacgtaacggtaaccgtacggaacccggtttaaggtttttaccggtaacggtaccgtttacgttacgggtaagggtaaaccggggttcccgttttaacccgaaaccctaacgttacccgtacgaaggaacggaaccctaaaccggaccctaaaaggtaaccttaccgtaacgttagttaaccttaccaaaaccgtaacgtaagaaaccgtacgtaccgtaggacgtaacgtccgaacgtaaacggaacccgacgggttcccgttaagtttaaccttaccggtgttaccggaaccgaagttaagttaaccgggttaaaggaaaaacgtttaagttacggtcggttttaagtttaacgggttttaggaaccgggggtaccctaagggggtaccgtacccccggttaggtacccgttaacccgg

SEQ ID NO: 247723 - DNA, 701 bp, Homo sapiens
  misc_feature: GYAE6OF02F6RE4.17.28.C06.1.454.CMB.1.raw
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagtgggctgaacttggtttcttgtgctgtttagaggtgtccagtgtgaggtcctagttggttgaggtccggggagctggtccaggccgtcgggggtcctgagactctctgtncagccctacggacttcccctcagttagttattgagtgtacgttgggaccnccgacgacctccggaggggagggtcgtaggggacggttggggacgaccgaaacgtaagtaaacgtaaccaaaggagtacggtaaccgtacggtacccggttagttttaacggtggtacctgttaggtacggaacgggttccctttaccgactactcctaccgaagacgtaaccgaaccgaccgtaaataacgttacctacgttacttatacctaaccgtaaacttaaccgaacgacgttacgtacggtacgaacgtcgacgaacgggaccgtaccggtaccgttacgttacttacgtgtacgacgtagtacgtaggtaaggtaaacgttagtacggtagttagtttaggtttagggttcggtacggtaacggtcggtaccgttcggttaacccgtcccg

SEQ ID NO: 247724 - DNA, 740 bp, Homo sapiens
  misc_feature: GYAE6OF02GYVT3.17.28.C06.1.454.CMB.1.raw
  modified_base (412)..(412): a, c, t, g, unknown or other
  misc_feature (412)..(412): n is a, c, g, or t
  modified_base (575)..(575): a, c, t, g, unknown or other
  misc_feature (575)..(575): n is a, c, g, or t
  modified_base (583)..(583): a, c, t, g, unknown or other
  misc_feature (583)..(583): n is a, c, g, or t
  modified_base (589)..(589): a, c, t, g, unknown or other
  misc_feature (589)..(589): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggtttccttgttgctgtttagagtgtccagtgtgagtcagttggttgacgtcggggagctggtccaggccgtgggggtccctgacgacctctcctgtcgcacgtccctccggactttcccccttgagttacgttagttcggatcgtacgttcgggtccctaccgagtaccgtccggaagggggtacggggtctgggtacgggtcggggtacgtacccgaaacgtaataaaacggcctaaaggtaatacgggtaaacncggtacccggtttaaggttttaccggtacgtaccgttcgttacggtacggtacgggttaccctttccgacccgttagtcccgtaccgtaagaccgtaaccgtaacccgaccgtaaagtaacttcggtaacctgtaaccgtactaacacgtagaactcgcgtanaggtaccncgtacngaccgtcggtccgttagttacgttgtcgtacgtagtacgtaggtacgtaaaggtaaccgtggtttaccggtagttccggtttaggtttaccgggtacgggtaccggttaagggtccccggtttaaccgtccggggttaaccctttcccggg

SEQ ID NO: 247725 - DNA, 704 bp, Homo sapiens
  misc_feature: GYAE6OF02HDZS0.17.28.C06.1.454.CMB.1.raw
  modified_base (286)..(286): a, c, t, g, unknown or other
  misc_feature (286)..(286): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggttgaggtccgggggaggcctggtccagccgtggggggtccctgacgactctcctgtgcacgcctccggacttccccttnagtacgttattggatgtacgttgggtcccgccgagacctccgaggggaacgggctgggaggtgggcggaccaacaagtaaagcgaaagataggaactgaccgtagttttacgtagacttcgtgtaggaacgggtccgtttacaccgtatcctaccgaaggaacgaaccgaacgtacccgaaaggtaaactttaccgtacgttagtaacttactaacctaactacgaaacgtacgccgttaggacgtacgtaccgacgtaacgaacccgaccgggtccgttagttaacgtttacgtgtacggaccgtagtacgttagggtaaagtaaaaaggttacggtaggttacgttacggtttaggttttagggttccggggtaacgtacggggtaccgtccccggttaggtaccccgttacccgg

SEQ ID NO: 247726 - DNA, 990 bp, Homo sapiens
  misc_feature: GYAE6OF02JDTVU.17.28.C06.1.454.CMB.1.raw
tcagcgtagactagcacgaccggtgctcgatttagagctcacgtattgggtttggggaggtctcagagaggaggcttagccctggactccaaggcctttccacttggtgatcagcgactgagcacgaggaggactcacagtggtaggttgggctagtacgaaacggtttttacctgtttgtacgtgtttacgaaggtgtccgaggtcgtagtaggttcgaggttcgggtggcggaacggggtaggtcctgggtccgtacggtccgtagggggtccctgtacgtcgttcgtccgtgtcgccgtacgtcccgttccggactttaccccgtttacgtaggtaaggttacgttacgggtacgtcggaccgttagggtcccgtaccggaaggtaccggtcgtaaacggggtagggtcgtacgggtaacggtacggtacggaaccgtaaacgtaagtaaacggtccgtaaacggtaccgttacgggtaaacccgttcggttacccggaggttttaaccggtcgggtaaaccggttccggttaaacgggttccggttaaacgggtaccccgttttaccgtaaaccccgaacgttacccggtaaccggtaaacccggtaaaccgggtaaccgtaaaaccggtaacccgtttaaaccggtaaaacgtttacccgttaaaccgtaaccgttaaaccgttaaacccgttaaaccgtaaaacccgtacggtaaaccgtacggtaaccggtacggtaacggtaccgtaaccgggtaccgttaaaccggtaaccgtaaccgggttaccgttaacggtacgtttaaccggtaagggttaacgtaaaacgggttaacggtaaaccgggttaaggttaaacgggttaaacggttaacggttaaccccgggggttacttaacgggggtttaccgggttaccggttacgggggtacccgttaaccgggggttaccgttaccccggttacggtacccggttaacccccgg

SEQ ID NO: 247727 - DNA, 650 bp, Homo sapiens
  misc_feature: GYAE6OF02GLRQJ.17.28.C06.1.454.CMB.1.raw
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
tcagcgtagactagcacgaccggtgctcgatttagagctcacgtattggggtttggggaggattcaggacaatctccagcatggccggcttccctctcctcctcaccctcctcactcactgtgcagggtcctgggcccagtctgtgctgactcagccaccctcagtgtcgtcgggacccccgggcaggagggtcaaccatatcttgttcgtaggaaacagctccggcatctacaaactaaaactattttgctggtaccagtacaacttccgaggtactcccggacccccgtactcctctatctaataagaaactgatcaagtccggcccctccggggtccctcggaccgtattctcgtcggctcctatgtctacggcacctcacgtccctcctanaccatcgacgtgggcctccggacgtagntcgagctagtatttactacgtgtcgaccgtaccggtggtatacgtactactcgtagtaagttcggttccgggttggttcgggacgggtacggaaccgcggtcgtacggtaccgttaacgaacgtcgaaccgacccgtaaggtccgtcccggtccccgtccgtaccgttaccctccggtttaccgttacccccttacccgtttcttacccgtaccgttaccttaccgg

SEQ ID NO: 247728 - DNA, 765 bp, Homo sapiens
  misc_feature: GYAE6OF02FU9SQ.17.28.C06.1.454.CMB.1.raw
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgaggtcggggaggcctggtccaggccgtgggggtccctgagactctcctgtgcacgccctccggtacttccccttcagttacgttattgggtatggtacttgggtcccgcctacgacctccggaagggggaacggggcgtacggggaggttcggggtcgggaccaaacgtaagtaaaacggccgaaaaggtagtacgggaaacgtccggtaccgttaagggttttttacggtcggtaccgttcgttaggtacgggtaaacggggtcccgttttaccacccgtacttaccgtacccgtaaggacgtaccaaaccggaccctaaaaggtaacttttccgaaacgttcggtaacttaaccctaacgaaaccgttagaaaaccgtacgtacccgtaggaacggaccgttcggaacaggtaaccgacgggtcccttaaggttacgttacgtgtacggacgagttcgtaaggtaaacggaaaagttcggtagttcgttaggtttacggtttaggtacggggtccggtaagggaacccgttccggttagggtccccttaccccg

SEQ ID NO: 247729 - DNA, 880 bp, Homo sapiens
  misc_feature: GYAE6OF02F10B3.17.28.C06.1.454.CMB.1.raw
  modified_base (188)..(188): a, c, t, g, unknown or other
  misc_feature (188)..(188): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
tcagcgtagactagcacgaccggtgctcgatttagagctcacgtattgggtttggggaggtctcagagaggaggcttagccctggactcccaaggcctttccacttggtgatcagcactgagcacagaggactcaccatggagttgggactgaacttgggttttccttgttgtcttgttttagaggtntcagtgtgaggtcaggttgttgaggtcggggagcctggtcacgccgtgggggtcctgatactctcctggtcgacncgccgttccggtacttccccgttanacgttagttaagttggtagtcggacgtttcgggtacccgacctacggtacctaccggaagggggtaacggggtcgtcggggtaacggttcggggtaccggaccgaactaaagtaaacggtaccgaaaggacgtaacggaacgttcggaccggttaaggtttaccggacgtacgtttcgtaggtacggaaacggggttccctttaccgaacgttacgtacccgttaccgaggtaaccgaaccgtaaaccggacctaaacggttactaccgtttaactacggtaacctttaaccgaaccgttaaaccgtaaccggtaaacgtaccggtaacccgttacggaaacggtaccgttaacccgaacggtaaaccggaacccgggttacccggggtaaacggtttaccggtttaaacgttttaacgggttcccggtttaccggtaaccgggtaagttaacgtttaagggttaaaccgggttaaaaacggttacgggttagggttaccgttttaagggtttacggtttttaacggacgggggtttacccgggaacgggttaccggtaccccggggtttttacggacccggttacccccgg

SEQ ID NO: 247730 - DNA, 769 bp, Homo sapiens
  misc_feature: GYAE6OF02JYMNC.17.28.C06.1.454.CMB.1.raw
  modified_base (273)..(273): a, c, t, g, unknown or other
  misc_feature (273)..(273): n is a, c, g, or t
tcagcgtagactagcacgaccggtgctcgatttagagctcacgtattgggttttggggaggtctcagagaggaggcttagccctggactccaaggcctttccacttggtgatcagcactgagcacagaggactcacatggagttgggctgaacgttgggttttccttgttcgcttgtttagaggtcgtccagtgtgaggtcagttgttagacggtccggggagccgtggtccacggccggttgggggtccctgacgtacttctacgtgtgacncgtccctccgggtaccttccccgttgaacgttagttagtcggactgtacggttcggtccgccgaacgtaccgtacggaggggtaacgggtcgttacgggtaggttcggggtcggtaaccaaacgtaaacgtaaaacgacgaaaaggtaacgtacggtaaaccgtacggtaccggttaacggttttaacggtacggttaccgttcggtagggttaacggtaacgggttacccgtttaaccgaacccgttaccgtacccgtacgacgtaacggaaacccgtaaccgaaccgtaaaagtacttaacgtaccgtacttaactaacccgtacaactaacgaactacgctacgagtacgacggacgagaacctaccggacgttacgttacgttagttcggcgtacgtagtaacggttagtaaaaggtaaagtaacggttggaaccgtttgtaggtttacgggcgggttacgaacggtcggttcccggtacgtaccgtacccg

SEQ ID NO: 247731 - DNA, 788 bp, Homo sapiens
  misc_feature: GYAE6OF02IF453.17.28.C06.1.454.CMB.1.raw
  modified_base (199)..(199): a, c, t, g, unknown or other
  misc_feature (199)..(199): n is a, c, g, or t
  modified_base (267)..(268): a, c, t, g, unknown or other
  misc_feature (267)..(268): n is a, c, g, or t
  modified_base (288)..(288): a, c, t, g, unknown or other
  misc_feature (288)..(288): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggtttttccttgttgcttgttttagaggttgtccaggtgtgnggtcctaggttggttgaggtccgggggagctggtccaggccgtcgggggtccctgagactctctgtcnncgcctcggtacttccccttncgttattagtggatcgtacgttcgggtaccgccacgtaccgtcccggaaggggaacgggggtcgtagggtagggtggggtacgaccaacgaaagtaaacgacgaaagtaagtacgggtaactcggaccgtttaaggtttttacggtacggtacgttcgtttaggtacgggtaccgggttacccgttttacgaaccccgtaattcccgttaccgacgggttaaacgaacccgtaaacccggaaccgtaaagttaaaccttaccgaacgtttacgttaaaccttactaaaccttaaaccgtacgtaaaccgaaccgtccgttaaggacgttacgaccgtacgtaaccgaaccggtaacccgggtaccgtttattaaccggttttaccgcgggttaacggccgtaagtacgttaaggtaaaggtaaaacggtagttcggtacttggttttaaggttagggttcggggacggtaggaccggttacccgttggtacccctacccg

SEQ ID NO: 247732 - DNA, 714 bp, Homo sapiens
  misc_feature: GYAE6OF02IU27C.17.28.C06.1.454.CMB.1.raw
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (192)..(192): a, c, t, g, unknown or other
  misc_feature (192)..(192): n is a, c, g, or t
  modified_base (269)..(269): a, c, t, g, unknown or other
  misc_feature (269)..(269): n is a, c, g, or t
  modified_base (381)..(381): a, c, t, g, unknown or other
  misc_feature (381)..(381): n is a, c, g, or t
  modified_base (686)..(686): a, c, t, g, unknown or other
  misc_feature (686)..(686): n is a, c, g, or t
tcagcgtagactagcacgaccggtgctcgatttagagctcacgtattggggtttggggaggtctcagagaggaggcttagccctggactccaaggcctttccacttggtgatcagcactgagcacagaggactcaccatggagttgggctgaactgggtttccttgtgctgtttagaggtntccgngtgtgnggtcctagttggttgaggtccgggggaggcctggtccaggccgtggggggtccctggacgacgtcctccgtgtgccncgccctccggtcttcccctgagttagttagttgatgacgttggccgaccacgactaccgagggaacgggtcgtagggaggtcgggtcggacaacgaagtaaacgcgaaaggngtaggaaacctcggaccgtagttttacgacggttactacgtcggtaggtaacgggtccctttacgaaccgtatacccgtacaagtacgtaccaaacgaccctaaagtaaccttagaacgttcgtactaacctacgaactacgaacgttaacgccgtagagacgtcgacgacgaccgtaccggtccgtagttaacttacgtcgtagtccggtaagacgtttaggtaagggttaaaaacgttaggttacggtacggttacggtttttacggtttaaggtttccggggaaccggtacggggttacccnccccgggtttaggtacccgttacccggg

SEQ ID NO: 247733 - DNA, 850 bp, Homo sapiens
  misc_feature: GYAE6OF02F0YLK.17.28.C06.1.454.CMB.1.raw
  modified_base (288)..(288): a, c, t, g, unknown or other
  misc_feature (288)..(288): n is a, c, g, or t
  modified_base (425)..(425): a, c, t, g, unknown or other
  misc_feature (425)..(425): n is a, c, g, or t
tcagcgtagactagcacgaccggtgctcgatttagagctcacgtattgggtttggggaggtctcagagaggaggcttagccctggactccaaggccttccacttggtgatcagcactgagcacagaggactcaccatggagttgggactgaactggttttctgttgtctagtttagaagtgtcagtgtgaggtcctagttggtgagtccggggagcctgtccagccgtgggggtccctgagacctcgtcgtcgtgcgtaagccgtaccggacttttaccccccgttanaaggttagtttaacgttgggtaacttaggtacggtttcggggtacccgtcccaaggaacctacccgaaagggggtaaacgggggcgtacgggtaggtacgggggtacggtacccgaaaacgtaaagtaaaaaccggngtaaaaacggacggttaacggaaacgttaccggtaccgggttaagtttttaaccgggtagggtaacccttacgttacggtaacgggaaaccggggttacccgttttacgaaaccccgtacttacccgttaaccgaaacggtaacggaaaaccccgtaaaacccggtacccgtaaaaacggtaaaccgtttaccgtaaaccgttacgtttaaacgtaacctaaaccgtaaacgttaacggaaaccacgtaccgtaggaacgacgtaccggacgaaacgaaccgtacgtaaccggtagttaacgttaacctggtaccgaggtaacgtgtttaaggaacggtaaaaaagttacgagggttactagttttaacgggtttagtacgggggtacccaaggggttacccgtaccgtacggtccgtaacccgg

SEQ ID NO: 247734 - DNA, 677 bp, Homo sapiens
  misc_feature: GYAE6OF02JHIIM.17.28.C06.1.454.CMB.1.raw
  modified_base (179)..(179): a, c, t, g, unknown or other
  misc_feature (179)..(179): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgactggtttctgtgctgtttagaggtgttnagtgtgaggtctagttggttgaggtcggggagcctggtccagccgtgggggtccctgagactctcgtgtgcagccgtcggacttcccctnacgtgttatgatgacttgggtccncagacctccgaggggaacggtctggaggtgggtcggaccaacagtaaagaccaagacgttaggaactcgaccggtaacggttttacggaggtcttacgtgtacgggtaacggtccgtttacaaccgtacgtcctaaccgagtaccgaacgaacccgaccgtaaaaggtaacttctaaacgttgtaacttaccaacgtaactacgggaaaccaaccgtccttaaggacgtaccgtacggacaaccgggaaccgtaacccgggcggttttacgaacgtttttacgtcggtacggtacgaagtacggttaggtaaaggtaaaaacgtcgtaggtcgttaggttacgttagggtcgggacggagtcgtcccggtaggtccctaaccgg

SEQ ID NO: 247735 - DNA, 710 bp, Homo sapiens
  misc_feature: GYAE6OF02FKOQM.17.28.C06.1.454.CMB.1.raw
  modified_base (171)..(171): a, c, t, g, unknown or other
  misc_feature (171)..(171): n is a, c, g, or t
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
tcagcgtagactagcacgaccggtgctcgatttagagctcacgtattgggtttggggacgcttcagctgtggtagagaagacaggattcaggacaatctccagcatggccgcttccctctcctcctcaccctcctcactcactgtcgctagggtcctgggcccagtctgtnctgctctacgcccaccctcagtcgtctcgggacccccggnaggacggtcaccgatactcgtttntcgtaggaactcgtcctccggctactcgttacaaaccgttaaactcgtttttgccgttacggacctaacgtccgtaaccgttacccgtacggtaaccggtccccgtaccccccggtaacctcccttcgaaacgttcgtaagttaacgtaaaacttcgacgtaccgtacgtacccgggttcccccgtaacccgggttccgtaaccgtaccgtactttcgtaccgtacggcttcgtacgtgtccgtcgaccctcctcgtacctcctaccgtctacgtactcgtagtcgccggtcgtacggtacgtggtacgcgtacgtagtacgttataccgtgtaccgtacgacggtacgtacgtacgtacgtaccttgtacgtacgtcggttccgggtcgttccggagggaccggacgtcgaccgttaccggtacgttccgtaaccgtagacccggaccgtactccgtcccgtacccgtacccgg

SEQ ID NO: 247736 - DNA, 840 bp, Homo sapiens
  misc_feature: GYAE6OF02FT55T.17.28.C06.1.454.CMB.1.raw
  modified_base (209)..(209): a, c, t, g, unknown or other
  misc_feature (209)..(209): n is a, c, g, or t
tcagcgtagactagcacgaccggtgctcgatttagagctcacgtattgggtttgggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccgggnaggacgggtccaccatatcttgttctaggaaacagcctcccggctacgtcctacaaaccttaaactatttttcgacgttacggtaaccagtacctaacttcccgaggtaccgtccccggaccccccgtactcccgtactacgtacctaataagtaaactcgtactacacgtcccgggtccccggttccggggtaccctcggtaaccgtctttcctccggtacggtccctaccgtacgttcgtccgttcgggacccttaccgtaccgtaccgtccccttcccgtacgtacccgtacgttacggtacgggttccggggtacccggttcccggggtaccggtaacgggtacggtcgggtaaccgggttcgttaacggttaacttttaaccggttacggttaccgggtacggtacccgggtaccgggttaagggtaccgttaacggtaccgttacccgttaaccggttagggtaaccgggttccggggtttcccgggttacgggttaccggggaccggggtaccggtaaccgggtccgggtaccggttaaccgggtacccgttaccggttaacggtaccggtacccggacccggttaacccgggccggttacccccggttaccccggttacccgg

SEQ ID NO: 247737 - DNA, 678 bp, Homo sapiens
  misc_feature: GYAE6OF02GSL1V.17.28.C06.1.454.CMB.1.raw
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttggttttccttgttgctgttttagaggtgtcatgtgagtcagttggttgagtccggggagcctggtccagccgtcggggggtccctgacgacttctccgtagtgcagccgtccgacttcccctnagtnttatgatgattcggccncagactcgaggggaaggtcnggagtgggcgacaacagtaaancgaaagatagactcggacttagtttacgnggactcgttagtagaacgggttccgtttaccaacgtactcctacccgaagacggtaaccaaaccgtaccaaaagtaaccttcgagttaagactacctaaacaacgttacgaaaccacgtaccttagaacggttacgacggactaacggaacccgtaacgggttcccgtaatttaccgttacgtggtacggtacgaaggtactagggtaaaacggtaaaagttaaggtccggttagtcggttaaggtttttagggccgggtaccggggtaagggtaccccgaccggtttacggacgttaaccccccgg

SEQ ID NO: 247738 - DNA, 824 bp, Homo sapiens
  misc_feature: GYAE6OF02GLU7Z.17.28.C06.1.454.CMB.1.raw
  modified_base (144)..(144): a, c, t, g, unknown or other
  misc_feature (144)..(144): n is a, c, g, or t
  modified_base (223)..(223): a, c, t, g, unknown or other
  misc_feature (223)..(223): n is a, c, g, or t
tcagcgtagactagcacgaccggtgctcgatttagagctcacgtattgggtttggggaggattcaggacaatctccagcatggccggcttccctctcctcctcaccctcctcactcactgtgcagggtcctgggcccagtctgngctgactcagcccaccctcagtgtccgtcgggacccccgggcaggacgggtcaccatacttctttgttcgtaggaaacngctccggctactctacaaacttaaaacttagttttcgcgttacggtaccacgactaaaccgttcccgaagggtacctcccccgggaccccccgtaaccttccctacgtaacttactaagtaagtaaactggtaactacctacggttcccggtaccccgttccggttccgggggttacccgtaccggaacccgttcttccgttaccggtcggttccgttaaccgttagttccggtccgttacgggtccctacccgttccaccgtccccttacccggtacgaacctacggtacggtacggtccgggttcccggtccgggtaccggtaggtacgtcgggtaacgtcgttaacggtttatttacgttaccggtacgtcgggtaccgtcgggtacgtaactcgtaccgtcgtacgtacggttacgggttccgggttcgggtacgggtggggaaccggggtacgcggtacggcggtaccgtaacccgttcggtaaccgcgacccggtccggaaccggttccctcccgggttaacccccggttggtaccctttcccgttcccgtttacccccgttcccgtacccctttccgttacccgttcgtacccg

SEQ ID NO: 247739 - DNA, 739 bp, Homo sapiens
  misc_feature: GYAE6OF02ITVUM.17.28.C06.1.454.CMB.1.raw
  modified_base (603)..(603): a, c, t, g, unknown or other
  misc_feature (603)..(603): n is a, c, g, or t
  modified_base (644)..(644): a, c, t, g, unknown or other
  misc_feature (644)..(644): n is a, c, g, or t
  modified_base (652)..(652): a, c, t, g, unknown or other
  misc_feature (652)..(652): n is a, c, g, or t
  modified_base (657)..(657): a, c, t, g, unknown or other
  misc_feature (657)..(657): n is a, c, g, or t
tcagcgtagactagcacgaccggtgctcgatttagagctcacgtattgggtttggggaggtctcagagaggaggcttagccctggactccaaaggcctttccacttggtgagtcagcactgagcacagaggactcaccatggagttggggctgaacgttgggttttccttgttgcttgttttagaggtgtaccagtgtgaggtccagttggtgaggtccggggagccgtggtccagcccgtgggggtccctgacgtactctcctggtcgacaggccctccggtaccttcccttacgtaggttacgtttagttaggaattgtaccggtttcgggtaccccgacctaacgtaccctacccgggtaagggggtaacgggggctgggggaggtttgggggaccgtacccgaaacgtaacgtaaaacgctaaaggagttacgggaaactcgtacccggttaaggtttaccgtggtaacgttcgttaggtacggtaacggttcccgtttaacgacctacgttccctccgaaagtaacgaaccgtaaacccgaaccgtaaaggtaaacttctaaaccgttagtacgtacctaaccgtaactaacgaaacncgtctagactagtcgagacgaccgcgtacgtatacgtttcnggtacganaagtntaaggtaagttaaaggtagtacgttagtgtttaggttaggttacgggtacggtaacggccgttacggtccgtaccgtacccg

SEQ ID NO: 247740 - DNA, 720 bp, Homo sapiens
  misc_feature: GYAE6OF02GRNV5.17.28.C06.1.454.CMB.1.raw
  modified_base (626)..(626): a, c, t, g, unknown or other
  misc_feature (626)..(626): n is a, c, g, or t
tcagcgtagactagcacgaccggtgctcgatttagagctcacgtattgggtttgggggaggtctcagagaggaggcttagccctggactccaaggcctttccacttgtgatcagcactgagcacagaggactcaccatggagttggggctgaactgggttttccttgttgctgttttagaaggtgtccagtgtgaggtccagttggtgagtccggggagcctggtccagcctgggggtccctgagactctcctgtgcagcctccggattcccctacacgtagttatggatgaccttgggccgccagactccgaaggggtagggcctgggacggttggggtccggaccgaaaacagttaaaacgcgaaaacggagtacggtaaactcggtaccgtaacggtttttaacggcggtaacttcgttaggtacggaaacgggttcccgtttaccgaaccgtagttaccgtaccaaggtacgtaaccgaaaccgacccgaaaagttaacttaccgtaacgttaacgttacttaaccgtaaacctaaacgttacgaaaacgtacgtacccgttagaacggtaacggttccacgaagaccgaacggtccgttagtaacgttacgttagtacggngtaagagtagtaacggtaaaaacgtagtacggacttaggttacgtttaggttcgggaccgaaggggtaccgtaccgtacgggtacccgtacccg

SEQ ID NO: 247741 - DNA, 860 bp, Homo sapiens
  misc_feature: GYAE6OF02F04XR.17.28.C06.1.454.CMB.1.raw
  modified_base (389)..(389): a, c, t, g, unknown or other
  misc_feature (389)..(389): n is a, c, g, or t
tcagcgtagactagcacgaccggtgctcgatttagagctcacgtattggggtttgggggaggtctcagagaggaggcttagccctggactccaaggcctttcacttggtgatcagcactgagcacagaggactcaccagtggagttggggctgtaacttgggttttccttgttgtcttgttttagaggtgtcagtgtgtagtctagttggtgagggtcggggaggcgtggtcaggccgtgggggtcctgagaccttctccgtgtcgccacgcccgttaccggtacctttccccttacgtagttagttttacgtagggtagtcggtacgtttcgggtcccgcctaggtccttaacgggagggggaacgggtcgtggggtaggttcggggnggtaccaaacgaaataaacggacgaaaggtatacgggtacgtcggtaccggtttaacggttttacggtacggtacttcggttacggtacgggttacgggttaccctttccgaacccttagtaccggttaccgtaaggaacggtaaccgaaaccgtaccgtaaaagtaacgttaacccgttacgttaaccgttacttaacctaaaccgtaaactttaacggaaccgtacgttacccgtagggaaccggttacggttaccggaaccggtaaacggtaacccgggtaacccggtaacccgggtttacgttaacgttttaccggttacggttaacgttacgtaaggttaacggttacggtaaaagggttaaaccggttaaaggttacggttaacgggtttgttttacgggtttaagggtacggggtaaccggttagggtaacccgggttaccggttaccggtaccccgttaccgg

SEQ ID NO: 247742 - DNA, 758 bp, Homo sapiens
  misc_feature: GYAE6OF02GCVLL.17.28.C06.1.454.CMB.1.raw
  modified_base (202)..(202): a, c, t, g, unknown or other
  misc_feature (202)..(202): n is a, c, g, or t
  modified_base (302)..(302): a, c, t, g, unknown or other
  misc_feature (302)..(302): n is a, c, g, or t
tcagcgtagactagcacgaccggtgctcgatttagagctcacgtattgggtttggggaggtctcagagaggaggcttagccctggactccaaggcctttccacttggtgatcagcactgagcacagaggactcacatggagttgggctgaactgggttttccttgttgctgtttagaggtgtccagtgtgagtcagttgtgngtcgggagctgcagcgtgggggtccctgagctctctggtgcacgccgtccggtacttcccccttcgagttaacgttagttacgatggtacgttgggtccnccgacgtaaccgtcccgaaggggacgggtcgtagggaggttcggggcggaccaaacgaagtaaaacggacaaaggtaacgagggtaaccgtagacccggttaaggttttaccggagggtaaccttaccggtttaggtacgggtaaaccgggtcccgttttaccaaacccgtacgttacccgtccgtaaggaccgtaaacgtaaacccggacccgtaaacgttaaacttaaccgtaccgttagttaacctacctttaaaccaacgttaacgaacgtacgaccctagggaacgtacgcggtaaccgaaggaccgtaccggtaccggttacgttaacgttaacgtgtaggaacgtagttaagtagggttaaaggaaaaggttcgtacggttacttagggttacgttttagggttaccgggacggtagggtaccgtacccggttaggtacccttacccgg

SEQ ID NO: 247743 - DNA, 486 bp, Homo sapiens
  misc_feature: GYAE6OF01A4I07.16.73.G07.1.454.CMB.1.raw
  modified_base (484)..(484): a, c, t, g, unknown or other
  misc_feature (484)..(484): n is a, c, g, or t
tcagtgtactactccacgaccggtgctcgatttagctctacgctcagggggcgtacaacaggcaggcaggggcagcaagatggtgttgcagacccaggtcttcatttctctgttgctctggatctctggtgcctacggggactatcgtgatgtacccagtctccagactccctggctgtgtctctgggcgagagggccacatcaactgcaagtccagccagagtgttttatataactccaacaataagagctacttagcttggtaccagcacaaatcaggacagcctcctaagctgctcatttactggcatctacccggaatccgggtccctgaccgattcagtgcagcgggtctgggacagatttcactctcacatcagcagcctgcaggctgaagatgtggctagtttatactgtacaacaatattataattaatctattattcgagaggaccaggtgagatcgaaacgatgtgctagcacntc

SEQ ID NO: 247744 - DNA, 541 bp, Homo sapiens
  misc_feature: GYAE6OF01BT3G0.16.73.G07.1.454.CMB.1.raw
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccgccagcctccaggcaaggggctggagtgggtggctcttatatcatctgatggaggtactgaatactacgcagactccgtgaagggccgattcaccatctccagagacaattcccagaacacactgtatctgcaaatgaacagcctgagaactgaggacacggctctatattactgtgcgaggagggggccggtgggagctcctccgacgggccagtgactccgtggggccagggactcccgtggtcacccgtctcctcacgccctccaccgaacgggccccagtccggtccttcccccgtggccgtccctgcctccgaggacgccaccctccgagcgcacgacgccggcccctgggcctggcccgtcggg

SEQ ID NO: 247745 - DNA, 494 bp, Homo sapiens
  misc_feature: GYAE6OF01CGETS.16.73.G07.1.454.CMB.1.raw
  modified_base (229)..(229): a, c, t, g, unknown or other
  misc_feature (229)..(229): n is a, c, g, or t
  modified_base (491)..(491): a, c, t, g, unknown or other
  misc_feature (491)..(491): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatctacccgggaatccggggtccctgaccgattcagtggcagcgggtctggggacagatttcactctcaccatcagcagccctgcaggctgaagatgtggctagtttatactgtcaacaatattataataatccatttaattcggcggaggaccaaggtgagatcaaacgatgtggctgcacntcg

SEQ ID NO: 247746 - DNA, 542 bp, Homo sapiens
  misc_feature: GYAE6OF01D4O5R.16.73.G07.1.454.CMB.1.raw
  modified_base (470)..(470): a, c, t, g, unknown or other
  misc_feature (470)..(470): n is a, c, g, or t
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccgccagcctccaggcaaggggctggagtgggtggctcttatatcatctgatggaggtactgaatactacgcagactccgtgaagggccgattcaccatctccagagacaattcccagaacacactgtatctgcaaatgaacagcctgagaactgaggacacggctctatattactgtgcgaggaggggggccggtgggagctcctccgacggggccagtgacctccgtggggccaggggactcccgtgggtccaccgtctcctcacgcctccaccaacgggcccatccggtccttccccnggccgccctgacctccgaggagcccgacctccgagcgccacgacggccggcccgtgggcctggccgtacggg

SEQ ID NO: 247747 - DNA, 483 bp, Homo sapiens
  misc_feature: GYAE6OF01BTJSH.16.73.G07.1.454.CMB.1.raw
  modified_base (304)..(304): a, c, t, g, unknown or other
  misc_feature (304)..(304): n is a, c, g, or t
  modified_base (398)..(398): a, c, t, g, unknown or other
  misc_feature (398)..(398): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttacngggcatctaccggaatccgtggtcctgaccgattcagtggcaggcggtctgggacagtattcactctcaccatcagcagcctgcaggctgaagntgtgctagtttatactgtacaatatattataataatctaattattcggagaggacaggtgagnacaacgagtgtagntgcactac

SEQ ID NO: 247748 - DNA, 518 bp, Homo sapiens
  misc_feature: GYAE6OF01D09YQ.16.73.G07.1.454.CMB.1.raw
  modified_base (229)..(229): a, c, t, g, unknown or other
  misc_feature (229)..(229): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatctacccgggaatcctgggtccctgaccgattcagtggcagcgggtctgggacaggatttcactctcaccatcagcagcctgcaggctgaagatgtggctagtttatactgtacaataatattaataataatcctaatttaacttcggacggtagggaccgtaagggttggaagtatacgaaacgtaactggtaggatcgctacctacg

SEQ ID NO: 247749 - DNA, 524 bp, Homo sapiens
  misc_feature: GYAE6OF01APVZQ.16.73.G07.1.454.CMB.1.raw
  modified_base (403)..(403): a, c, t, g, unknown or other
  misc_feature (403)..(403): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcaggcgggtctgggacagtatttcactctcaccatcagcagcctgcaggctgaagntgtggctagtttatactgtacaactaatattaataattaatacctatttaacttcggacggagggacctaagggtggagtatacgaaacgaacgtggtacggctaggctaccgtagttccg

SEQ ID NO: 247750 - DNA, 489 bp, Homo sapiens
  misc_feature: GYAE6OF01AYML5.16.73.G07.1.454.CMB.1.raw
  modified_base (230)..(230): a, c, t, g, unknown or other
  misc_feature (230)..(230): n is a, c, g, or t
  modified_base (305)..(305): a, c, t, g, unknown or other
  misc_feature (305)..(305): n is a, c, g, or t
  modified_base (409)..(409): a, c, t, g, unknown or other
  misc_feature (409)..(409): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttanataactccaacaataagagctacttagcttggtacaagcacaaatcaggacagcctcctaagctgctcatttacngggcatccgtacccgggaatccgggtccctgaccgtattcgagtcggcaggcgggtctgggacagtatttcactctacaccatcagcagcctgcagctagaagntgtgctagtttatactgtacaatatattataatatctattatggngagacaggtganatacaagatgtacgcngcantcg

SEQ ID NO: 247751 - DNA, 540 bp, Homo sapiens
  misc_feature: GYAE6OF01BDG6O.16.73.G07.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (399)..(399): a, c, t, g, unknown or other
  misc_feature (399)..(399): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttacngggcatctacccgggaatccgggtcctgaccgattcagtggcagcgggtctgggacagatttcactctcaccatcagcagcctgcaggctgaagntgtgctagtttatactgtcaactaatattattaaataacttacctattttaaagttcggacggtacgggtaaccaagggttcggaagtacttaacgaaaaccgtaacgttcggtaggaccctaggcctaaccgtattaccg

SEQ ID NO: 247752 - DNA, 508 bp, Homo sapiens
  misc_feature: GYAE6OF01DKU25.16.73.G07.1.454.CMB.1.raw
  modified_base (228)..(228): a, c, t, g, unknown or other
  misc_feature (228)..(228): n is a, c, g, or t
  modified_base (505)..(505): a, c, t, g, unknown or other
  misc_feature (505)..(505): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacgggacatcgtgatgacccagtctacagactccctggctgtgtctctgggcgagagggccaccatcaactgcaagtccagccagagtgttttanataactccaacaataagagctacttagcttggtaccagcacaaatcaggacagcctcctaagctgctcatttactgggcatctacccgggaatccggggtccctgaccgattcagtggcagcgggtctgggacagtatttcactctcaccatcagcagcctgcagctagaagatgtggctagtttatatgtacaactaatattaataataatacctatttaacttcggacggagggaccaagggtggagatacaaacgtactgtcggactgactacntcg

SEQ ID NO: 247753 - DNA, 527 bp, Homo sapiens
  misc_feature: GYAE6OF01ETM31.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatcctgggtccctgaccgattcagtggcagcggtctgggacagatttcactctcaccatcagcagcctgcaggctgaagatgtggctagtttattactgtacaactaattattaataaattaatacctaattttaagttcgggacggaagggtaccaagggtaggaagtatacgaaaacgtaacgttgtaggacgtcgcaccgtacg

SEQ ID NO: 247754 - DNA, 549 bp, Homo sapiens
  misc_feature: GYAE6OF01CMHAR.16.73.G07.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
  modified_base (431)..(431): a, c, t, g, unknown or other
  misc_feature (431)..(431): n is a, c, g, or t
  modified_base (514)..(514): a, c, t, g, unknown or other
  misc_feature (514)..(514): n is a, c, g, or t
  modified_base (545)..(545): a, c, t, g, unknown or other
  misc_feature (545)..(545): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacgggacatcgtgatgacccagtctccagactccctggctgtgtctcgtgggcgagagggccaccatcaactgacaagtccagccagagtgtttanataactccaaanaataagagctaacttagcttaggtaccagacaacaaatcaggacagcctacctaagctgctctattttacgnggcaactccgtaacccgggaagtcccggggtccctgaaccgtattcgaggtcggcaggcgggtntcggggaacagtatttcaactctacaccatcagcagccctgcgaggctagaagntgtggactagtttataacgtgtacaataataattaataaattatacctaatttaacgtggacggaaggtaacaagggtcgaanataacgaaaccgtatggtcgatagcaacctntccg

SEQ ID NO: 247755 - DNA, 500 bp, Homo sapiens
  misc_feature: GYAE6OF01ENODR.16.73.G07.1.454.CMB.1.raw
  modified_base (229)..(229): a, c, t, g, unknown or other
  misc_feature (229)..(229): n is a, c, g, or t
  modified_base (424)..(424): a, c, t, g, unknown or other
  misc_feature (424)..(424): n is a, c, g, or t
  modified_base (497)..(497): a, c, t, g, unknown or other
  misc_feature (497)..(497): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactcaacaataagagctacttagcttggtaccagcacaaatcagacagcctctaagctgctcatttactggcatctacccgggaatccgggtccctgaccgattcgagtggcaggcgggtctgggacagtattcgactctcaccatcagcacgcctgcaggctagaagatgtgctagtttatactgtacaanaattattaataattaatcctaatttaattcggaggaggaccaaggtgagatacaaacgactgtcgctagcacntcg

SEQ ID NO: 247756 - DNA, 553 bp, Homo sapiens
  misc_feature: GYAE6OF01B8OBT.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatcccggggtccctgaccgattcagtggcaggcgggtctggggacagtatttcacgtctcaccatcagcagccctgcaggctgaagatgtggctagtttattactgtacaactaatattaataataactactaatttaacgttcggacggtagggaacctaagggtacgggaagtagtaccgaaaaccggtaaacttggttacgggacttaggacctaacccgtagttacccg

SEQ ID NO: 247757 - DNA, 556 bp, Homo sapiens
  misc_feature: GYAE6OF01DMF1B.16.73.G07.1.454.CMB.1.raw
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccgccagcctccaggcaaggggctggagtgggtggctcttatatcatctgatggagtactgaatactacgcagactccgtgaaggccgattcaccatctccagagacaattcccagaacacactgtatctgacaaatgaacagcctagagaactgagacacggctctaatattactgtgcggaggacggggggcggtgggagctccgtccgacgggccagtcgacgtccgtgggccagggtactcccgtggtccaccgtctccctcacgccctaccaccgaacggcccagtccggtccttcccccgtggcccgtccctgcctccgacggcgccacccgtaccggacgacgccacgacggtccggcccgtgggcctcggtccgtcggg

SEQ ID NO: 247758 - DNA, 656 bp, Homo sapiens
  misc_feature: GYAE6OF01DQ7VP.16.73.G07.1.454.CMB.1.raw
  modified_base (138)..(138): a, c, t, g, unknown or other
  misc_feature (138)..(138): n is a, c, g, or t
tcagtgtactactccacgaccggtgctcgatttagctctacgctcgagggggtccgggagatcatggagggtgtccttgagtcgtgggggaggcgtggtccagccgtgggggtcgctgagactctcctgtgcagcctntggattcaccttcagtacctatgccatacacgtgggtcccgccagccctccgaggcgaaggggctgggaggtgggtgcttcttatatcatctgatggagtactgaatactacgcagactcgtgaaggcgatcacatctcagagacactccagaacacactgtatctgacaaatgaacagacctgaagaacgtgacggacacggctactattattacgtgtggacggaggggacggggggccggtgggacgtccgtccgtacccggacggggaccctaagtcgtaccgtccggtcggggccgagggtaccgtcccgttcggtacccgtaccgttccctcccgtacgccgtaccctacccgaaccgaaccggggtcccctacggttcccgggttacccctttccccccggtgggtcccccgtccccggtcggccccgttaccggaacgggaccgtacccgacccgtaccggacggacgtccgaaccgaggccccggccggtcggctcggcccgttacggg

SEQ ID NO: 247759 - DNA, 546 bp, Homo sapiens
  misc_feature: GYAE6OF01CP0WE.16.73.G07.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (307)..(307): a, c, t, g, unknown or other
  misc_feature (307)..(307): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacgggacatcgtgatgacccagtctccagactccctggctgtgtctcgtgggcgagagggccaccatcaactgcaagtccagccagagttgtttanataactccaanaataaganctacttagcttggtaccagcaacaaatcaggacagcctactaagctgctctatttacgngggctacgtccgtacccgggaatcccgtcgggtcccctggaccgtattcgaggtcggcaggcgggtcgtagggactagtatttcacttctaccacatcagcacgcctgcngctagaagntgtgtctatttatactagtacaactaattattataatactactaatttacgtcggacggtaggaaccgtaagggtgaagtaactacgaaaacgacgttggtacgtactgaccgtactacg

SEQ ID NO: 247760 - DNA, 589 bp, Homo sapiens
  misc_feature: GYAE6OF01EA9QY.16.73.G07.1.454.CMB.1.raw
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccgccagcctccaggcaaggggctggagtgggtggctcttatatcatctgatggaggtactgaatactacgcagactccgtgaagggccgattcaccatctccagagacaattcccagaacacactgtatctgcaaatgaacagcctgagaactgaggacacggctctatattactgtgcgaggaggggggccggtgggagcgtcctccgacggggccagtcgactccgtggggccagggactcccgtgggtccacccgtcctcctccgacgccctcccgaaccgaacgggccccagtccggtccctttccccccgtcgggcccgtcccctcggcccttccgacgggacgcccgacccgttaccgacggtacgcccgaacgacggcccggccccgtagggcccttcggcccgttaccggg

SEQ ID NO: 247761 - DNA, 584 bp, Homo sapiens
  misc_feature: GYAE6OF01AKFJF.16.73.G07.1.454.CMB.1.raw
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccgccagcctccaggcaaggggctggagtgggtggctcttatatcatctgatggaggtactgaatactacgcagactccggtgaagggccgattcaccatctccagagacaattcccagaacacactgtatctgacaaatgaacagcctagaacgaactgaggacacggctactatattactgtgcggaggggacggggggccggtgggacgccgtccgaccggacgggccagtcgacgtccggtggggccgagggtactcccgtcgtcctaccgtcctcctcacgccctacccgaccgacggcccacgtccggtcccttccccgtggcccgtccctcgcctccgacggacgcccgacccgtccggaggccgccgaccgcgggccggtcccggtagggccctggtcccgtacggg

SEQ ID NO: 247762 - DNA, 515 bp, Homo sapiens
  misc_feature: GYAE6OF01D4Y3K.16.73.G07.1.454.CMB.1.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
  modified_base (410)..(410): a, c, t, g, unknown or other
  misc_feature (410)..(410): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctctaagctgctcatttacnggcatcgacccggaatcctgggtccctgaccgattcagtggcagcggtctgggacagatttcactctacacatcagcagcctgcaggctagaagatgtgctagtttntactgtacaataatattaataataactacttaatttaagtttcgggacggtaagggaccgtaaagggtggagtactaacaaacgacgtggtagctgctacctacg

SEQ ID NO: 247763 - DNA, 532 bp, Homo sapiens
  misc_feature: GYAE6OF01CCLR2.16.73.G07.1.454.CMB.1.raw
  modified_base (401)..(401): a, c, t, g, unknown or other
  misc_feature (401)..(401): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatcctacccgggaatccgtgggtccctgaccgatcagtgcagcggtctgggacagtatttcactctcaccatcagcagcctgcaggctgaagntgtggctagtttattactgtacaactaattattaattaaataacttcctaattttaagttcgggacgtaagggacctaaagggtggaagtagtacgaaaacgtacgttggtacggctacgctaacctaacg

SEQ ID NO: 247764 - DNA, 521 bp, Homo sapiens
  misc_feature: GYAE6OF01B5713.16.73.G07.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttacngggcatctacccggaatcctggtccctgaccgattcagtggcagcggtctgggacagatttcactctcaccatcagcagctgcaggctgaagatgtgcagtttattactgtacaacaattacttataaattaactcctaattttaacgttcggacggagggtacccgaaagggtggaagactacaaaacggtaactggttacggactgccaccgtag

SEQ ID NO: 247765 - DNA, 525 bp, Homo sapiens
  misc_feature: GYAE6OF01CV9TD.16.73.G07.1.454.CMB.1.raw
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (492)..(492): a, c, t, g, unknown or other
  misc_feature (492)..(492): n is a, c, g, or t
  modified_base (522)..(522): a, c, t, g, unknown or other
  misc_feature (522)..(522): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgttttanataactcaacaataagagctacttagcttggtaccagcacaaatcaggacagcctacctaagctgctctatttacngggacatcgtacccgggaagttcccggggtcctgaccgattcgaggtcggcacggtcgggtctcgggacagtacttcactctcacatcagcagcctgcaggctagaagntgtcggntagtttatactgtacaactatattataataacttactatttaacgttcggaggtacggactaagggtganagtacgaacgtatgtggactagacaccgtntcg

SEQ ID NO: 247766 - DNA, 680 bp, Homo sapiens
  misc_feature: GYAE6OF01DQRDC.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgttttatataactccaacaataagagctaacttagcttggtaccagacaacaaatcaggacagcctcctaagctgctctatttacgtgggctatccgtacccgggaactcccggggtccctaggaccgtattcgagtcggcaggcgggtctggggacaggtactttacgacttcgtccaaccgtatccgaagtccaacgtcccttggaccgtaagggtccttagggaaagtacgttgggtacggtaccttaaggtttttaacttacccgttagtaacctaaactaaatttaactttaaattaaacttaacttaacccttaagtttttaaacggtttacccggggaacgggtaaacggggtaacccgtaaagggggttacggtaaaggtaacttaaccggaaaaaccggtaacctttagggtaccggtaccttaggaaccctaacccgtgtttaacccg

SEQ ID NO: 247767 - DNA, 528 bp, Homo sapiens
  misc_feature: GYAE6OF01AT60X.16.73.G07.1.454.CMB.1.raw
  modified_base (229)..(229): a, c, t, g, unknown or other
  misc_feature (229)..(229): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatcgtacccgggaatccggggtccctgaccgattcagtgcagcgggtctgggacagtatttcgactctcaccatcagcagcctgcaggctagaacgtatgtggtactagtttatacgtgtacaactaataattataaattaatcctatttaagttcggaggacgggacctaagggtcgagtaatcaaaacggtactggtacggtctagctaccgtatccg

SEQ ID NO: 247768 - DNA, 514 bp, Homo sapiens
  misc_feature: GYAE6OF01BM1HL.16.73.G07.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (309)..(309): a, c, t, g, unknown or other
  misc_feature (309)..(309): n is a, c, g, or t
  modified_base (484)..(484): a, c, t, g, unknown or other
  misc_feature (484)..(484): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtttanataactccaanaataagagctacttagcttaggtaccagcaacaaatcaggacagcctacctaagctgctctatttacgnggcatccgtaacccgggaatcccgggtcctgaccgattcagtggcgacgcgggtcgtgggacagtatttaccactctaccacctatcagcacgcctgcaggctagaacgtgtgtgactagttttatactgtacaatatattataataatctaattagtcggagagactaggtganatacgaaacgatggtagctagacnctntcg

SEQ ID NO: 247769 - DNA, 664 bp, Homo sapiens
  misc_feature: GYAE6OF01AXH9C.16.73.G07.1.454.CMB.1.raw
  modified_base (308)..(308): a, c, t, g, unknown or other
  misc_feature (308)..(308): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataactccaaacaataagagctacttagcttggtaccagcacaaatcaggacagcctcctaagctgctctatttacgnggcactccgtacccgggatcccggggtccctggaccgtattcgaggtcggacgaggcgggtcgtcgggactaggtactttccactcctaccaccgtatccgacgcacggtccctaggaccgaagggcctaggaacgtgttcggtacggtactttaaggttttacttacgtacgttaacctaaacgttaatttaaactttaaacttaaactttaaacttaccgttaaagttttttaacggtttccggggaacgggtaaaccggggtaaacccgtaaaggggttaggaacgttaacgtaaacccgaaaaccggtagtttacgggtacggtaccttagacccgtacccgtagttacccg

SEQ ID NO: 247770 - DNA, 590 bp, Homo sapiens
  misc_feature: GYAE6OF01DADNZ.16.73.G07.1.454.CMB.1.raw
  modified_base (134)..(134): a, c, t, g, unknown or other
  misc_feature (134)..(134): n is a, c, g, or t
  modified_base (173)..(173): a, c, t, g, unknown or other
  misc_feature (173)..(173): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
tcagtgtactactccacgaccggtgctcgatttagctctacgctcaggggtccgggagatcatgagggtgtccttgagtctgggggaggcgtggtccagccgtgggggtcgctgagactctcctgtgcagcctntggattcaccttcagtacctatgccatacactgggtccnccagcctccaggcaaggggctggagtgggtgctcttanatcatctgatggagtactgaatactacgnagactccgtagaaggccgattcaccatctccagagaacaattccagaacactacttttanctagacaaatgaacagcctagaacgaactagaggaacncggactactatattactgtcgcgagggacgggggccggtgggagccgtcctccggacgggcagtcgactcggagggccaggactcccgtggtcctacccgtctccctacacgacccctaccaaccgaacgggccctacgttcccggtacccttccccgtggcccgtccccgtgccgtaccgaggtccgaccgacccgtacgacgtacgcaaccgccggccggtcccgtggaccctcggtccgtcggtaaccg

SEQ ID NO: 247771 - DNA, 733 bp, Homo sapiens
  misc_feature: GYAE6OF01C26Q0.16.73.G07.1.454.CMB.1.raw
  modified_base (719)..(719): a, c, t, g, unknown or other
  misc_feature (719)..(719): n is a, c, g, or t
tcagtgtactactccacgaccggtgctcgatttagctctacgctcgagggggcgtacaacgaggacgaggcaggggcagcaagatggtgttgcagacccaggtcttcatttctctgttgctctggatctctggtgccgtacggggacatcgtgatgacccagtctccagcctccctggctgtgtctcgtgggcgaggacgggccacactcaaactgacaacgtcccagaccaggtagttgttttaataataacctaccaaacaaagtaaagacgtacttaacgttagccgtttacggtaacccagaccaaacaaatccgaaggaaccacggtacccctacctaaggcctcggtaccttactaacgttttacgcgggactaacgtacccggtaacccgggtaacttcccggtcgggtaccctacggtacccgtatttcgacgtggacgtacggtcgggtacgtgggaactaggttactttacacttacctccgaacctacgtaccacggaccacgtcccgtgaccgtacgggacttaggaaagttcgtggtacgttactttagtttacttaaccgtagtaacctaataaatttaacttaataaactttaacttaccgttaaagttttacggttaccgggacggggtaaccggtaaccgtaaggggtacgaaagttaaacgtaaacccgtaaaaggttaccgtagggtacgtaccgtaacnccgttaaccgttac

SEQ ID NO: 247772 - DNA, 519 bp, Homo sapiens
  misc_feature: GYAE6OF01EICQZ.16.73.G07.1.454.CMB.1.raw
  modified_base (312)..(312): a, c, t, g, unknown or other
  misc_feature (312)..(312): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttatataactccaacaataagagctacttagcttggtaccagcaacaaatcgaggacacgcctaccgtaagctgcttcatttacgngggcatcgtacccggaatcccgtgggtccctagaccgtattcgagtggcacggcgggtctagggacctagtatttccacttcctacaccatcacgcagcctgcaggctagagtntgngtctagtttatactgtacaanattatataatactctattagtcgacggtaggacgaggtagagatacgaaagtactggagntcgcntacg

SEQ ID NO: 247773 - DNA, 687 bp, Homo sapiens
  misc_feature: GYAE6OF01CVH88.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgatgacccagtctccagacctccctggctgtcgtctcgtgggcgagacggccaccatacaactcgacaacgtccgagaccagtagttagttttaatactaacctacaaactaaataacgagtaccttaacgttacgtccgttaggtaaccaacgactaacaaaatacgaacggaacctaacggccttaaccgtaacgtctacggtccttaacgtaacttttacggtcgggacctaacgtaacccgtaacccggggtaacgttccccggggtccctacggtaccgtaacgttacgacggtcggacgacgggtcggtcgtagggactagtacttcgacgtctccgaactagtccagtccacgtcctgacgagctagaagtgtcggagtacttaagtttactaacgtgaactaaataagtttaattaataactaattaccgttaagttttaacgtcggggaacgtaaggtaaccgtaggtacgtagtaaacgttaaacaaacggtagttaggtcggtaacttccgaaccttacctggttacccg

SEQ ID NO: 247774 - DNA, 524 bp, Homo sapiens
  misc_feature: GYAE6OF01AJAR0.16.73.G07.1.454.CMB.1.raw
  modified_base (229)..(229): a, c, t, g, unknown or other
  misc_feature (229)..(229): n is a, c, g, or t
  modified_base (518)..(518): a, c, t, g, unknown or other
  misc_feature (518)..(518): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatctacccgggatccgggtccctgaccgattcagtggcagcgggtctggggacagatttcactctcaccatcagcagcctgcaggctgaagatgtggctagtttatactgtcaataatattataataatctaatttaacttcgggacggtaacggaccgtaagggtcgaggactacgaaaacgacgtaggtacggactagcctaaccgtnttaccg

SEQ ID NO: 247775 - DNA, 566 bp, Homo sapiens
  misc_feature: GYAE6OF01DPLKU.16.73.G07.1.454.CMB.1.raw
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (320)..(320): a, c, t, g, unknown or other
  misc_feature (320)..(320): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccgccagcctccaggcaaggggctggagtgggtggctcttatatcatctgatggagtactgaatactacgcagactccgngaagggccattcaccatctccaganacaattcccagaacacactgtatctgacaaatgaacagcctagaanaactgaggacacggctctatattactgtgcgagggngggggcgtgganctccgtccgacgggccagtcgactccgtggggccgagggtactcccgtggtccacccgtctccctcacgccctacccaccgaacggccctacttccgggtcccttcccccgcggtcccgcccctgccctaccgaggacgacccgtaccgtaccggagaccgcaccgacggccggaccccgtgggcctcggcgtacggg

SEQ ID NO: 247776 - DNA, 557 bp, Homo sapiens
  misc_feature: GYAE6OF01DDFBP.16.73.G07.1.454.CMB.1.raw
  modified_base (229)..(229): a, c, t, g, unknown or other
  misc_feature (229)..(229): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaaacaataagagctacttagcttggtaccagtacaaatcaggacagcctcctaagctgctcatttacgtgggcatctaacccgggatcccggggtccctgaccgattcagtggcagcggtctgggacagtatttcactcgtacaccatcagcagccctgcgaggtctagaagtgtagtggtactagttttattacgtgtacaacgtaattaagttaataattaacttacttaatttaagtttccggacgggtaggtaacctaagggtgaacgtataaccgaaacggaactaggtacgccgttagaccaactatcgttacg

SEQ ID NO: 247777 - DNA, 703 bp, Homo sapiens
  misc_feature: GYAE6OF01BU9HZ.16.73.G07.1.454.CMB.1.raw
  modified_base (239)..(239): a, c, t, g, unknown or other
  misc_feature (239)..(239): n is a, c, g, or t
tcagtgtactactccacgaccggtgctcgatttagctctacgctcagggggctacaacaggcaggcaggggcagcaagatggtgttgcagacccaggtcttcatttctctgttgctctggatctcgtggtgccgtacgggacatcgtgatcgacccagtcctcagacctccgtggctgtgtctcgtgggcgaggacgggccacatacaactgacaagtccagaccagtagttgtttaanactaacctaccaaactaataagacgtacttacttagtcgttaggaccagaccaactaaactcgaacggacacgtccctactaagctacgtctctaagtttacgcgggactacgtacccgtaacccgggtaacgttcccgggacctacggaccttagtacgaggtcggacgtacgggcgggtacgtacgggaactagtactttaccgaccttccaccaccagtaccacggccagtcccgtcgaacggaggtacgtaagaacggtgtggtacgtacgtttaatttacgtacgtactaacgaaacttattaactttaaagtaaactttaacgttaacctttaaggtttaaccgggttccgggaacggggtaaaccggtaaacggtaagggtacggtaaataaccggtaaaacggaaccggttacgttaggtaccggtaccgttaacaccgttaaccgtcggtttacc

SEQ ID NO: 247778 - DNA, 541 bp, Homo sapiens
  misc_feature: GYAE6OF01BHL3C.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataactccaacaataagagctacttagcttggtaccagcacaaatcaggacagcctcctaagctgctcatttactgggcatccgtaccggatccgtcggtcctgaccgattcgagtggcacggcgggtctagggacagtacgtttcacgtctacacctatcgagccagcctgcgaggctagaagtagtgtggcttagtttattactgtactaataattaattaataattaagtaccttaaatttacgttcggacggtaggtaaccgagggtagaggtactactaaacgactggacgacttcgcgtactacg

SEQ ID NO: 247779 - DNA, 567 bp, Homo sapiens
  misc_feature: GYAE6OF01BOSXN.16.73.G07.1.454.CMB.1.raw
  modified_base (230)..(230): a, c, t, g, unknown or other
  misc_feature (230)..(230): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanataactccaacaataagagctaacttagcttggtaccagcaacaaatcaggacagcctcctaagctgctcattactggcatcgtacccggaatccgggtccngaccgnttcgagtgcaggcggtctgggacagtacttcactctaccacctatcagcacgtccctgcgaggcctagaaagtgtgtggaccttagttttaatcgtagtcaaacgtaattaattaataaagttactaccttaattttaacgttccgggacgggtaacggtaaccgtaagggtggaacgtataccgaaaacgtacttcgggtagtaccctaggacctaccgtagttcccg

SEQ ID NO: 247780 - DNA, 600 bp, Homo sapiens
  misc_feature: GYAE6OF01D1C1A.16.73.G07.1.454.CMB.1.raw
  modified_base (306)..(306): a, c, t, g, unknown or other
  misc_feature (306)..(306): n is a, c, g, or t
  modified_base (428)..(428): a, c, t, g, unknown or other
  misc_feature (428)..(428): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataactccaacaataagagctacttagcttggtaccagcacaaatcaggacagcctcctaagctgctcatttacgngggcagtccgtaaccccgggaagtcccggggtccctagaccgtattccgagtcggctaggcgggtcgtggggactagtactttcacttcctcaccatcagcacgcctgcgaggctagaagtntggtgacttaagttttatacttgtacaaactaattaagttaattaaattaacgttaccttagttttaacggttccgggacgggtacgggtaaccgtaagggtaggaacgtaagtaaccggaaaaacgtacgttagggtacgggaccttaggaccctaaccgtagtttacccg

SEQ ID NO: 247781 - DNA, 752 bp, Homo sapiens
  misc_feature: GYAE6OF01CZZ8V.16.73.G07.1.454.CMB.1.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (332)..(332): a, c, t, g, unknown or other
  misc_feature (332)..(332): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgacaagtccagccagtagttgtttaanactaactccaaanaataagagactacgttagcttaggtaccagacaacaaatccgaaggacacgtccctacctaagcctagccttactattttacgngggactacgttacccgtaaccccggggtaattcccggtacggggttcccctacggtaaccccgtagtttccggaaggttccgggaccgtacgggtccggggttacgttacggggaacctaggtttactttccaaccgtttcctacccgaacctaatccgaagccgtaacgtcccgtggaccgtacggacgttagaaacggtacgtttggtacgggtactttaaggttttaacttacgtacgttaaaccaaacttaaatttaactttaaattaaacttaaacgtttacccgttaaaagtttttaaaccggtttccgggggaaacgggttaacgggtaaacccggttaaaggggtggaaacgtacgttaaacccgaaaaggttaaccgtggtacgggtacctacggaacctaaccgttacgg

SEQ ID NO: 247782 - DNA, 717 bp, Homo sapiens
  misc_feature: GYAE6OF01C3VTM.16.73.G07.1.454.CMB.1.raw
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgaccccagtctccagactccctggctgtgtctctgggcgagacgggccacatcaactgcaagtccagccagtagttgtttanataactacaanaataaganctattagcttcggtacagcaacaatcgagacagcctaccaagctgctctatttacgcgggactacgtaccgtaccccgggtaacgtccccggggtacctacggacccgtagttccgaaggtcggaccgtacgggtccgggtacgtaggggactaacggttctttacccaaccgttccttaccaaccgtaactcgaacgtccgaacggtccccttgggaccgtacgggtaccgtaaggtaaaggtcgttaggtacggttacgttaagtttttactaacgttacgtaacctaaaagttaactttaattaacgtaaattaaacctttaccttaagttttaaccgggtttcggggaaccgggtaacgggttaaaccgaaacggggtttacggaaagttaaaccggtacggaaaaaccgttacggttacggttacgggaacgtttaccggaaccttaccgtacgtttaccgg

SEQ ID NO: 247783 - DNA, 615 bp, Homo sapiens
  misc_feature: GYAE6OF01A0EGP.16.73.G07.1.454.CMB.1.raw
  modified_base (253)..(253): a, c, t, g, unknown or other
  misc_feature (253)..(253): n is a, c, g, or t
  modified_base (315)..(315): a, c, t, g, unknown or other
  misc_feature (315)..(315): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagttgttttatataactccaaacaataaganactacttagcttggtaccagcaacaaatcaggacagcctacctaagctgctctagtttacgngggacactccgtaacccgggaacgtcccggggtccctacgaccgtattcgaggtcggcgacggtcgggtcgtggggactaggtactttccacttcctaccgaccactacacgcacgtcctgacgacggtcaggaagtgtcggtggtacttaagtttactacgtgtaactaaataattattaataaattactaccttaagtttacgttaccgggcggtaaacgggaaccgtaaagggttcggaagtaaacgttaaccgaaacggtacgttcggtacggacctagacctaccgtagttaccg

SEQ ID NO: 247784 - DNA, 594 bp, Homo sapiens
  misc_feature: GYAE6OF01BXIBI.16.73.G07.1.454.CMB.1.raw
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccgccagcctccaggcaaggggctggagtgggtgctcttatatcatctgatggagtactgaatactacgcagactccgtgaaggcgatcaccatctccagagacaactcccagaacacactgtatctgacaaatgaacagcctagaagaactggacggacacggctctatattatggtgacggagggacggggggccggtgggacgccgtcccgtccggaccgggccagtcgaccgtccggtcggggaccgagggtaccttcccggtggtccctacccgtccgtcctccgacgtcccctaccgaccgacgggaccctacgtcccgttcccttccccgtcgcccgtccctgcctcccgaggccgacccgtcccgtacggagaccgccgaacgccgcccggtcccgtcgggcctcggtcgtaccggg

SEQ ID NO: 247785 - DNA, 879 bp, Homo sapiens
  misc_feature: GYAE6OF01DNIJ6.16.73.G07.1.454.CMB.1.raw
  modified_base (229)..(229): a, c, t, g, unknown or other
  misc_feature (229)..(229): n is a, c, g, or t
  modified_base (317)..(317): a, c, t, g, unknown or other
  misc_feature (317)..(317): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgatgacccagtctccagactccctggctgtgtctctgggcgagagggccaccatcaactgcaagtccagccagagtgttttanataactccaacaataagagctaacttagtcttggtaccagtacaacaaactcaaggacacgcctcctaaagctcgctactatttacgnggacataccgtaaccccgggtaagtcccggggtccctacggtacccgtagtttcgaaggttcgggacacggtacggggtcgtaggggactaggtacttttaccgaaccttaccttaccgaaccctacgttaccgaacgggtaccctaaacgggtcccctttagggacccggtaacggggtacccgtttagggaaacggtaacggtttacggggttaccgggttaccgtttaaaggtttttttaaccggtttaacccgtttacgggttaaacccctaaaaagtttaaaaccggttttaaaagtttttaaaactttaaaaaccgttttaaaacccggtttaaccccctttttaaagttttttttaaaaccgggtttttaccccggggggttaaacccgggggtttaaaaccgggggaacccccggtttaaaaagggggggttacggttaaaaccgggttaaacgtttaaaaccccggtaaaaaccgggttaaacccgtttaacggggtttaacgggacccgttttacggaaacccgtaacccgtttaacggtttaacccccggg

SEQ ID NO: 247786 - DNA, 522 bp, Homo sapiens
  misc_feature: GYAE6OF01DFBDN.16.73.G07.1.454.CMB.1.raw
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacgggacatcgtgatgacccagtctccagactccctggctgtgtctctgggcgagaggccacatcaactgcaagtccagccagagtgtttatataactcaacaataagagctatagcttggtaccagacacaaatcaaggacagcctacctaagctgctacatttacgtgggcatccgtacccggaagtcccggggtcctcgaccgtattccgaggtcggcaggcggtcgtggactagatttcactctcacatcagcacgcctgcaggctgaatgtgngtactagtttatagntaanaactaatattataattatactatttacgttcgacgggtaagacaaggtggaagtactaacgaaacgtagtagtaggactagaccatattccg

SEQ ID NO: 247787 - DNA, 575 bp, Homo sapiens
  misc_feature: GYAE6OF01EFT70.16.73.G07.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanataactccaaanaagtaagagctaacttagcttggtaccagcaanaaatcaggacagcctacctaagctgctctatttacgtggcaatccgtaacccgggaatcccggggtaccctggaccgtattcagtcggcaggcgggtctgggactagtatttcactcgtacactatcagtcacggtcctgctagggctaggaagatgtgtctaagttttattacctgtaccaaataattaattaacttaaataacttaccgtaattttacgttcgggacggtaaggaaccgtaagggtggaactaatacgaaaacgtacgtaggttacgactaggctaacctgttaccg

SEQ ID NO: 247788 - DNA, 729 bp, Homo sapiens
  misc_feature: GYAE6OF01DG15X.16.73.G07.1.454.CMB.1.raw
  modified_base (673)..(673): a, c, t, g, unknown or other
  misc_feature (673)..(673): n is a, c, g, or t
  modified_base (712)..(712): a, c, t, g, unknown or other
  misc_feature (712)..(712): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggacagtcgtgatgacccagtctccagactccctggctgtgtctcgtgggcgagaggccaccatcaactgcaagtccagccagtagttgttttaactactaacctaacaaataagtaagactacttaactcgtcgtttacggaaccagaccaaactaactacgaacggacacgtccctaacgtaacgtctctccttatacgttttacggacggtaccttaaccggttacccggtaaaccccgggtaaccgggttccccgggtaccgtacggtaacccgtgttaccgtaagggtcgaccggtagggttcccggggtaagtacgggaacttacggttacctttaccaccgttaccaaacctaccgtaactacaccgtccgacccgtgtaccgtacgggcgttacggaaggaagttcggtaggttaccggtattttaacgtttaactcggttactaaactaaattaaagtttattaaaattactttaaccttaattttacgttaacggttacgggacggaaacggttacgaaggggtanaacgtacgttaaacgaacggtacgttggtaggtacctanaccctaagttcgttacg

SEQ ID NO: 247789 - DNA, 729 bp, Homo sapiens
  misc_feature: GYAE6OF01D9QS2.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatcgacccagtcctccagacctcccgtggctgtgtctcgtgggcgagacggccaccatccaactgacaacgtccagccagtagttagtttaatactaacctaccaaacaataagacgtactaacttacgtcttacggtaaccagacaacaaaagtcgaacggaaccacgtcccgtacctaaggcctacgtaccttactactttacggtcgggacctaacgtacccggtaacccggggtaacggtccccggggtaccctacgaaccgtattacgaggttcggacgacggtcgggtctacgggaactagtactttcacttcctaccactatccgagcctacgcctaggccgacggtcgtaaggaagtacgtggtacggtacctttaaggttttacctacgttaactaaccgaaaacttaagttaaattttaaactaaactttaaccgtttaaccgttaaagtttttacccggttacgggggaacccggtaaacgggtaacccgtaaagggttaggaaacgtaaccgttaaacgaaaccggtagttcggtcggaacgttacccgactaacccgtagtttcccgg

SEQ ID NO: 247790 - DNA, 721 bp, Homo sapiens
  misc_feature: GYAE6OF01C79VY.16.73.G07.1.454.CMB.1.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgaccagtctccagactccctggttgtgtctcgtgggcgagacgggccaccatcaacgtgacaacgtccagccaaggtagttagttttanaactaactccaaanaataagganctacttagcttagtaccagcaacaaatcgaaggacagcctactaagctgctactatttacgtgggctacgtacccggtaaccgggtaacggtccgggtaccctgaaccgtattcgaggtcggacgacgggtacggtcgtagggaactagttactttaccactttccacctacctactaccgacgacgaacgtcctggaaccgacgggtaccgttaaggaacggttacgttcggttaaccgggtaactttaacggtttttaacgtaacggtttcgttaaaacgtaaaccttaaagtttaacttttaaaacgtaaatttaaaccgttaccgttttaaagtttaaccgggtttaacggggaaccgggtacgggtaaaccgtaaggggttaacgaacggtaaacgtaacgtaaaaccggacgttcggttacggactcgaaattacccgaagtttcttaacccgg

SEQ ID NO: 247791 - DNA, 709 bp, Homo sapiens
  misc_feature: GYAE6OF01C5ZW8.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctcgtggtcgccgtacgggacatcgtgatcgaccctagtcctaccacgtacctcccgtggcttggtgtccgtcggtgggcgacggacgggacccaacctactaccaacgtcgacaacggtccacgcgtaggtagtttagttttaataactaacctaccaaataagtaaagacgtacttaacgttagtccgtttacggtaaccagaccaaactaaacgtcgaacggacctacgtacccttacgtaacgtctacgtaccttacgtacgtttacggcggtactacgtaccgggtaacccgggacggttcccgggtactacggtacgtacttcgaggtcgacgtacgggtcggtcgtagggactacgtacttccactctacactacacgacgcacgtctagacgtagtactagaagtgtggtactacgtttagtttaactacgtagtaaccaaattattaagtttaactaaattactttacgttaagtttaaccgggcgggtaacggtaacggtacggtaaaggttaggaaacgttaacgtaaaggtaaaccgttagtcgggtacgtactacggaaccccttgttactacg

SEQ ID NO: 247792 - DNA, 664 bp, Homo sapiens
  misc_feature: GYAE6OF01APXSQ.16.73.G07.1.454.CMB.1.raw
  modified_base (649)..(649): a, c, t, g, unknown or other
  misc_feature (649)..(649): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagttgttttatataacctaccaaacaataagagctacttagtcttggtaccagacaacaatcgagacacgcctacctaagctcgctactactttacgtgggcacgtaccgtacccgggtaacgtcccggggtaccctcggtacccgtagttacgaggtcggcgtacggtcgggtcgtacggggactacggttactttccgaaccttccgtacccacctactaccgacgccgtacggtcccctggaccgtagggtaccgtagggtaacgtagttcggtacggtaactttaagttttaacttacgtagtaacctaaactaagtttattaaacttaaattaacttaccttaagtttaacgttacgggtaccgggtaacggtaccggtaagggtcgtaagtacgtaccgaaacgtacgtggtacggtctanccgtaactgttaccg

SEQ ID NO: 247793 - DNA, 773 bp, Homo sapiens
  misc_feature: GYAE6OF01D5GWW.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggcccaccatcaactgacaagtccagccagagttgttttatataacctaccaaacaataagagacttacttacgtcttcggtaccagacaacaaatcaaggacacgcctaccgtaagctgctactatttacgtggactacgtccggtaacccgggtaacgttcccggggtccctacggtaaccgtacgttacgaggtcggacgtacgggtcgggtcggtaggggaactaaggtactttccgtaaccttcctaccaccctatacccgaagtccgaacgtccccgtaggaccgtacggtacgttaacgggaaagtagttgggttacggggttacctttaaggtttttacttaaccgtttaggaaccttaaaactaaattttaaacgtttaaaactttaaaattaaaccctttaaccgttttaaacgtttttaaaccggggtttacccgggggaaaccgggggttaaaccggggtaaaccggttaaacggggggttaacgggtaaacggtaaaccgttaaacccgaaaacggttaaaccgttgggttaccggaccttacggacccttaacccgtgtttacccg

SEQ ID NO: 247794 - DNA, 513 bp, Homo sapiens
  misc_feature: GYAE6OF01CKFQ7.16.73.G07.1.454.CMB.1.raw
  modified_base (426)..(426): a, c, t, g, unknown or other
  misc_feature (426)..(426): n is a, c, g, or t
  modified_base (476)..(476): a, c, t, g, unknown or other
  misc_feature (476)..(476): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatcccggggtccctgaccgattccagtggcagcgggtctggggacagatttcactctcaccatcagcagccctgcaggctgaagatgtggctagtttattactgtnaacaatattataataattcatttaattcggacggaggaccaaggtcgganactacgaaacgaatgtaggctaggaccaccgtatacg

SEQ ID NO: 247795 - DNA, 852 bp, Homo sapiens
  misc_feature: GYAE6OF01DNYA1.16.73.G07.1.454.CMB.1.raw
  modified_base (230)..(230): a, c, t, g, unknown or other
  misc_feature (230)..(230): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgttttanataactccaaacaataagagtctacttagtcttaggtaccagacaacaaatcaaggaccagcctacctaagctagctctacttttacgtgggactactaccgtaaccccggggtaacgtccccgggggtacccctacggaccgtacttccgaaggttcgggaccgacgggtccggggttctacggggggactaaggtacttttacacccgttacctacccaacccctaacgttcccgaacggtaccgtaacggtaccccgtcggtaaccggaacggggtacccgttaaggggaaaacggttaacggtttgggttacgggttaaccggtttaaacggttttttaacgttttaaaccgtttacgggttaaacctaaaacccgtttaaaattttaaacgttttaaactttaaaaacttttaaaccctttaacccgttttaaagttttttaaaaccgggtttttacccggggttaaccgggggaaaaccgggggttaaaccccggtaaaagggggtttacggggtaaacggttaaacgttaaaaccccgtaaaaccgggttaaacccggttagggttaaccgggtacgttaaccggtaccgtaaaccccgttaacgtttaacccgg

SEQ ID NO: 247796 - DNA, 555 bp, Homo sapiens
  misc_feature: GYAE6OF01BISCP.16.73.G07.1.454.CMB.1.raw
  modified_base (419)..(419): a, c, t, g, unknown or other
  misc_feature (419)..(419): n is a, c, g, or t
  modified_base (498)..(498): a, c, t, g, unknown or other
  misc_feature (498)..(498): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
tcagtgtactactccacgaccggtgctcgatttagctctacgctcaggggtccgggagatcatgagggtgtccttgagtctgggggaggcgtggtccagccgtgggggtcgctgagactctcctgtgcagcctctggattcaccttcagtacctatgccatacactgggtccgccagcctccaggcaaggggctggagtgggtgctcttatatcatctgatgggagtactgaatactacgcagactccgtgaagggccgattcaccatctccagagacaattcccaagaacacactgtatctgacaaaatgaacagcctagagaactgaaggacaacggctactagtacttactgtagcggaagggacggggggccgggtagggacgccgtccgtccggacggggccatcgacgtccgnggggccagggactcccgtcggtcctacccggtctcctcgacgccctccacgaccgggcccacgtccgtcccttccccgngccgccctgcctccgngcncgccncgagcgcacngccggccgngggctcgccgtagg

SEQ ID NO: 247797 - DNA, 801 bp, Homo sapiens
  misc_feature: GYAE6OF01EPQH0.16.73.G07.1.454.CMB.1.raw
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
tcagtgtactactccacgaccggtgctcgatttagctctacgctcagggggctacaacaggcaggcaggggcagcaagatggtgttgcagacccaggtcttcatttctctgttgctctggatctcgtggtgccgtacggggacatcgtgatcgacccagtctccagactcctggctgtgtctcgtgggcgagacggccacatcaactgacaagtccagcctagtagttgtttanactaaccgtcaaacaagtaagngtactacgttagccttaggaaccagacaactaacgtcgaggacctacgccttacgtaagccttacgtaccttacttaacgttttacggcgggtacctacgttaccggtaacccggggtaacgttccccggggttaccctacggtaacccgttacgttaccggacggttccggtacgtacgggtcccgggtttacgtaacggggttaaccacggtttacttttcccgaaccgtttaccgtaccgtaaccgtagtcccgtaaggtcccgtacggttacccgtaggaaccggtacgggtacgttaacgggtaagtacggttcggtaccggttacgtttaacggttttactaccgttacgtaaccgttaaacgttaacgtttaagtttaacgttaaagttaaccgtttaccgtttaacggttttaaacggtcccggggtaaacgggttaccgggtaaacccgttaaggggttacgtaacggttaacgtaaccggttaaaaccggtgttaccgggtacgtaccgtacggtaccttaaacgtcgttaccgg

SEQ ID NO: 247798 - DNA, 612 bp, Homo sapiens
  misc_feature: GYAE6OF01DAB0H.16.73.G07.1.454.CMB.1.raw
  modified_base (317)..(317): a, c, t, g, unknown or other
  misc_feature (317)..(317): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgatgacccagtctccagactccctggctgtgtctcgtgggcgaggacgggccaccatccaactgcaagtccagccagagttgttttatataacctaccaacaataagagctacttagcttggtaccagacacaaatcaggacagccctacctaagctgctactatttacgngggactagtccgtaacccgggaattcccgtggtccctgaccgtattcaggtggcagggtcggtactggggactagtactttcacttcaccaccatccagcacgtcctgacgacggctaaggaaagtgtggtacggtctttaagttttattaccgtagtaaccaaacgtaaatttagttaaataaagttaacttccttaaagttttaacgttccgggagggttaacgggaacgtagggtaggaagtaactaaccgaaaacggtacgttggtaacggtctaacggcctaacccgtta

SEQ ID NO: 247799 - DNA, 601 bp, Homo sapiens
  misc_feature: GYAE6OF01E26VD.16.73.G07.1.454.CMB.1.raw
  modified_base (426)..(426): a, c, t, g, unknown or other
  misc_feature (426)..(426): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgttttatataacctccaacaataagagctacttagcttggtaccagcacaatcaggacagcctctaagctgctctatttacgtgggctactccgtacccggggtaacgtcccggggtccctcggaccgtattcgaggtggcaggcgggtctggggacagtattcacctctccaccatcagcacgcctcgacgaggctagaagtntcggtgtacttagttttacttacgtagtaacctaaactaattaattaaattaaacttaacttaccttaatttttaacggttcgggacgggtaacgggaacccgttaaggggtacggtaaggaactacgaaaaccggtacgttcggtacggtcttacggacctaaccgtgttaccg

SEQ ID NO: 247800 - DNA, 623 bp, Homo sapiens
  misc_feature: GYAE6OF01E4BXP.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactaccaacaataagagctacttagcttggtaccagcacaaatcaggacagcctcctaagctgctactactttacgtgggcacgttccgtacccgggtaacgtcccggggtccctagacccgtattcgagtcggcacggcgggtacgtgggtacagtactttcactctacaccactcacgcacgtccctcgacgtagcgtaggaagtagtggtacggtacgttagttttaacttacgtagtaccaaataagttaattaaattaaattaacttaccttaagttttaaacgttccggggacggtaaacggggtaacccgtaagggtacgggtaagtaacgtacccgtaaaacggtacgttaggtacggtacgtacgctaaccgtcgtttaccg

SEQ ID NO: 247801 - DNA, 746 bp, Homo sapiens
  misc_feature: GYAE6OF01DUM94.16.73.G07.1.454.CMB.1.raw
  modified_base (172)..(172): a, c, t, g, unknown or other
  misc_feature (172)..(172): n is a, c, g, or t
  modified_base (242)..(242): a, c, t, g, unknown or other
  misc_feature (242)..(242): n is a, c, g, or t
  modified_base (540)..(540): a, c, t, g, unknown or other
  misc_feature (540)..(540): n is a, c, g, or t
  modified_base (722)..(722): a, c, t, g, unknown or other
  misc_feature (722)..(722): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgatcgacccagtctccagacctcccnggctgtgtctcgtgggcgaggacggccacatcaactgacgaacgtccacgccaaggtagttagttttaanaactaaacctaccaaataaattaaggactaccttaaccgttagtcgttacgggtaaccagtacaaacaaatccgaagggtaacaccgaccctttaccaaggtcctacggacctttcgtaacgttttacgacgggtactaacggtacccggtaacccgggtaacggttccccggggtacctgaacccgttattccggagggtacggactacggggccgggttagtacggggaactacggttactttccggacttccctacgactacgaccgtaacgcgtacgccgtacgacgacgggtntaacgggagtagttcgggacgttacttagttttaacgtaaggtacctaacgtaaacttaatttaaacgttaaattaaacgttaacttacccgttaagttttaaccggtaccggggtacggtaaaccgggtaacgtaagggttaggtaaacgttaacgaaacgtaaccgtaggtcggttaacncgtaaccgtactaccgatttcccg

SEQ ID NO: 247802 - DNA, 579 bp, Homo sapiens
  misc_feature: GYAE6OF01A7HLM.16.73.G07.1.454.CMB.1.raw
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
tcagtgtactactccacgaccggtgctcgatttagctctacgctcaggggggctacgaacaggcaggcaggggcagcaagatggtgttgcagaccccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagtctaacttaaggcttaggtacccagcacaaatcaggacagcctcctaagctgctcatttacgngggacatccgtaacccgggaatccgtcgggtcccnggaccgtattcgaggtcggccaggtcgggtctagggactaggtactttcaactctaccacctatcagcagcctgcaggctaggaagtagtggtcggtacttagttttatactggtaaccaaacgtaattaattaattaaataacgttacctaagtttaaccgttcgggacgggtacggaaccgtagggtgaagtataccgaaaagtccttagggtcgactcggacacgta

SEQ ID NO: 247803 - DNA, 642 bp, Homo sapiens
  misc_feature: GYAE6OF01B9BQA.16.73.G07.1.454.CMB.1.raw
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
  modified_base (367)..(367): a, c, t, g, unknown or other
  misc_feature (367)..(367): n is a, c, g, or t
  modified_base (475)..(475): a, c, t, g, unknown or other
  misc_feature (475)..(475): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacggggacagtcgtgatcgtaccctagtctccagtactccgtggctgtgtctgtgggcgagcggccacgagtcaagtgcaacggtccagcagtagttgtttaanataactaccaaataataagagtacttactagcttaggaaccngacaacaaaatccgaagggaacgcctaccgtaacgctcgcgtaacttgttaacgtggactctaccgaccgggtacgaccggttccgngtaaccgtattcgagtcggacgtacggtcgggtacggtcggtaacgtgtaacgtttcctaaccgtcgttacccaacacgtaaccgtcgacgtacgacggtcgtaccgnggtaaccgtacgaagtacgttgtacgggtacttagtttaacttcgtataccgtaaataacgtaattaataactacttacttaacttagttaccggtaggacggtacgtaggtagggacactaagtaacgtaaccgtggtcgacgttcgaacctacgtgttacgttcg

SEQ ID NO: 247804 - DNA, 570 bp, Homo sapiens
  misc_feature: GYAE6OF01B3HMK.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgcctcatttactgggctatccgtacccgggaatcccggggtcctgaccgattcgagtcggcaggcgggtctagggacagtatttccactctacaccatcagcacgcctgcaggctagaagagtgtcggctagtttattacgtgtaactaactaattaattaataattaaacttaccttaagttttaacgtttcgggacggtaagggaacccgtaaagggtaggaagtaactaacgaaaacgtaacgttacgtacggactacggacaccgtagttccg

SEQ ID NO: 247805 - DNA, 680 bp, Homo sapiens
  misc_feature: GYAE6OF01DCB6W.16.73.G07.1.454.CMB.1.raw
  modified_base (250)..(250): a, c, t, g, unknown or other
  misc_feature (250)..(250): n is a, c, g, or t
  modified_base (351)..(351): a, c, t, g, unknown or other
  misc_feature (351)..(351): n is a, c, g, or t
  modified_base (427)..(427): a, c, t, g, unknown or other
  misc_feature (427)..(427): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcccgtacggggacatcgtgatcgacccagtctccagacctccctggctgtcgtctcgtgggcaggggggggggacaccaccatccaactgaccaacgtccagccaggtagttgttttaanactaacctaccaaacaagtaagagtctacttagctttacggtaccagacaacaaatcgaaggacacgaccctacctaaggcctagcctactagttttacgngggctacgtaccgtacccgggtatcccgtagggtccctggacccgtattccgaggtcgacgacgggtcgggtacgnggggtacaggttactttccgaccttctacctaccgatacacgcgacgcctagccgagggctaggaacgtagtcggtaggtacgtagttttacttacttaacgtactaaactaattaacttaaataattaacttacttaagttttaaaccgttccggggaacgggtacgggaaaccgtaaaggggttaggaaacggtaactaaccggtaaaacgttaggttacgggtacgtacgtacggaccctaacgttaccg

SEQ ID NO: 247806 - DNA, 800 bp, Homo sapiens
  misc_feature: GYAE6OF01ECIWV.16.73.G07.1.454.CMB.1.raw
  modified_base (236)..(236): a, c, t, g, unknown or other
  misc_feature (236)..(236): n is a, c, g, or t
  modified_base (332)..(332): a, c, t, g, unknown or other
  misc_feature (332)..(332): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctctgggcgagacgggccaccatcaactgaccaagtccagccagtagttgttttaanataacctaccaaacaataagagtccttaacttagtcttaggtacccagacaacaaatcgaaggaccacgccctaccgtaagctgctctatttacgnggactatccgtacccgggaacgtcccgggtcctacgaccgtattacgaggttcggccgagggtccgggtacgtcgggggaacctaaggtacgttttacccaaccgttccctaccctaaccctaacgttcccaacggcccgtaacggtccccgttacggaacccggtaacgggtaccgttaagggaaacgggtagttacggggttacgggtaaccgttttaaggtttttaacgtttaaccgttacgttaaaccctaaaaccgttaaatttaaattttaaacttaaaacgtttaaacctttaaccgtttaaaggtttttaaccgggtttaccggggtaaccgggggtaaacgggtaacccggttaaaggggtacgggttaaacgaacgttaaaacccggtaaaaacgggttaacccgtttagggttaccgggtacgttaccgggacccttaaccggtaccgtttacccgg

SEQ ID NO: 247807 - DNA, 606 bp, Homo sapiens
  misc_feature: GYAE6OF01ERL6E.16.73.G07.1.454.CMB.1.raw
  modified_base (233)..(233): a, c, t, g, unknown or other
  misc_feature (233)..(233): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggcccaccatcaactgcaagtccagccagagttgttttanataactcaaacaataagagctaacttagcttggtaccagcaacaaatcaggacacgcctcctaagctgctcatttactggcatcgtacccggaatccgtcgggtccctgaccgattcgagtggcaggcggtctgggacagtactttcaccttctcacctatccagcagcctgccaggctaggaactagtggtcggtacttaagttttacttactagtacctaaacgtaatttaattaattaaattaacttaccttaaattttaaacgttttccggggaacggtaagggtaacccgtaaaggggttacggaagtaacgttaaccgaaaaccggtaacgttacgggtaggtaccgttagaccctacccgttaacg

SEQ ID NO: 247808 - DNA, 728 bp, Homo sapiens
  misc_feature: GYAE6OF01BC729.16.73.G07.1.454.CMB.1.raw
  modified_base (232)..(232): a, c, t, g, unknown or other
  misc_feature (232)..(232): n is a, c, g, or t
  modified_base (321)..(321): a, c, t, g, unknown or other
  misc_feature (321)..(321): n is a, c, g, or t
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagttgttttanaataactccaaacaataagagtactacttagcttaggaccagcaacaaatcgaaggacacgtcctacctaagctcgctctactttacgnggctacgtccgtacccgggtaactcccggggtccctaggaaccgtnttcgaggtcggcgaggtccgggtcgngggactagttacgtttccaccttccgtacctacctattccgaagacccgtaacgtccccgttacgggaccgtaacgggtaccttaacgggaacgttacggttacggttacgggtaccgttttaaagtttttaacccgtttaacggttacgttaaacctaaaacggtttaaacttttaaactttaaacgtttaaaacttttaaacgttaccccgttttaaagttttaaaccgggtttcccgggaaaccgggttaacgggtaaacccgtaagggtacggtaagtaacgttaaccgaaaacgtacgtacgtacgtacgtacgacctaccgtgttaccg

SEQ ID NO: 247809 - DNA, 547 bp, Homo sapiens
  misc_feature: GYAE6OF01E44XV.16.73.G07.1.454.CMB.1.raw
  modified_base (414)..(414): a, c, t, g, unknown or other
  misc_feature (414)..(414): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttaatataactccaaacaaataagagctacttagcttggtaccagcaacaaatcaggacgcctcctaagctgctctatttacgtgggcatccgtacccgggaatccgtcggtccctgaccgattcagtggcaggcgggtctgggacagtactttcactctacaccatcagcagccctgcaggctgaagntgtgctagtttatactgtacaactaatattaataaataacttacctattttaacgttcgggacgggtaacgggaacctaaggggtgaagaactaccgaaaacggtaactggtacgtctacggcacctattccg

SEQ ID NO: 247810 - DNA, 599 bp, Homo sapiens
  misc_feature: GYAE6OF01EPVKI.16.73.G07.1.454.CMB.1.raw
  modified_base (227)..(227): a, c, t, g, unknown or other
  misc_feature (227)..(227): n is a, c, g, or t
  modified_base (304)..(304): a, c, t, g, unknown or other
  misc_feature (304)..(304): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccagagttgtttanataactccaacaataagagctacttagcttggtaccagcacaaatcaggacagcctcctaagctgctctatttacgngggacacgtccgtacccgggtaatcccggggtccctgaccgattcgagtggacaggcggtcgtagggacagtattacgactctcaccatacagcagcctgaccgaggtcctagaagtagtgtgtacgtagttttacgtactgtactaactaagttattaaactaattaacttacctaattttaacgttcggggtaaccggtaacgggtaacccgtaaaggggtacggtaagtaacgttaacccgaaaaacgtaacgttacggtcggtacgtacggaacctaaccgtcgttaaccg

SEQ ID NO: 247811 - DNA, 711 bp, Homo sapiens
  misc_feature: GYAE6OF01C9VJ3.16.73.G07.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggaggccaccatcaactgcaagtccagccagagttgtttanataactccaaanaataagagtctacttagcttaggtaccagcaanaaatcaggacagcctacaagctgctactatttacgcggactagtacgtacccgggtaatccccggggtcctaggaccgtacttcgaacggttcggacgaacgggtccgggtctacgggggaactaaggtacctttacaccgttcctaccgaacctacttaccgaacgtccaacggtccccgttaggaaccgtaacgggtccgttaaggaaacggttaacgtagggtacgtaccgtttaaggttttaacgttaccgtacgtaaacctaaacttaaacgtttaaagtttaaacttaaataaccgtttaccgttaattttaaccggttaccggggaacgggtaaacggtaaccgaaagggtacggtaagtaacgttaaaccgaaaacgttaccgttaggtaccgggtactacccggtaacgaacccgttagttaccgg

SEQ ID NO: 247812 - DNA, 748 bp, Homo sapiens
  misc_feature: GYAE6OF01CPWW9.16.73.G07.1.454.CMB.1.raw
  modified_base (238)..(238): a, c, t, g, unknown or other
  misc_feature (238)..(238): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgatcgacccagtcctccagacctcccgtggctgtcgtcctcgtgggcgaggacggccacatacaactgacaacgtccacgaccaggtagttntttaacaataacctaccaaactaaagtaagactcttaacgttagtcgttacggtaccaagaccaaactaaagtccgaaggactacctaccccgtaacctaacggctacgtccttacttacgtttacgcgggtacctaacgttcccgggtaacccgggtaaccggttcccccggggtacctacggtaaccgtacgtacgtacgggtcggtacggacgggtccgggtacggtacggggtactaggttacctttccgacctccgtaccgaacctagttaccgcggtaccacggtccgtcggtacgacgggtactaggaacgtaggttcggacggttacgttagtttaattaccgtagtaacctaaagttaatttaacttaagttaacttaaacttaccgtttaacgttaacggttccgggaacgggtaccggaaacggttaagggtacgggtaaatacgtaaacgtaaccggtaaggttcggtaccgacgttacgacctacgttcgtttaccg

SEQ ID NO: 247813 - DNA, 569 bp, Homo sapiens
  misc_feature: GYAE6OF01AEDOM.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttatataactccaaacaataagagctacttagcttggtaccagcaacaaatcaggacagcctacctaagctgctctatttactgggcataccgtacccgggaacgtcccggggtccctggacccgtagttcaggtcggcaggcgggtcgtgggacagtatttcactctcacatcagcacgcctgcaggctagaagtgtgtggacttaagtttacttactgtaccaaagtaatttaattaataataacttacttaagttttaagttccgggagggtaacggaaccgtaaagggtggaagtactaacgaaaaccgtaagtggtcgacttagaccaactgttcccg

SEQ ID NO: 247814 - DNA, 690 bp, Homo sapiens
  misc_feature: GYAE6OF01CTQ1V.16.73.G07.1.454.CMB.1.raw
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccgccagcctccaggcaaggggctggagtgggtggctcttatatcatctgatggaggtactgaatactacgcagctccgtgaagggccgattcaccatctccagagacaacttcccaagaacacactgtatctagacaaatgaacagcctagagaactgagacacggctctatattacgtgtcgcggagggcgggggcggtgggagccgtcccgtccggaccggggccacgtcggaacctcccgggtacggggcccgaacggggtaaccccgtgggtaccctacccggttcctcccgtcgaccgtccctacccaacccgaaccgggtcccaacgttcccggttccccttcccccggtcggacccctacccccgttccctaacccgaacggtaccgacccgtaacccgttcgggttccggggggaccctaaccggaccgggccccgggtcccccggttacgggggccccgttaccgggtccccggttacggggtaacccggtaaaccggggttaaacccccg

SEQ ID NO: 247815 - DNA, 842 bp, Homo sapiens
  misc_feature: GYAE6OF01B7KXX.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatcgacccagtctccagactccctggctgtcgtctcgtgggcgagacgggccaccatcaactgacaacgtccagccaagtacgtttagttttaataataaccttaccaaactaaataaggacgtacttaacgttagtactttacggaaccctaagaccaactaaaactccgaacgggtaccacggtaccccttaccgtaaacggtcctacgtccttaacgtacttttacggacgggactaacgttacccgtaaccccggggtaacgttccccggggttaccctacggaccgtacgttacgacggttacggaccgagggtccgggttacggtagggtacgtaacgttacttttccaaccgttcaccctaaccattaccgagtaccacggtcccgtacggacgtaacgggtccgtaaggtaacggtagttcggggtaacggttacctttaaggtttttaacttaaccggtactttaaaccgtaaacctttaaagtttaaacttttaaacctaaaagtttaacccttttaacccgtttaagtttttaaacccggttacgggggaaaccgggttaaaccgggggtaaacggttaaaggggttacggttaaaaggtaaaccgtttaaaccggtaaaaaccggttaccggttggggttaaccggtacggttaaccgtaacccttaacggacttttaaccgg

SEQ ID NO: 247816 - DNA, 787 bp, Homo sapiens
  misc_feature: GYAE6OF01EBPAG.16.73.G07.1.454.CMB.1.raw
  modified_base (339)..(339): a, c, t, g, unknown or other
  misc_feature (339)..(339): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatcgacccagtctccagacctccctggctgtgtctcgtgggcgaggacgggcccaaccataccaactgaccaacgtcccagccagtagttgttttaataactaacctaccaaacaaataagacgtactaacttagcgttaggtaaccagacaacaaatcgagacacgccctactaagctcgctctagttcgnggacagtccgtaccggtacgtcccgggtcctacgaccgtatcgagtgcgtaggcgggtcgtagggactacggtactttaccgacttccctaccgtaacctacgtaccgaacgtaccgtaacggtccccgttacgggaccgtaacgggtacgttaaggggaaacgttaggttacgggtacggttaacccgtttaagtttttttaaccgtaacgttaacgttaaccttaaaacgttaaattttaaactttaaaacgttaaactttaaaccgtttaaccgttttaaacgtttttaacggggttacccggggaaaccggggtaaaccggggtaaaacccggttaagggggtaacggtaaaggttaaaccgttaaaacccgggtaaaaaccggttacgtttaacggggtcggttaacccgtaccggaaacccctaaccgttacggtttacccg

SEQ ID NO: 247817 - DNA, 624 bp, Homo sapiens
  misc_feature: GYAE6OF01BX5IP.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagttgttttatactaacctccaaacaataagagctacttagcttggtaccagcacaaatcaggacagcctacctaagctgctctatttacgtgggctagtcccgtacccgggtaacgttcccggggtccctaggacccgtagttcgtaaggtcggactacgggccggggtcgtacggggaacctaggtacttttccaccgtccttacccaacctatacgacggcaccgtcccgtgaccgtaggtctaagggaagtacgtggtaggtacttaagttttacttacgtgtaacaactaattattaaataattacttactaagtttaagttcgggaaggtacggacgtaagggtcggaagtactaaccgaaacgtcgttaggtacggtctaacgcctactacgttccg

SEQ ID NO: 247818 - DNA, 720 bp, Homo sapiens
  misc_feature: GYAE6OF01CF3T0.16.73.G07.1.454.CMB.1.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (401)..(401): a, c, t, g, unknown or other
  misc_feature (401)..(401): n is a, c, g, or t
tcagtgtactactccacgaccggtgctcgatttagctctacgctcagggggctacaacaggcaggcagggggcagcaagatggtgttgcagacccaggtcttcatttctctgttgctctggatctcgtggtgccgtacggggacatcgtgatgacccagtctccagacctcccgtggctgtgtctcgtgggcgagacggccaccatcaactgacaagtccagccagtagttgttttatataacctaccaaanaataagntactacttacgcgtttacggacctagccaacaaatcgaaggacacgtccttactaagcttcgcttacgtatttcgacgggctaacgtccgtaacccgggacgttcccggggtccctaggtaccgtagttccgagggttccgngtacggtccgggtgtacggggactagtaactttccaacgtctaccgacctatccgacgtactacgtcccgtgacgaacgggtctagtaacgtaggtaccggtaggtacctttaagttttacgttaaccgtagtaaacctaaagttacttaacgtttaaacttaaagtttaaaccttacccgtttaagttttaaccgggtttaccgggacggggttaaaacggtaccggtaaaggtcgggtaacgttaaacggtaaccccgtaaaaagggttcccagggttaccggacctttaccggaaacccttcgtaagtttaccccg

SEQ ID NO: 247819 - DNA, 647 bp, Homo sapiens
  misc_feature: GYAE6OF01E5ZBQ.16.73.G07.1.454.CMB.1.raw
  modified_base (309)..(309): a, c, t, g, unknown or other
  misc_feature (309)..(309): n is a, c, g, or t
  modified_base (327)..(327): a, c, t, g, unknown or other
  misc_feature (327)..(327): n is a, c, g, or t
  modified_base (641)..(641): a, c, t, g, unknown or other
  misc_feature (641)..(641): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagacggccaccatcaactgacaacgtccagccagtacgttgttttaatataacctaccaaactaaataagagaccttacttagcttggtaccagcaacaaatcgaggaccacgcctacgaanctgcctactactttacgngggactacgtccgtaacccgggtacgtcccggggtacctacggaccgtattacgaggtcggacgtacggcgggtcgtacgggactagttacttccaccttccgtaccaccgatacgacgacgtacgccctagccgtaaggtcctaaggaagtagttggtacgtacttagttttaacttacgacgtaactaaataatttaattaattaattaaccttaaccttaagttttaagttaccggggaacggtacggtaacgtaagggtgtaagtaacgtaaacgaaacgtacgtggtacggtactacggaccctacgtnttaccg

SEQ ID NO: 247820 - DNA, 559 bp, Homo sapiens
  misc_feature: GYAE6OF01B5YSW.16.73.G07.1.454.CMB.1.raw
  modified_base (229)..(229): a, c, t, g, unknown or other
  misc_feature (229)..(229): n is a, c, g, or t
  modified_base (412)..(412): a, c, t, g, unknown or other
  misc_feature (412)..(412): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaaacaataagagctacttagcttggtaccagcacaaatcaggacagcctcctaagctgctcatttactgggcatctacccgggaatccggggtccctgaccgattcagtggcaggcgggtctgggacagatttcactctcaccatcagcacgcctgcaggctagaagtatgtggntagtttattactgtacaacaattattaataattaactacctaatttaacgttcgggtacgggtacgggtaacccgtaagggtacggtaagaacgttaccgaaaacggtaacgttaggtacggtactagacctaaccgtagttacccg

SEQ ID NO: 247821 - DNA, 507 bp, Homo sapiens
  misc_feature: GYAE6OF01AP12X.16.73.G07.1.454.CMB.1.raw
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (414)..(414): a, c, t, g, unknown or other
  misc_feature (414)..(414): n is a, c, g, or t
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcaacaaatcaggacagcctcctaagctgctcatttactgggcatccgtacccgggaatcccggggtccctggaccgtattcgagtcggcaggcgggtctggggactagtatttcactctcaccntcagcngcctgcaggctagaagntgtgctagtttactactgtacaactattattaataatatctatttagtcggnggaggacaggtganactacaaagatgtgctagcncgtntcg

SEQ ID NO: 247822 - DNA, 823 bp, Homo sapiens
  misc_feature: GYAE6OF01BTXCE.16.73.G07.1.454.CMB.1.raw
  modified_base (235)..(235): a, c, t, g, unknown or other
  misc_feature (235)..(235): n is a, c, g, or t
  modified_base (283)..(283): a, c, t, g, unknown or other
  misc_feature (283)..(283): n is a, c, g, or t
  modified_base (331)..(331): a, c, t, g, unknown or other
  misc_feature (331)..(331): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagtagttgttttanataacctccaacaataagagtactacttagcttaggtaccagaccaanaaatcgaaggaccacgccctaccgtaagctgccttactacgtttacgngggacctaacgtccggtaacccgggtaacgttcccggggtccctaggacccgtagttcgaaggttcggaccgtacgggtccggggttacgtacggggaactaaggtcctttaccaccttcccgtaccaaccctagtacccgacggtacctaacggtccccgttaggaccgtacgggtaccctaagggaaacggtgttacgggttacgggtacctttaaggtttttaaccgttaccgttaacggttaacctaaaccgttaaattttaaactttaaaagtttaaaactttaacccgtttaccgttttaaaacggtttttaacgggtttaccccggggggaacgggtttaaaaccggggtaaacccgggttaaaaggggttacggggtaaaacggttaaccgtttaaaacccgggaaaaaccgtttaccggggtttacgggttacggggtaccccttaacgggtaccccttaaaccccgttaggttttaccccgg

SEQ ID NO: 247823 - DNA, 973 bp, Homo sapiens
  misc_feature: GYAE6OF01AYMTZ.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctcgtggtgccgtacgggacagtcgtgatcgacccagtctccagacctcccgtggctgtgtccgtgtgggcgaggacggcccacctatccaacgtgacgtaacgtccacgtaccgaggtagtttagttttaactaacttaacctaacccaaactaaaacgttaaaggacgttaccttaaaccgtttacggtaccgtttaccgggtaaaccaacggtaacctaaacgtaaaaacgttccgaaacgggtaacccacccggtacccctttaacccgtaaaggtccttcggtacctttaaccgtttaaacggttttccggaaccgggtacctaaccggtttaacccccgggtaaaccccggggtaaccggtttcccccgggggttaccccttacgggtaaaccccgttacggtttaccgggaaacgggtcccggaacggggtaccgggtccggggtttaccgtaacgggggtaacgttaaaccgtttaccggttttaccaaccccggtttactaaccccgtaacctaccgtaaccgccgttaccgaacggttccccgtaggccgttaaccgggtagtaaccgtagggtaccgtttgggtaccggtttaactttaaacgtttttacctaaccggtttaacctaaacgtaaaacctttatttaaaagtttaaacgttaaacgtttaaaccctttaaaccgtttaggtttttaaccccgggtacgggaaccgggtttaaacgggtacggttaaaacggggtgaaaacggtttaaccgtaaaaccgggttaaaaagtcccgggttttaaggaccggttaccccggttaaagtaacctaaccccggtttcgtaaacccgg

SEQ ID NO: 247824 - DNA, 788 bp, Homo sapiens
  misc_feature: GYAE6OF01BNS25.16.73.G07.1.454.CMB.1.raw
  modified_base (254)..(254): a, c, t, g, unknown or other
  misc_feature (254)..(254): n is a, c, g, or t
  modified_base (384)..(384): a, c, t, g, unknown or other
  misc_feature (384)..(384): n is a, c, g, or t
tcagtgtactactccacgaccggtgctcgatttagctctacgctcagggggctacaacaggcaggcaggggcagcaagatggtgttgcagacccaggtcttcatttctctgttgctctggatctcgtggtcgccgtacgggacatcgtgatcgacccagtctcagacctccgtggctgtcgtctcgtgggacgacggacggcccaccactaccaaacgtgacctaaacgtccacgccaaggtagttgttttaanaactaaacctaccaaataaagtaagactacttaacgttaggtcgttacggtaaccagaacctaaacaaaactccgaaggaacctaacgtaccctaaccgtaaggccttcgtacttacgttacgtttacgnggacctacgtacccggttaaccgggaacgttccccgggtactacggaccgttagtcgacggtcgacgacgggtccgggtcgtacggactacgttactttccaacttcctaccgtaacctacgtccgaacgtccgaacgtacctacggaccgtaacggacgtaagaacggactttacgggacgttacgttaagttttaacgtaaccgttaacgtaaacctaaattaacgtaaattttaaacgtaaactttaaacttaacccggttttaaatttaaccgggttaacggaacggggtaaaccggttaaccgggtaaagggtttacggaaaggttaaaccggtaaaccgttaaaaccggttacggtaccggtaagggtaccctaacgtaccgtaccgtaacgttcccg

SEQ ID NO: 247825 - DNA, 568 bp, Homo sapiens
  misc_feature: GYAE6OF01C4FXK.16.73.G07.1.454.CMB.1.raw
  modified_base (229)..(229): a, c, t, g, unknown or other
  misc_feature (229)..(229): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcactttactgggcagtctacccgggaatcccggggtcctgaccgattcgagtggcagcgggtcgtagggactagtacttcacgtctcacgatcacgcacgctgacgagcctagaagtagtggtgtacttagtttacttacgtacgtaactaaagtaacttaattaataaataacttaccttatttaacgttcggacggacgggtaacgtaagggtaggaagtaacgtaaacgaaaacgtaacgtggtacggtactagaaccacctgttaccg

SEQ ID NO: 247826 - DNA, 590 bp, Homo sapiens
  misc_feature: GYAE6OF01CGNTK.16.73.G07.1.454.CMB.1.raw
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (425)..(425): a, c, t, g, unknown or other
  misc_feature (425)..(425): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactggacaacgtccagccagacgtgttttatataacctaccaacaaataagacgactaccttagcttaggtaccagcaacaaatcaggacagcctcctaagctgctcatttcnggcatcgtacccggagtccgggtcctgacgtntacagtgcgngcggtctggacagtattccagctacccgatatcgacgacacgccctagacgacggtactacggaaagngttgggtacggcgtttaaacggttttattaaccgttcgtaactaaaaccgtaagttttaaacttaatttaaacttaacttaccttagttttaaacgttccgggaggtaaacgggactaagggtgaagtaacgtacaaaacgtattggtaggaccngaccntagtc

SEQ ID NO: 247827 - DNA, 732 bp, Homo sapiens
  misc_feature: GYAE6OF01DRR4N.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagagtgttttatataactaccaacaaagtaagacgtacttaaccttaggcctttacgggtaacccaggtaccaaactaaaacgtccgaagggaccaacgtcccctacctaaaggccttagccttactagttttacgtcggggactaacgtccgtaacccggggtaacgttccccggggtaccctcgaaccgtattcgacgggtggacctagggtccggggtactacggggactaacgttatttccaccgttctaccgaaccctagtaccgacggacacgtcccgtacgacgaggtaccgtaggaaagtagtcggtggtacctttaaggtttaacttacgtacgtaaccgaaacttaacttaatttaaattaaacgtttaaacttaaccctttagtttttaaaccgggttcggggtaacgggtaaacgggttaaccgtaaaggggttcggtaaagtaactaaccgaaaacgttaccggtggttacggactacggaccctaactcgttacccgg

SEQ ID NO: 247828 - DNA, 695 bp, Homo sapiens
  misc_feature: GYAE6OF01D4P28.16.73.G07.1.454.CMB.1.raw
  modified_base (172)..(172): a, c, t, g, unknown or other
  misc_feature (172)..(172): n is a, c, g, or t
tcagtgtactactccacgaccggtgctcgatttagctctacgctcaggggtccgggagatcatgagggtgtccttgagtctgggggaggcgtggtccagcctgggggtcgctgagactctcctgtgcagcctctggattcaccttcagtacctatgccatacactgggtccnccagcctccaggcaaggggctgggagtgggtgctcttatatcatctgatggagtactgaatactacgcagactccgtaggaacgggcgattcaccatcctaccaagacgaacaacttccccaagaaccacacttagtatctagacaaatcgaacagcctagaacgaacgtagacgacgacggtctactaattatacgtgtagcggaggggacggggcggtggacgtctacccgtaccgacgggaccagtacgtaccgtccgggtacggggccgtaacgggtacctcccggtcggttccgtaccccgttccgtccctaccgaccgtaccccgtacccgtaacccggaaccgggtaccccctaacggttccccggttaccccgtttccccccggtaccgggtcccgtaccccgttccggtcccgttacccggacggaccgtacccgtacccgtaccggacgaccgtaaccgcccgaaccgggtcccggtaccccgggttaggcccgttccggccgttacccgggg

SEQ ID NO: 247829 - DNA, 699 bp, Homo sapiens
  misc_feature: GYAE6OF01CRBUY.16.73.G07.1.454.CMB.1.raw
  modified_base (125)..(125): a, c, t, g, unknown or other
  misc_feature (125)..(125): n is a, c, g, or t
  modified_base (187)..(187): a, c, t, g, unknown or other
  misc_feature (187)..(187): n is a, c, g, or t
  modified_base (255)..(255): a, c, t, g, unknown or other
  misc_feature (255)..(255): n is a, c, g, or t
  modified_base (290)..(290): a, c, t, g, unknown or other
  misc_feature (290)..(290): n is a, c, g, or t
  modified_base (410)..(410): a, c, t, g, unknown or other
  misc_feature (410)..(410): n is a, c, g, or t
tcagtgtactactccacgaccggtgctcgatttagctctacgctcagggggctacaacaggcaggcaggggcagcaagatggtgttgcagacccaggtcttcatttctctgttgctctggatctntggtgccgtacggggacatcgtgatcgacccagtctccagacctcccgtggctgtgtctcgngggcgaggacggcccacatacaactgacaacggtcacgcagtagttagtttaatactaacctacaaanaataagatctaacttgacttacggaccagaccaanaaactcgaaggacacgcctacctaagctcgctactaactttacgcggactacgtaccgacccgggtaacgtcccggggtcctagtacgtattcgaacggtcggtaccgaggtccggggtntacggggtaccaaggtttacctttacaccgtccctactaacctagtaccgaacgtcgaacgtccctaggaccggaggcgtaagaaacgtagttcgggtaggttacttaaggttttaacttaacgtacgtaactaaacgtaatttaaataacttaaaacgttaacctttaagttaaattttaccggttacggggaacgggtacgggtaacggtaagggaccggttaaagaacttaaccggaaaaacgtagttaggtaccgggtactaccggacctacgttaaccgttccg

SEQ ID NO: 247830 - DNA, 730 bp, Homo sapiens
  misc_feature: GYAE6OF01CX5HI.16.73.G07.1.454.CMB.1.raw
  modified_base (173)..(173): a, c, t, g, unknown or other
  misc_feature (173)..(173): n is a, c, g, or t
tcagtgtactactccacgaccggtgctcgatttagctctacgctcaggggtccgggagatcatgagggtgtccttgagtctgggggaggcgtggtccagccgtgggggtcgctgagactctcctgtgcagcctctggattcaccttcagtacctatgccatacactgggtccnccagcctccaggcaaggggctggagtgggtgcttctatatcatctgatggagtactgaatactacgcagaccttccggtaggaacgggccgattccacctatcctaccaagagactaacttcccaagaacacactgtatctgacaatcgaacacgcctagacgaacgtgaacgacaacgtctacttattattacgtggtcggcggagggacgggggggtccggtggggacgtccgtccgtcccggacggggtcccaggtcgaccgtccggtcggggccgtacggggacctcccggtcggtaccctacccgttcctcccgtccgacgtcccctacccgaccggtaaccgggtcccctaacggttcccgggttacccccttcccccggtacgggccccgtccccgtacggtccccgttacccggacgggtacccgaccccggtaaccccggttacccgggaacggtacccggacccgtaaaccccgggtaccggggtaccccggggttcccccggtaccggggggttccccttcccggggccccggttaaacccggggg

SEQ ID NO: 247831 - DNA, 636 bp, Homo sapiens
  misc_feature: GYAE6OF01AU40H.16.73.G07.1.454.CMB.1.raw
  modified_base (316)..(316): a, c, t, g, unknown or other
  misc_feature (316)..(316): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagacggccacatcaactgcaagtccagccagagttgtttatataactccaacaataagagtactacttagcttaggtaccagcaacaaatcgaaggaccaagcctacctaagctgctactagtttacncgggcagtaccgtaacccgggtactccggtcgggtccctacgaccgtacttcgacgtcggcgtaggtccgggtactaggggaactaggttacttccactcctacgacctatccgaacgcacgtcctggacgaggtcgagaaggtactggtcggtacttaagtttacgttacgttacgtaacctaaacgttaattaaacttaaattaaacttaacgtttaccttaaagttttaaccgttccgggtaaacgggacgggtaaccggtaagggtagtaaacggactaacggaaacgtacgttagtcggactcgactaccgtacg

SEQ ID NO: 247832 - DNA, 769 bp, Homo sapiens
  misc_feature: GYAE6OF01D9UQK.16.73.G07.1.454.CMB.1.raw
  modified_base (732)..(732): a, c, t, g, unknown or other
  misc_feature (732)..(732): n is a, c, g, or t
tcagtgtactactccacgaccggtgctcgatttagctctacgctcagggggctacaacaggcaggcaggggcagcaagatggtgtgcagacccaggtcttcatttctctgttgctctggatctcgtggtgccgtacggggacatcgtgatcgaccagtctccagacctccgtgctgtcgtctcgtgggcgaggcgggaccaccactaccaactgacaacgtccacgaccaggtagtttagttttaataacttaacctaccaaaactaagtaacgagtaccttaacttaacgtcgttacggtaaccacgactaaaactaaactacgaacgaactacggacccttaccgtaaggtctacgtcttaccgtaacgtttacgcgggtactacgtacccggtaacccgggtaacgttcccgggtaccctaggtaccgtacttcggacggtcggacgtacgggtcgggttacgacggggtacctaggttacttaccgcgttacctaccgaactaccttcggaacgtctaaccggtcccgtaagaccgtagggtactaaggtaaacggtggttacggtcggttaacttttaacgttttactaaccggttaactaaactaaaccttaaatttaaacgtttaaacttaaacttaacgtttaacctttaacgttttacgggaccgggtaagggtaaacggaaccggttaaggggtacctaaggtaccttaaacggaaacggtnttcgggtacgaccttacgactaaaccgttgtttaccg

SEQ ID NO: 247833 - DNA, 684 bp, Homo sapiens
  misc_feature: GYAE6OF01B8117.16.73.G07.1.454.CMB.1.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
tcagtgtactactccacgaccggtgctcgatttagctctacgctcagggggctacaacaggcaggcaggggcagcaagatggtgttgcagacccaggtcttcatttctctgttgctctggatctcgtggtgccgtacggggacatcgtgatcgacccagtcctccagacctcccgtggctgtgtctcgtgggcgaggacggccaacntcaactgacaagtccagcagtagtntttanaataaccaccaaanaanaagagtactactagtcttacggtaccagacaacaaatcgaacggacctacgtaccctacctaacgcctcgaccttactacgttttacgcggacctacgtacccggtaaccccggtacgtcccgggtccctacggaccctagttacgacggtaggaccgagggtccgggtgtacgggactagtacttcgactcctacaccatcgacncgtcgccngcgagctagaagtgcgtagtactttacgtttactaactacgtaacctaaagtatttaaacttaaacgtaaactttaacgttaacgtttaggtttaaacccggtttacggggaaaccggtaacggggtaaaccgttaagggtacggttaaacgtaacgtaacgtaaacccggtagttacggtacggtacttaccggaaccttaacggtctttaccgg

SEQ ID NO: 247834 - DNA, 732 bp, Homo sapiens
  misc_feature: GYAE6OF01E4QR9.16.73.G07.1.454.CMB.1.raw
  modified_base (488)..(488): a, c, t, g, unknown or other
  misc_feature (488)..(488): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatcgacccagtctccagacctcctggctgtgtctcgtgggcgaggacgggccaccatccaactgactaacgtccagccgtagtagttagttttatacgtaactaccaaactaaagtaagacgtacttaacgttacgtccgttacggtaccacgacaacaaactcgaaggtaccacggtcctaccgtaacgctcgtaccttaccttaagtttccggtcgggtacctacgttaccccggttaaaccccgggtacgttcccggttacgggtccctaacggtaccgttagttccggaggtcggaccggtacgggtcggttacgtacgggactagtactttaccnccttaccgtacaccctaacgttcgacgtaccgtaccgtccgcggtcgacggtcgtaaggaacgtagtcggtagggtttactttaacggtttacttaacttcggtaaaccttaaacgttaattttaaacttaagttaaacttacgtttaccgttaagtttaacggttcgggaccgggtaaacggtaacggtaggtagtaacgtaacgtaaccgaaaggtacgtgggtacactacgactccgtacg

SEQ ID NO: 247835 - DNA, 958 bp, Homo sapiens
  misc_feature: GYAE6OF01EHUKA.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgccgtacggggacagtcgtgatcgaccccagtcctccagacctccctggctgtcgtctcgtgggcgaggcgggccaccataccaactcgactaacgtcccagccaaggtagtttagttttaataacttaaacctaccaaaactaaagtaacggacgtaccttaacttacggtccttacggtaacccagtaccaaataaactccgaaggaccacgacccttaccgtaacgtccttacgaccgttacttaacgttttaccggacgggtacctaacggttaccccgggttaaaccccggggtaaaccgggtttcccccgggggttaaccccttacggaaaccccggttagtttaccggaacgggttccgggacggtaccggggtaccgggggttaccggtacggggaaaccttagggttaacctttacccgaaccttcccgtaaccctaacccgtagtcccgaaacggtccgtaccgttcccgtacggacccgtaagggtaccgttaagggtaaacgttggtttacgggtacgggttaacccgttttaaaggtttttaccttaaaccggtaccgttaaactaaaaccgtttaaattttaaaattttaaaaccgtttaaaacgtttaaacccgttttaaccggttttaaacggttttttaaacccggggttacccgggggaaaacgggggttaaacccggggttaaaaccggggttaacggggttaaacgggtaaacgttaaaacccggtaaaccgttaaaaccgggttaacggttccgggttaaacgggtaccttaaccccgggtaaccctacggttacggtttaacccccg

SEQ ID NO: 247836 - DNA, 661 bp, Homo sapiens
  misc_feature: GYAE6OF01DS5FX.16.73.G07.1.454.CMB.1.raw
  modified_base (378)..(378): a, c, t, g, unknown or other
  misc_feature (378)..(378): n is a, c, g, or t
  modified_base (425)..(425): a, c, t, g, unknown or other
  misc_feature (425)..(425): n is a, c, g, or t
  modified_base (649)..(649): a, c, t, g, unknown or other
  misc_feature (649)..(649): n is a, c, g, or t
  modified_base (654)..(654): a, c, t, g, unknown or other
  misc_feature (654)..(654): n is a, c, g, or t
tcagtgtactactccacgaccggtgctcgatttagctctacgctcagggggctacaacaggcaggcaggggcagcaagatggtgtgcagacccaggtcttcatttctctgtgctctggatctcgtggtcgccgtacgggacatcgtagatcgacctacgtcctccgacgtcctccgtggctgtcgtctcggtgggacgaggacggacctacactaccgacgtacgacaacggtccacgacgtaagttagttagtttaaacactaacctaaccgaaataagtaaggtcttacctaagttacgtacgttacgaaccagaaccaacaagtcgaacggtacacgtaccctaacgacgtctacggacttacgtagttaccggnggtactaacggtccggaaccggtaccgtcccgggtccagaaccggtntacggtagtcggaacgtcggtccgggtagacgacgtagtttacctcaccgttcgaacctacgtacgaccgacgtacgtaccgtgtacgacgtacgtagtaccgggtaatacggtcgtacggtaactttagtttaccagttactaaacctaataacgttataaataacgttactacgttaggttacgtacgaggtacgaggtagagactagaagctagcgtgacncgctncgttacg

SEQ ID NO: 247837 - DNA, 666 bp, Homo sapiens
  misc_feature: GYAE6OF01CWM4R.16.73.G07.1.454.CMB.1.raw
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgatcgacccagtcctccagactcccgtggctgtgtctcgtgggcgagacggccaccatcaactgacaagtccagccagtagttgtttanactaactaccaaactaagtaagngtacttaacttaggctttaggaccagacaacaaactcgaggaccacgtcccttacaagctgacctactagtttacgcggactacgtacccggtaacccggacggtcccgggtaccctcgaccgtagttcgaggtcgacgaggtcgggtcgtagggactacgtacttccgaaccttctccgaactacgtccgaacgcgaccgctacggcgtaggacgtaggaagtagtcggagtacgttaatttacgttacgtacgtaaagtaacttaaagttaaactttaataaacttaaacgttaccttaagttttaacggtacgggtaaccgggtaacgggtaacgtaagggacggttaagaaacgtaaacgtaaacgtacgtagtccggaactggtaaccctaacgtgttacccg

SEQ ID NO: 247838 - DNA, 530 bp, Homo sapiens
  misc_feature: GYAE6OF01B0593.16.73.G07.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttanataactacaacaataagagctacttagtcttggtaaccagacaacaaatcgagacagcctactaagctgctcatttacgnggacactcgtacccgggaatcccggggtcctgaccgtattcgaagtggacacggtcgggtctggggaacagtactttccactctacacccgtatccagcaacgcctagcgagctaggaangtgtgctagtttatacntacaaatatataataatatactatttagtcggaggtacggactaaggtgaatactcaaagtacaggtcgactagacctagctcg

SEQ ID NO: 247839 - DNA, 810 bp, Homo sapiens
  misc_feature: GYAE6OF01DSA6Y.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatcgacccagtctccagacctccctggctgtgtctgtgggcgagacggccaccatcaactgacaacgtccagccagtagttgttttaatactaacctaccaaacaataaagacgtacttaacttagtcgttacggtaaccagaccaaacaaaactcgaaggaaccacggtaccccttaccgtaagtccgttacgtccttacttaagttttaccggtacgggtacctaaccgttaccccggtaaaccccggggtaaccggttcccccgggggtaccctacggtaaccgttagttcgtaacgggtcggacgacgggtcggggtaccgtaggggactacgttactttcccacgttacctaccgaaccctcgtaccgacgccgtaacgcccgttacgacggtacgggtacgtaggtaaagttcggttacggtacggttaacctttaggtttaacttaaccgtaacgttaactaaaaccgttaaattttaaacttaacttaaaacgtttacccttaacgtttaaggttttaaccggtttaccgggggaaacgggtaaaccgggtaaagttaaacgggggtacggtaaaagttaaacgtaaacccgggtaaaaacggtacttggggtacccgtacgtaaccgaaccccgtaacgttaggtttaccccg

SEQ ID NO: 247840 - DNA, 721 bp, Homo sapiens
  misc_feature: GYAE6OF01CAN7I.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatcaactgacaacgtccagccagtagttgttttataactaacctaccaaacaaataagacgtacttaactttaggctttacggtaacccagaccaactaaaactcgaaggaacacgtacctaccgtaagtctacgcctataacgtttacgtgggactaacgttacccggtaaccccggggtaattccccggttcgggtacccctacggaaccgtagtttacgacggttcgggactacgggtcgggtcgtagggacctaaggtactttaccgaccttccgaccacctagtcacggcctagtccgtgacgaggtcgtaaggtaacgtagtacggtacggtaactttaacggtttaatttaccgtaacgttaaactaaacttaagtttaactttaaacttaaacttaacgttacctttaaagtttaccggtacggggacgtaaacgggtaacgttagggtaagaacggtaactaaccggaaaacgtacggtaggtaccggtaactcggaacctcgttaacgg

SEQ ID NO: 247841 - DNA, 667 bp, Homo sapiens
  misc_feature: GYAE6OF01C5YO3.16.73.G07.1.454.CMB.1.raw
  modified_base (235)..(235): a, c, t, g, unknown or other
  misc_feature (235)..(235): n is a, c, g, or t
  modified_base (342)..(342): a, c, t, g, unknown or other
  misc_feature (342)..(342): n is a, c, g, or t
  modified_base (509)..(509): a, c, t, g, unknown or other
  misc_feature (509)..(509): n is a, c, g, or t
  modified_base (661)..(661): a, c, t, g, unknown or other
  misc_feature (661)..(661): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatcgacccagtctccagacctccctggctgtgtctcgtgggcgagacgggccaccatcaactgcaagtccagccagtagttgttttanataacctaccaaacaataagagtccttaacttagcttaggtacccagccaacaaagtcaacggaccacgtacccttaccgtaagcctgccttactaattttaccggngggcctacgtacccgtacccgggtaacgtcccgggtccctaggacccgtattcgagtcggcagggcgggtgcgggactagtactttacaccttcgaccaccgtatccgagtcacgccctgacgacgggtcctaggaagtcgttcggtacggtacgtttaacgttttnttaaccgtagtaaacctaaccgttaaatttaacctttaattaaacgttaaccttaccgttaagttttaaccgttcggggtaacgggtacgggtaaccgtaagggtggaagtaacgtacgaaaacgtcgtagtcggtacaccgtaccacgttnttaccg

SEQ ID NO: 247842 - DNA, 819 bp, Homo sapiens
  misc_feature: GYAE6OF01DHN17.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctcgtggatctcgtggtcgccggtacgggactagtcgtgactcgaccctagttcctccaacgtccttcccgtggtccttggtcgttccgtcggtacgggcgaggaccgggacccaaccactacctaacgtcgacgtaacggtccacgaccgtaggttagtttacgttttaactaacttaaccaaccctaaaagtaaacgtaacggtactacgtttaacgttacggtaccgtttacggaaccgacaaccaaaacgtaaactcggaacggtacaaccggtccctaaccgtagtcctcgtacctacttaagttacgcggtactaccggtaccggtaacccgggtacggtccccgggtacctacggtacccgttagtcggtacggtcgcggtacggtcgggtacgtacggacgttaacgttcgtttaccacgtaccttacccgaccgtataccgtacggtaccgtccgtaccggtacgaacggtcgtaaccgtaaggagttacggtacggttacgttaacttttaacgtttacttaacgttaacgtaaacttaaacgttaaattaacgtttaaacttaaacgtttaacgttaacgtttagttacgggtacggtaacgggtaacggtaaacggtaggggtaactaacgtaacggttaaaccgtaaacggtacgtcggttacgtacgtaactccaacgttgttaaccccgg

SEQ ID NO: 247843 - DNA, 531 bp, Homo sapiens
  misc_feature: GYAE6OF01DO5M1.16.73.G07.1.454.CMB.1.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (400)..(400): a, c, t, g, unknown or other
  misc_feature (400)..(400): n is a, c, g, or t
  modified_base (448)..(448): a, c, t, g, unknown or other
  misc_feature (448)..(448): n is a, c, g, or t
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatacaactgcaagtccagcccagtagtgttttaatataactaccaacaanaaganctacttagcttacggtaccagacaacaaatcaggacagcctactaagctgctctatttcgtggctactaccgtacccgggacgttcccgggtcctagacctattcgagtcggcgtaggcgggtctcgggactaggtacttcactcncaccatcacgcagctgcaggctagagtgtgtgtacttagttatacgtntacaatattaattataactataccttattagttcggagtaggacgtaggtgagatacaaacgntggtcgactnactcngttcg

SEQ ID NO: 247844 - DNA, 780 bp, Homo sapiens
  misc_feature: GYAE6OF01A58DF.16.73.G07.1.454.CMB.1.raw
  modified_base (259)..(259): a, c, t, g, unknown or other
  misc_feature (259)..(259): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatcgacccagtctccagacctcccgtggctgtgtctcgtgggcgaggacgggcccaccatacaactgacaagtccgagccagtagttagttttataactaacctaccgaaanaattaagacgtacttacttagtcttacggtaaccagaccaacaaataccgaaggacctacgaccccttaccgtaagctacgtaccttacttaacgttttaccgcgggtacctaacgttaccccggtaaccccgggaaccgtttccccggtccgggttcccctacggtacccgtaactttccggaaggttccgggaccgacgggtaccgggtcggtaggggtaaccctaggttactttccctaccgttacctacccgtaaccctacgtaccgacgaccgtaccgtcccgttacgggacggtaacggtaccgtaaggaacgtagttggtacggttacttaacggttttacttacggtactaaccgtaaattaatttaagttaaattaaacttaccgtttacgttagttttaacggtccgggtaccgggtaaacggggtaccggtaaggggttaacggaagttaccggtaaacccgtaaaccgtaacggttacggtacgtaccgtaccggtaccgtacgttacg

SEQ ID NO: 247845 - DNA, 851 bp, Homo sapiens
  misc_feature: GYAE6OF01CB5PO.16.73.G07.1.454.CMB.1.raw
tcagtgtactactccacgaccggtgctcgatttagctctacgctcaggggtccgggagatcatgagggtgtccttgagtcgtgggggaggcgtggtccagccgtgggggtcgctgagactctcctgtgcagcctctggattcaccttcagtacctatgccatacacgtgggtcccgccagccctaccgagggcgaagggggctgggaggttgggtgcttcttatatcatctgagtgggagtactagaactacgtacgcacgcctccggtaggaacgggccgtattccacctatcctaccgagacgaactacttacccgaagaaccacacttgtactccgtagaacctaaagtacgaaaccgcgacccgtagaaacgtaacgtaacggacggaacgaccggtcttacgttattaacgttaacgttggtcgggacgggtaaggggggaccgggggggtaccggggttaggggaccgtacccggtccccggtacccggggaccgggtacccgtaggttaccggtaccggttacccggggtacgggggtaacccggtaacggggtacccgtttccccggttacgggttaccccgttaccccggttcccgttaccccgtaccgtaacccgtcccccttaaccccgaacccgggtaacccgggtaccccgttacccggttccccggtttcccccgttccccccggtcgggacccccgttccccgtcggaccccgttaccggaacgggtacccgcccggtaacccggtacccggaacggtcccgaacccggtaccggaaccccggggtccgggttccccggacggggttcccgtaccgggtcccgggttaacccgggg

SEQ ID NO: 247846 - DNA, 718 bp, Homo sapiens
  misc_feature: GYAE6OF01AT9EA.16.73.G07.1.454.CMB.1.raw
  modified_base (329)..(329): a, c, t, g, unknown or other
  misc_feature (329)..(329): n is a, c, g, or t
  modified_base (379)..(379): a, c, t, g, unknown or other
  misc_feature (379)..(379): n is a, c, g, or t
tcagtgtactactccacgaccggtgctcgatttagctctacgctcagggggctacaacaggcaggcaggggcagcaagatggtgtgcagacccaggtcttcatttctctgttgctctggatctctggtgcctacggggacatcgtgatgacccagtctccagacctccctggctgtgtctcgtgggcgaggacgggcccaccatacaactgacaagtccagccagagttagtttaatactaacctaccaaacaaataaggagtacttacttagtcttacggtaccagacaacaaatcgagacacgtcctactagctgctactattacgnggactacgtaccgtaccgggaaccgttcccgggtacctaggtaacccgtnttcgaggtcggcgagggtccgggtaggtacgggaacgtaggttactttaccaccgtttcccaccctaaccgtataccgacggtaccgacgtccccgtaggacccgtagggtacctaagggaaggtacgtgggtacggtactttaacggttttaactaaccgttagtaaacctaaaacttaatttaaactttaaattaaaacctttaacgttaccgtttaaagttttaaccgggttccggggaacggtaacggggtaaaccgtaaggggtacgtaacgtaaagtaacccggtaaaaccgtaggtacggtacggtactaccggacctaaccttcgttaccg

SEQ ID NO: 247847 - DNA, 735 bp, Homo sapiens
  misc_feature: GYAE6OF01D36WV.16.73.G07.1.454.CMB.1.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaccatccaactgacaacgtccagccagtagttnttttanactaactaccaaacaataagagtcttaacgttacgtcgttacggtaacccagaccaactaaactcgaaggactacgtccctacgtaagctgaccttactagtttacgcggactacgtaccggtacccgggaattcccggtcggtacccctcggtaaccgtattccgaggtcggcgtacgggtcggtcgtagggactaggtactttcaccgtcctacgaacctactacgacgactacggtcccgtaggaccgtacgggtctaaggaacgtacgttgggttaacgtacgttttaacgttttaaccgttaacgtaaccgttaacaaaatttaagtttaaacttaagtttaaaccttaccgttaacctttaaaggttttaacggtttccgggggacgggtaaaggggttaaacccgaaggggttaacggaagtaaaacgtaccgggttaaaacccggtaggttacgggttacgtacccgtacggtaaccctaacgtttacg

SEQ ID NO: 247848 - DNA, 654 bp, Homo sapiens
  misc_feature: GYAE6OF01BDHFA.16.73.G07.1.454.CMB.1.raw
tcagtgtactactccacgaccggtgctcgatttagctctacgctcaggggggctacaacaggcagggcaggggcagcaagatggtgttgcagacccaggtcttcatttctctgttgctctggatctctggtgcctacgggggacatcgtgatgacccagtctccagactccctggctgtgtctcgtgggcgagagggcccaccatcaactgcaagtccagccagagttgttttataataactaccaaactaataagagtactacgttagtcttacggtaccagacaacaaatcgaaggacacgccctacctaagctgactactatttacgtggctagtaccgtacccggggtaacgtcccggggtccctaggaacccgtagttccgaggttcggcgtacgggtccgggttacgtacggggacctaggttaactttccaccgttcctaccgacctacgtccgacgtacacgcccgtgaccgtaggctagaacgtatggtacgtgttaacgtttattacgtgtactaactattaattaattaaacttacttaccttaagtttaacggttcgggacggtaacgggtaaccgtaagggttacggaactaaggtaaccgaaacggtagttcggtacggcctagaccgtacctagttccg

SEQ ID NO: 247849 - DNA, 594 bp, Homo sapiens
  misc_feature: GYAE6OF01ARJYS.16.73.G07.1.454.CMB.1.raw
  modified_base (487)..(487): a, c, t, g, unknown or other
  misc_feature (487)..(487): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatccaactgacaacgtccagccagagttagttttatataactaccaaacaataagagtctacttagcttaggtaccagacaacaaatcgaggacacgcccttaccaagtctgacctactacgtttaccgaggtacacgtaccgtaacccgggaacttcccgtcgggtccctaggaccgtacgttcgacgtcggcgtaggcgggtacgtggacagtactttacacctcacctacactcagctacgcctagcgaggctagaagtctgtgtacttagtttactacgttanacaaactaattattaaataactattacctaatttacgtcgggacgtaaggacgtaagggtcggaatactaaccgaaagtagttcggagtacgtacaccgtaccttag

SEQ ID NO: 247850 - DNA, 905 bp, Homo sapiens
  misc_feature: GYAE6OF01B7FRS.16.73.G07.1.454.CMB.1.raw
  modified_base (111)..(111): a, c, t, g, unknown or other
  misc_feature (111)..(111): n is a, c, g, or t
  modified_base (134)..(134): a, c, t, g, unknown or other
  misc_feature (134)..(134): n is a, c, g, or t
  modified_base (178)..(178): a, c, t, g, unknown or other
  misc_feature (178)..(178): n is a, c, g, or t
  modified_base (220)..(220): a, c, t, g, unknown or other
  misc_feature (220)..(220): n is a, c, g, or t
tcagtgtactactccacgaccggtgctcgatttagctctacgctcaggggtccgggagatcatgagggtgtccttgagtcgtgggggagcgtggtccagccgtgggggtcnctgagactctcctgtgcagcctntggattcaccttcgagtacctatcgcctatacacgtcgggtccnccagccctccgaggcaaggggctggaggtcgggtgctcttanagtcatctgagtgggtacgtactagtaactaccgtcgcgagtaccgtccggtaggaacggtcccgtatttaccaccgtacttaccgtacccgaagtaaccggaaacctaaccgttaccccgaaaacggtaaccctaccgtaccgttacggttaacctccggttaacggaaccgtaaaaagtcggtaaacccgagggtaccccgttaaggaaaacgtaacgtaacggaacggtaaccgtaacggtaccttaacgttaagttaccgttaacggtcggtaacgggaccggggtagggggaaccgggggggtccgggtacggggaccgttacccgttaccccggtaccgggggtaccccggtaccttaaccgggtccggtaccccggttcccggggtaaccgggggacccgggtacgggttaccccgttacccggttaccgttaccccgttacccggttccccgtaccctacggaccccgtaccccgtaaccccggtaacggtaacccgggtccccttaaccgggtccccgggtttaccccccgttcccccggacggggtcccccttacccggtccgtacccggtacccggaccggtaacccgacccgtcccggtaaccgggacgtccggaacccggacgccccgggtccggtaccggtccgggtaacccgttcggccggttaaccggg

SEQ ID NO: 247851 - DNA, 730 bp, Homo sapiens
  misc_feature: GYAE6OF01CVKY2.16.73.G07.1.454.CMB.1.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
tcagtgtactactccacgaccggtgctcgatttagctctacgctcaggggggctacaacaggcaggcaggggcagcaagatggtgtgcagacccaggtcttcatttctctgttgctctggatctcgtggtcgccgtacggggacatcgtgatcgacccagtctccgagacctccctggctgtgtctcgtgggcgagacggccaccataccaatgacaacgtccagccagtagttagttttaanactaactaccaaanaactaagacgtacctaacttacgtacgttacggtaccagacaaacaaatcgaaggacctacgtccctaccgtaagtctcgtcctacttacgtttacggcggtactaccgtacccggtacccgggtaacggttccccgggtaccctacggacgtacgttacgaggtcggactagggtccgggtagtacgggacgtacgttacttaccaccttcctacctaacctacgtacgaacgccgtacgtccgtcgacggtacggacgtacgaaggtacgttcgggtacgtacgtttagtttaacgttaacttagtaaaccctaattaaacgtttaattaacgtaaactttaaactaccgttttaaggtttaacggttccggggtagggtaaaccgggtaacggtacgggtaagtaacgtaacgtaaccggaaacgttaacgttaggtacgggttactacggtacctaacgtacgtttacg

SEQ ID NO: 247852 - DNA, 703 bp, Homo sapiens
  misc_feature: GYAE6OF01BTIKP.16.73.G07.1.454.CMB.1.raw
  modified_base (539)..(539): a, c, t, g, unknown or other
  misc_feature (539)..(539): n is a, c, g, or t
  modified_base (657)..(657): a, c, t, g, unknown or other
  misc_feature (657)..(657): n is a, c, g, or t
tcagtgtactactccacgaccggtgctcgatttagctctacgctcagggggctacaacaggcaggcaggggcagcaagatggtgttgcagacccaggtcttcatttctctgttgctctggatctcgtggtcgccgtacgggactagtcgtgatcgaccctagtcctaccagacctcccgtgggctggtcgtcgtcggtggggacgaggacgggcccaccataccaactcgacgaacgtccgacgaccgtaaggtagtttagttttaactaacttaacctaaccaaaataaataaggtactacttaacttagtccgttacggaaccacgtacaaactaaacgaccgaagggacctaccgtacccctacgtaacggtcctacgtccttagttacgtttacggcgggtacacggttacccgggtaaccggggtaccggttcccgggtaccacggtaccgttagtaccggaggtcggacggtacgggtcgggttacggacgggacttacggtcctttaccgacctcgtaccaccagtccgaanccgacgtccgtagcgtacggacgtaggagtacgttgggtactacgtttattacgtatacgaactaatattagttaatattactacttagttacggtacggacggaggtaacgaggtanagaacttacgggaactaggttcgacgacgtacacttacgtgtaccg

SEQ ID NO: 247853 - DNA, 655 bp, Homo sapiens
  misc_feature: GYAE6OF01DQDRV.16.73.G07.1.454.CMB.1.raw
tcagtgtactactccacgaccggtgctcgatttagctctacgctcaggggtccgggagatcatgagggtgtccttgagtctgggggaggcgtggtccagcctgggggtcgctgagactctcctgtgcagcctcgtggatttcaccttcagtacctatgccatacactgggtccgccagccctccaggcaaggggctggagtgggtgctcttatatcatctgatggacgtctgaatctacgcagactccgtgaaggccgattcacatctccagacgacaattcccagaacacactgtatctgacaaatgaacagtaccctagaacgtaaactggaacggaaccgaacggtccttacttaatttaagtttactacggtacggccgggtaaggggcggggggggtcccggtagggggtacgccgttacccgtccggacgggccagtcgtaccgtccggtcggggaccgtacgggacgtcccgttacggtccgtacccgtccttccctacgcgccctaccgaaccgacggtaccctacgtcccgttcccttccccgtcggcccgtcccgcgttcccgtaccgacggtcgtacccgaccgtacggacggtcgaccacgaccggtcccggtacccggtcggtcgtccgtcccggttaacgg

SEQ ID NO: 247854 - DNA, 683 bp, Homo sapiens
  misc_feature: GYAE6OF01CKGOR.16.73.G07.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (340)..(340): a, c, t, g, unknown or other
  misc_feature (340)..(340): n is a, c, g, or t
  modified_base (549)..(549): a, c, t, g, unknown or other
  misc_feature (549)..(549): n is a, c, g, or t
  modified_base (678)..(678): a, c, t, g, unknown or other
  misc_feature (678)..(678): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatcgacccagtcctccagacctcccgtggctggtcgtctcgtgggcgaggacggaccacatacaatgacaagtccaggccagtagttntttaanataacctacaaataanaagtacgacttacttacgcgttagaaccagacaacaaatcgaaggtacacgtaccctacctaagctctactactatttacgngggacctacgtacccggtaacccgggtaacgttcccggggtaccctaggaacccgtatttaccgagggacgcgtacgggcgggttactacggggaaactggtaactttcaaaccttccgacaaccgtatcacggtacgaaccgccgtacgacggaaccgattagggaagtacgtggtaacgtacgttaagtttctaacgtacgttaaanaaacttaattaattaaacttaagttaaaccttacgtttaacgttaacgggtcgggaacgggtaaacggtaacgtaagggtacgaagtaactaacggaaacgtcgtggtaccgacgtaagacctacgttntaccg

SEQ ID NO: 247855 - DNA, 893 bp, Homo sapiens
  misc_feature: GYAE6OF01DJD7F.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctgatctcgtggtcgccgtacgggacatcgtagatcgaccctagtcctccaacgtaccttcccgtggcttgtcgtcctcggtgggacgagggaccggcccaaccgactaccgaacgtcgaactaaccggccaacggaccgtaaggttagttttacttttaactaacgtaacctaaccgtaaaataacgttaaggacgtaccttaaagttccggtacgtttaaccggaacccaaggtaaccaaacggtaaactacggaacgtaccgtaccggttacccctaacgttaacggccttacggtcctttaacttaacgtttaccgggtccgaccttaacggttaccccgggtaaccccgggtaacgttccccgggtacctaacgtaccgttagttaccggacggttcggaaccggtacggggttacccgggttaaccggtacgtaaacgttacgtttacccgtttaccgacccttaccgtacccgtaactacgtaccgacgtaccgacgtcccgtagaaccgtaggttaccgtaagggtacggttacggtttacggtaccggttaagtttttaacgtttaccgttacgttaacctaacgttaaaactttaaagtttaactttaaacgtttaaccttaacctttaacggtttacgttttaaccggggaaccgggtaaccggggtaaacggtaaccgggtaaggttaaccggtaaattaaccggtaaaccgtaaacggttccgttaacggtacgttaccgacgtaccttaccgtctttaaccgg

SEQ ID NO: 247856 - DNA, 740 bp, Homo sapiens
  misc_feature: GYAE6OF01DPRT8.16.73.G07.1.454.CMB.1.raw
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgatcgacccagtcctccagacctcccgtggtctggtgtcctcgtgggcgaggcggccacatccaactgacaacgccaacgccgagtagtttgttttaanaactaacctaccgaaanaataagacgtactacttacgtcttacggtaccagactaacaatcgaggaccacgtccctacctaaggccttgcctcgtactttacggtggtacctacgtacccggtaacccgggtaccggtccccgggtcctacggtacccgtagttaccgagggtcggtcgtacgggtccgggtcgtacggggactagttacctttctaccgttcctaccgtaaccgtacctaccgacgaccgacgtacccgtcgtacggacggtacgttagggaacgttggtcggttacggtactttaacggttttacttaacggtaccgttaacctaaattacgtttaattaaacttaatttaaccttaccgtttagttttaacgggttacccgggtaaacggggtaccggtaaccggtaagggttaggtaagttaacgtaaccggtaaaccgtaggttacggttaccgtacgtacctaacgtccctggtttccg

SEQ ID NO: 247857 - DNA, 959 bp, Homo sapiens
  misc_feature: GYAE6OF01CK7JT.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgatcgacccagtctccagactccctggtctgtgtctcgtggcgaggacggccaccactacactcgacacgtaccagacctaggtaacgtttagtttttaactaacttaaacccttaaaccgaaacttaaaacgtaaacggtaacggttaacctttaaccgttttaacggttaccggttttaaccggtaaacccgtaacgtaaacctaaaaccgtaaaaccgttaaccgaaaccggtaacctaacccgggttaccccctttaaccgttaaaacggtcccgttacggttaccctttaccgttaaacgttttaccgggtacgggtaccttaacccgttaccccgggttaacccccgggtaacgggtttaccccggggttaccctaccggtaacccgttacgtacggtacggtcggtaccggtacgggttaccgggttcgggtaacgggtacgtaacgttaccgttacccgttaactcccgtacgtaaccgtacgtacccaggtaacccgtaccgtccggtaccggccggtaagggtaccgttacgggaacgtttacgggttacggtcgtttaaacggtttacgtttaaccgttaacgtacgttaaacgtaacttaaactttaacgtttaaacttaacctttaacgttaaccgtttaacggtttttaaaccggggtaccggggttaaccgggtaaaacgggtaaccggttaaacggggttacgtaaaccggtaaacggtaaaaccggttaaaccgttaacggttaccgggtttaccggaaccgttaccggtaaacccgttaaccgtagtttacccgg

SEQ ID NO: 247858 - DNA, 713 bp, Homo sapiens
  misc_feature: GYAE6OF01BGEPJ.16.73.G07.1.454.CMB.1.raw
  modified_base (207)..(207): a, c, t, g, unknown or other
  misc_feature (207)..(207): n is a, c, g, or t
  modified_base (351)..(351): a, c, t, g, unknown or other
  misc_feature (351)..(351): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctgggtcgtccgtacgggactagtcgtgatcgacccagtcctccagacctccgtggctgtcgtctcgtggcgaggcggccacntcactgacagtccagcagtgtttgtttacaactacctaccaaataagtaacgacgtcttaacttaggtaccgttacggtaccagacctaacgtaaatcgaaggaccacgtccctacgtaacgctcgtctacgtagtttaccggnggacctacgtacccggtacccgggtacgtcccgggtaccaggtaccagttcgaggtcgtcgacgggtcggtcgtacgggactagtttaccgttcaccgttccaccgtactacgtccgaacgccgtacgttcccgacggcgtaacggtacggtagaacggttgtcggtcgtaccttttaaggtttaccctagacgttaaccaagtttaattaatttaaacttaacttaaccgttacgtttaacgtttaacgggccgggtacggttaaaaccggacggttaaacgggtacgttaaggtaacgtaaaccggtaaccggttagttaccgggtacgttacgaaccgtaccgttacccttagttcccg

SEQ ID NO: 247859 - DNA, 875 bp, Homo sapiens
  misc_feature: GYAE6OF01AO2C2.16.73.G07.1.454.CMB.1.raw
tcagtgtactactccacgaccggtgctcgatttagctctacgctcagggggctacaacaggcaggcaggggcagcaagatggtgttgcagacccaggtcttcattctctgttgctctggatctcgtggtcgccgtacggggacatcgtgatcgaccctagttcctaccgacgacctcccgtggcttggttcgtctcggtgggacggtaaggacgggcccaacgactaccaacgtgacctaacgtccgacgaccgaagtaggtttattttaaactactaaccctaccaaacgtaattaacgagttaccttaacgttcgtacgttacggtacctagaccaaacaaagtccgaacggaaccacggtccctaacgtaacgtcgtacgtaccttacgttaacgtttaccgggtacgggaccttaaccggtacccgggttaaccccgggtaaccgggttccccgggtacctaccggtaccggtacttaccgggacgggtaccggcggaacgggttccggggtacggtacgggtaaactacggttaacctttcggtaccctacgtaaccctaccgtacgtaccgtaccgaccggtaccggtaccgtacggtaccggtacgggtacgtaacggtacggttaggtacggttacggtacgttttaacgtttaacgttacgttaacgtaaacgtaaacttaacgttaaacgtttaaacttaacgttaacgtttaaaccgtttacgtttaacccgggttacgggtaacgggttaacgggtaacggttaacggggtaacggtaaggtaaaccgttaaaccgtaaaccggtaacggttacgggttaccgtaccggggttaaacacccggttaacgttccgtttaacccg

SEQ ID NO: 247860 - DNA, 808 bp, Homo sapiens
  misc_feature: GYAE6OF01BB6JG.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagtagttgttttatactaacctaccaaacaaataagagtacttaacgttaagtccgttacggtaaccacgaccaaactaaatccgaaggaaccaccggccccttaaccgtaaacgtcctacgtccttaccttaacttttaccggtacgggtacctaaccgttaccccgggttaaccccggggtaacgttcccccgggggtaccctaccgggtaacccgttacttaccggtacgggttcgggaccgtaacggggtccggggttacggtaacggggtacctaagggtttactttaccacccgttcctaccctaacccacgttaccgaacgccgtaacgtcccgtacggacgtagggtacctagggtaacgtaggttcggtaggttaaccgtttaggttttaactttaccgtagttaactaaacttaagttaaatttaaattaaacgttaaccttaacgtttagttttaaaccgggttcccggggtaacgggtaaaccggggttaaacggtaaggggttacggtaaagtaacgttaaaacccgaaacggttaacgttcgggtagtaccgtaccgtaacctacgttacgttaccg

SEQ ID NO: 247861 - DNA, 722 bp, Homo sapiens
  misc_feature: GYAE6OF01AKR85.16.73.G07.1.454.CMB.1.raw
  modified_base (236)..(236): a, c, t, g, unknown or other
  misc_feature (236)..(236): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggcccaccatcaactgacaagtccagccagagttgtttaanactaactaccaaacaaataagagtactaacttagtccttaggtaacccagaccaacaaatcgaaggaccacgacccctaccgtaagctacgtcctacttaactttaccggtgggacctaacgttacccggtaacccccggggtaacggttccccgggggtccctacggaacccggtattaccgagggtcggacgacgggtcgggttcgtacggggactaggtactttccgaccttcctaccgaacccataccgagccacggtcccgtggacgaacggtacgtaacggaaggtagttcgggtacggtaacgttaagtttacgttaacctaggtaaccctaaaataacgtttaaacttaagttaaacttaacgtttaaccttaaaggttttaccggttacgggacgggtaaccggaacggtaagggtggaagtagtaacccaaaaggttaccgtgggtaacggtctaagacccgtaacgtacgttccg

SEQ ID NO: 247862 - DNA, 883 bp, Homo sapiens
  misc_feature: GYAE6OF01B7M0B.16.73.G07.1.454.CMB.1.raw
  modified_base (148)..(148): a, c, t, g, unknown or other
  misc_feature (148)..(148): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggacatcgtgntcgacctagtctccagacctcccgtgtctgtgtctcgtgggcgaggacggccaccataccaactcgactaacgtccacggaccgtaggttacgtttacgttttaactaaccttaacctaaccaaaactaaacgtaaacgtacgtaccttaacgttacgtccgtttaccggtaaccctaagaccgtaaactaaacgtaccggaacggtaacctaccggttaaccccgtaaccgtaacgtcgtccgtacttaccgttaagttttaccggtcgggtaccgtaacccgttaccccgggtaaaccccgggggtaacccggttaccccggggttaccctacgggttaacccccgtaggtttaccgtacgggttaccgggtacggtacggggttaccgggtaccgggttacggggaaacccgttaacgttaacggtttacccctaacccgtttacccggttaaccctaacccgttacgggttaacccgaacggggtccccgttaaccggttccccgtacgggttaactaccggggttaacgtaagggttaacggtcggttacgggtacgtttacgtttaaacgtttactaaccgttaacgtaactaacgttaaacttaagtttaactaaacgttacgttaccgttacgttacggttacggacggtacgggtaacgtagggtagacgtaagtaaacccgaaggttacgtaacgttcggtacgtacccacgtcgtaagttcccg

SEQ ID NO: 247863 - DNA, 688 bp, Homo sapiens
  misc_feature: GYAE6OF01CKABO.16.73.G07.1.454.CMB.1.raw
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
tcagtgtactactccacgaccggtgctcgatttagctctacgctcagggggctacaacaggcaggcaggggcagcaagatggtgttgcacgacccaggtcttcatttctctgttgctctggatctcgtggtcgccgtacgggacatcgtgatcgaccagtcaccagactcctggctggtctctcgagggacgaacggacgggaccaccatacaaaccgtgaacgtaaacgccgaagtaccgtaagttagttacgttttaaataacttaaaccttaacccaaaaanaaacggttaaacgtaggtaaccttaacggttacgtaccggttttaaaccgggtaaaaccaaaaaccggttnacgagacgtacgacgacgacgtacgacgacgacgacgtagagacgtacgacgacgacgacgtagacgtacgacgaacgagtacgacgacgagacgacgagacgacgagacgacgtacgagacgacgacgtacgtagacgtaacgagtagtaactaacgacgacgaacgaacacgaacgaagaacgacgtaacgaacgaagtaacggtaacgaacgtaacgaacgtacgtaacgtacgtaacgtaacgaacgtaacgaacgtaaacgaacgtaaggaacgtaaacggaacggtaacgtaacgtaacgaacgtaagtaactagtaacggaacgg

SEQ ID NO: 247864 - DNA, 964 bp, Homo sapiens
  misc_feature: GYAE6OF01BDNQ2.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctcgtggtgccgtacggggacatcgtgatcgacccagtctccagacctcccgtggctgtcgtctcgtgggcgaggacggccaccataccaactcgacaacgtccagccaaggtagtttagttttaataacttaaacctacctaaaactaaagtaacgagtacttaacgttaacgttcgttacggtaaccaacgacctaaacgtaaaactcggaaacggtaaccaccgtaccccttaaccgtaaacggtcccttacggtaccctttacgttaacgttttacgggttacgggacctttaaccgtaccccgggttaaaccccgggggtaaccggttaccccgggggtaccccgttaacggtaacccggtacgtttacgggaacgggtcggtaccggaacggggttccgggttacgtaacggggtaactaagggttaccttttaccaaccgttacccgtaccaacccgtaacgttaccgacgtacccgaacgtccccggtagaacccggtacgggtacgtaagaacgggttcgtttaggtcgtttaacgtttaacggttttaacgttaaccgtacgtaaaccgttaaaacttaaacgtttaaatttaaaacgttaacgtttaaaacctttaccgttttaaagggtttttaaccggggttaaaccgggggtaacccgggttaaaacgggggttaaacccgggttaaaaagggggttacccggggtaaaacccgtttaaaccgggttaaaaaccggtaaaaacccgggtttacggggttaacgggtttaccgggtaaccccgggttaacgtaaacccccgtttaaccgttaaccgggttttaaacccg

SEQ ID NO: 247865 - DNA, 656 bp, Homo sapiens
  misc_feature: GYAE6OF01B3U7Q.16.73.G07.1.454.CMB.1.raw
  modified_base (162)..(162): a, c, t, g, unknown or other
  misc_feature (162)..(162): n is a, c, g, or t
  modified_base (265)..(265): a, c, t, g, unknown or other
  misc_feature (265)..(265): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
  modified_base (650)..(650): a, c, t, g, unknown or other
  misc_feature (650)..(650): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacgggactatcggtgatcgacccagtcnccagtacctcctggctgtctcctgtgggacgaggacggccactatacaactgacgaagtccagctagtagttactttaaacttaaccaccgaaaataagtaanacgttacttactagtcttacggaacngacaactaancgaaggactacggtacctaccgaatctacgtctactacgtttagacgggattaccgaccgggtaaccgggacgtcccggggtacctacggaacgtcttacgaggtcgacgtcgggacggttcgacgggactaatccgtttanaccctctaaccncgaatcncgaccacgtcgcgacgaaggnaacgaagtntcggacggtaattgttaattaccgtgaacctaaaattataatttaaactaacggttaatacccgtttaagttaacggttaccggggaaggtaaacgtccggttaaaagggcgaagttacgaaaactaacggtacagggtcacgtaccgataaccggtnttaccc

SEQ ID NO: 247866 - DNA, 871 bp, Homo sapiens
  misc_feature: GYAE6OF01DEEVB.16.73.G07.1.454.CMB.1.raw
  modified_base (112)..(112): a, c, t, g, unknown or other
  misc_feature (112)..(112): n is a, c, g, or t
  modified_base (135)..(135): a, c, t, g, unknown or other
  misc_feature (135)..(135): n is a, c, g, or t
  modified_base (183)..(183): a, c, t, g, unknown or other
  misc_feature (183)..(183): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (476)..(476): a, c, t, g, unknown or other
  misc_feature (476)..(476): n is a, c, g, or t
tcagtgtactactccacgaccggtgctcgatttagctctacgctcaggggtccgggagatcatggagggtgtccttgagtcgtgggggagcgtggtccagccgtgggggtcnctagagactctctgtgcagcctntggattccaccttcagtacctatcgacctatacgacgttcgggacccnccaggtccctaccgaagggcgaaggggtctagggnggttggggtacnccttactttanactacgtacttggtaggtagtaggggtaacgttactaaggtaaactaccgtacgaccgacgttacgtaccgggtaagggaccggctacttccaaccttactcgtaccgaagacgtaactaaccgtacccgaaagtaacctacctacgttaggttacctacgtagaaacaaacttacggaaaccgtagtaacccgttaggaaacgtacgaacgggtaccgtaaccgtaaccggttntaactttaaacttacggttaccgtagggacggggacgggtaacggggggggtcggggtaccgggttaaggtacccgcccgttaccccgggaccggtacgggtaacacgtaccggtaccgggtcggtacggggtaccgtaaccggtccgttcccggtaccgtcctacccgttccgtaccctacgtaccccgtaccgtacccggaaccggtacccgtaaccggttcccggttacccgggttccccttccccgggtaccgggccccttccggacccgtccggtacccggtaccgaccggtacccgtacccggaccggacgtacccgaacccgggtaaccggcccggggtaaccccggtccgggacgggtccgttaaacccggtcccggtttaaaaggg

SEQ ID NO: 247867 - DNA, 910 bp, Homo sapiens
  misc_feature: GYAE6OF01A9DON.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatcgacccagtctccagacctcctgctgtgtctgtggacgagcggacccaccatacaactgcaacgtccacgccgagtagttacgttttaataacttaacctaccaaaacgtaaagtaacggagtaccttaacgttacgtcgttacggtaaccgacgaacaacgaaactcgaacggtaccaaccggccctttaaccgtaacgtcgtacgtaccttaccgtttaacgtttaccggtacgggtaccctaccgttaccccgggttaaaaccccgggggtaacccggtttcccccgggggttacccgtacggtaacccgttacgtttaccggtacgggtacgggtaccggacggggttccggggttaccggttacgggggtaaaccgtacgggtttaactttaccgtacccttacccgtaacccgaacctaacgtcccgtaacggaccgttaaccggtcccggtaacggaccggtaacgggtaccggttaagggtaacggttacggttaccgggtacggttaacggttttaacgttttaacgttaaccgttaacgtttaaacccgtaaaagtttaaacttaaagtttaaacctttaaacgtttaacccttaaacggttttacggtttttaacggggtaaccgggttaaccggggtaaacgggtaaccggttaaacggggtacggttaaaaccggttaacggtaaacccgtaaacgttaccggtacgggtttacgaccgttaccgtaaccgttaactccgtttacgg

SEQ ID NO: 247868 - DNA, 749 bp, Homo sapiens
  misc_feature: GYAE6OF01EZFZH.16.73.G07.1.454.CMB.1.raw
  modified_base (262)..(262): a, c, t, g, unknown or other
  misc_feature (262)..(262): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
tcagtgtactactccacgaccggtgctcgatttagctctacgctcagggggctacaacaggcaggcaggggcagcaagatggtgttgcagacccaggtcttcatttctctgtttgctctggatctctggtgcctacggggacatcgtgatgacccagtctccagactccctggctgtcgtctctgggcgagagggccaccgatcaactgcaacgtccaagcccagagttgttttatactaacctccaaacaaacttaagganacttaacgtttagtacctttagggtaacccagtccaactaaaacgttcaacgggacacgcctacctaagctaggcctacgtaattttaccgtgggactacgttccgtacccgggtaagtcccggggttccctcggaaccctaatttcgaggtcggacacgggtcgggtccgtagggactagtctttaccacgttcctacacctagtccaacgcgtacgtcccnggacngggtaccttaggaacggttatagggtacggttactaaggtttttaacgttacctaggttaacctaaaacgtatttaaactttaaactaaatttaacctccgttttaaagttttttaaccggtttcggggtaacccgggtaaaggggtaaaccccttaagggggtacggtaagggtaaaccttaccggtaaaaaccgggttaaccgttgggttaccgggaccctttaaaggggccccttaaccgtaaacgggtttttccc

SEQ ID NO: 247869 - DNA, 675 bp, Homo sapiens
  misc_feature: GYAE6OF01AGCG3.16.73.G07.1.454.CMB.1.raw
  modified_base (235)..(235): a, c, t, g, unknown or other
  misc_feature (235)..(235): n is a, c, g, or t
  modified_base (304)..(304): a, c, t, g, unknown or other
  misc_feature (304)..(304): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcaggacgggccaccatcaactcgacaagtccaggccagtagtgttttanaataactcaacaatagagactactagcttaggaactaagcaacaaatcacggacacgccctacgtaacncgttgtccgtactatttacgacgggactactaccggtaacccggtaagttcccggggtaccctaggtacccgtaatttcgaacggtggcacgggtcggtctagggactaagtatttccaacgtcttaccgaacacgtacgacgtacgtcgtcccgtaggcgtaacgggtactacgggtaaaagtcgttcgggtaacggtccgttaaggttttaaccgtacgtaacggttaacctaaaacgttaattaacttaacgttaaacttaacgttaacccgttaagtttaccggtttacgggacggtaacgtaccggttaagtacgggataactaacgaaacggttacgtcgtacgacgtagacctacggattccgg

SEQ ID NO: 247870 - DNA, 655 bp, Homo sapiens
  misc_feature: GYAE6OF01EPOTM.16.73.G07.1.454.CMB.1.raw
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
tcagtgtactactccacgaccggtgctcgatttagctctacgctcagggggctacaacaggcaggcaggggcagcaagatggtgttgcagacccaggtcttcatttctctgttgctctggatctcgtggtgccgtacggggacatcgtgatcgacccagtcctaccacgtacctcccgtggtctgtcgtctcgtgggcgaggacggccacgactacaactcgacaacgtccagccagtagtttagtttaacataacctaccaaacaagtaagacgtacttaacgttagtaccgttacggtaaccagacctaaanaacgtcgaacggaccacgtccctacgtagctcgacttactagttacggngactaccgtaccggtaacccggtacgtcccgggtccagaccgtatcggngcggacgtggccggtagtacggactattcttaccactccacacntacgacgcnccgtgacgacgtaggacaaggtagtcgttcggtacgtactttaagtttactagtactaactaattactaattaattaacttacttaagttacgttacgggtcggaacggtaggtaaaccgtaggtacgaagttaacgaaccggtaaccggttagtcgggtaacgtaccgtacgaaccgttcctagttccg

SEQ ID NO: 247871 - DNA, 807 bp, Homo sapiens
  misc_feature: GYAE6OF01A5A09.16.73.G07.1.454.CMB.1.raw
tcagtgtactactccacgaccggtgctcgatttagctctacgctcagggggctacaacaggcaggcaggggcagcaagatggtgttgcagaccaggtcttcatttctctgttgctctgatctcgtggtcgaccggtacgggactatcggtagaatcgaccctacggttcctaccgacgtaccttccgtcggtcttgttcgtctacggtgggcggaggacggcccaacacgtacaacgtgacgtaacgtaccgacgactaggttagttttacgtttttaactaacctaaccttaacccaaaacgtaaacgttaaaggtacctacgtttaacctttaacggttccgttaacgggtaaccctaacgtaaccgaaacctaaacgttacggacgaaccgtaacgttacccctaacgttagtccgtacgtaccttacgttacgttacggtacggtacctaccggttaacccggttaccgggtaactttcccgggtaccggttccgaaccgttcgtacggttacgacggtcgggacgtcgggtacgggtacgtaggtacgtaacgttcgttaccgtactctaccgactacctacgacgtaccgtacgtccgtagaccggtagtacggtacgtaagttacggtcgttacgtacgtttaacgttacttaccgtaattacccgtaaattaacttaattaaacgtaacctttaacgtacgtttaacggttacgttacggggttaacggtaacgtaacggtacggtagacgtaaaccgtacgttaacggtagttacggtacgagtaccgtagtcttacg

SEQ ID NO: 247872 - DNA, 794 bp, Homo sapiens
  misc_feature: GYAE6OF01AF463.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacagtcgtgatgacccagtctccagtacctcccgtggctgtcgtctacgtgggccgaggacgggcccacactcaactgcaagtccaggccagtagttgtttacactaactaccaacaagtaagacgtctacgttagtccgtttagggtacccaggacaacgtaaatcgaggtaccacgtcccgttacctaagtctacgccttactacttttacggcgggactaactacccgggtaacccgggacgttcccggggtaccctacggtaccgtaagtccgtaggcgggtactacggggtccgggttacgtacgggggtaccagggtttacctttaccggaacccttcccgtaaccgaaccctacgttaccgtaacgggaaccttaccgggccccgttagaccggtacgggtacctaagggtaaacgtggttacgggtcgttaccgttttaacgggtttaatttaacccggttaggtaaacctaaacttaaacgtttaactttaaaccgttaaaatttaccttaaccggttttaaacgttttaacgggttaccggggaccggtaaacggggtaacggtaaccgggtaggtaaagtacgtaaaccggtaaacggttccggtagttaccggtactaccgggtaaccctacgtcgttaccgg

SEQ ID NO: 247873 - DNA, 818 bp, Homo sapiens
  misc_feature: GYAE6OF01AJAID.16.73.G07.1.454.CMB.1.raw
  modified_base (129)..(129): a, c, t, g, unknown or other
  misc_feature (129)..(129): n is a, c, g, or t
tcagtgtactactccacgaccggtgctcgatttagctctacgctcagggggctacaacaggcaggcaggggcagcaagatggtgttgcacgacccaggtcttctatttctctgttgctcgtggatcctntggtcgccgtacggggacatcgtgagtcgacccagtcctaccgaacgacctcccgtcggtcctgtcgttctcggtacggggacggacggcggaccaaccactaccaacgtcggacaacgtccaggaccgtaagtacgtttatttaactaactaactaccctaaaacaaagttaacgacgtacttaacgtttagaccgtttaggaacctaacgacaaactaaaacgtcgacggaacctacgtaccctaacgtaacgtctacgtaccttacttaactttacggacggactacccgtaacccgggtaaccccggtaacggtcccggggttacccctagtaacccggttatttcgacggttacggtacgtcgggaccgggttcggtaaacgggtacaagtttacccttaccgaccttaccgtacctacctaacgacgacgtaccgtaacggtccacggtaacggtagtaacccgtagttaaacgcggttacgtacgtatttaacttaggtttaactaacgtaacttaacgtaaattttaacgtaaacgttaaactttaacgtaactttaaacggtttacgggtaaacccggacggggtaaagttaacccggaaggggttacgaaacgtttaacgaaacgggttaaacccgtaagtttacgacgttaacgtacgaacctttcgtaaccggttac

SEQ ID NO: 247874 - DNA, 495 bp, Homo sapiens
  misc_feature: GYAE6OF02G9QMO.16.73.G07.1.454.CMB.1.raw
  modified_base (304)..(304): a, c, t, g, unknown or other
  misc_feature (304)..(304): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttacngggcatctacccgggaatccggggtcctgaccgattcagtggcagcggtctgggacagatttcactctcaccatcagcagcctgcagctgaagatgtgctagtttatactgtacaactatattataataatcctaatttaattcggagtaggacaaggtggagatacgaaacgtatgtcggctgcacatcg

SEQ ID NO: 247875 - DNA, 539 bp, Homo sapiens
  misc_feature: GYAE6OF02GQR5N.16.73.G07.1.454.CMB.1.raw
  modified_base (308)..(308): a, c, t, g, unknown or other
  misc_feature (308)..(308): n is a, c, g, or t
  modified_base (402)..(402): a, c, t, g, unknown or other
  misc_feature (402)..(402): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataacctccaaacaataagagctacttagcttggtaccagcacaaatcaggacagcctacctaagctgctcatttacnggcatctacccgggaatcccgggtcctgaccgattcagtggcagcgggtctgggacagtattcactctcaccatcagcagcctgcagctagaangtgtgctagtttattacgtgtcaaactaattattaataaacttaattacctaaattttaagttcggacggtagggtaaccgtaagggtggaagtaacgtacgaaacgtacgtgtacggtctacggacaccgtattcg

SEQ ID NO: 247876 - DNA, 504 bp, Homo sapiens
  misc_feature: GYAE6OF02INCIO.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactcaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggctagtttatactgtcaacaatattaataataattccaatttaattcgacggagggaccaaggtggagatacaaacgaacgtgtaggctggacaccatcg

SEQ ID NO: 247877 - DNA, 508 bp, Homo sapiens
  misc_feature: GYAE6OF02FUBYZ.16.73.G07.1.454.CMB.1.raw
  modified_base (229)..(229): a, c, t, g, unknown or other
  misc_feature (229)..(229): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatctacccgggaatccggggtcctgaccgattcagtggcagcgggtctgggacagatttcactctcaccatcagcagcctgcaggctgaagatgtggcagtttattactgtacaacaatattaataattaatcctaatttaattcggacggtagggaccaagggtggaagatacaaacgtactgtaggctgctaccatcg

SEQ ID NO: 247878 - DNA, 764 bp, Homo sapiens
  misc_feature: GYAE6OF02J27XT.16.73.G07.1.454.CMB.1.raw
  modified_base (229)..(229): a, c, t, g, unknown or other
  misc_feature (229)..(229): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaaacaataagagctacttagcttggtaccagcaacaaatcaggacagcctccaagctgctaatttactgggcatcgtacccgggaatcccgggggtcctggaccgattccgagtcggcaggcgggtcgtagggacaggtactttcgaccttctaccaccgtatccgaagtccgaacgtcccgttggaccgtaacgggtccgttaaggaaacggtacgttacgggttacgggtaacccgtttaaggtttttaaacgtttaacccgttacgggttaaccctaaaaaccgttaaaagtttaaaacttttaaacgtttaaaaactttaaaccgttttaaacccgttaaacgtttttttaaaaccggtttaccgggggtaaccgggggtaaaccgggggttaacccggtaaagggggtttacggggaaacggtaaccgtttaaaccggaaaaaccgggtttaaacccggttaggttaacggggttacccgttaacgggtaccctaacccgttacgttacccgttttaaccgg

SEQ ID NO: 247879 - DNA, 534 bp, Homo sapiens
  misc_feature: GYAE6OF02HEN0D.16.73.G07.1.454.CMB.1.raw
  modified_base (421)..(421): a, c, t, g, unknown or other
  misc_feature (421)..(421): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
tcagtgtactactccacgaccggtgctcgatttagctctacgctcaggggtccgggagatcatgagggtgtccttgagtctgggggaggcgtggtccagcctggggggtcgctgagactctcctgtgcagcctctggattcaccttcagtacctatgccatacactgggtccgccagcctccaggcaaggggctggagtgggtggctcttatatcatctgatggaggtactgaatactacgcagactccttgaagggccgattcaccatctccagagacaattcccagaacacactgtatctgcaaatgaacagcctgataactgaggacacggctctatattactgtgcgagagggggccgtgggagctctccacgggccatgactccgtggggccagggatcccgtggtccaccgtccncctcagccctccaccgacggcccagtccgtccttccccgnggccnccctgcctccgaggacgccaccctccgagacgccacgacgccggccccgtgggacctcgcccttcggg

SEQ ID NO: 247880 - DNA, 521 bp, Homo sapiens
  misc_feature: GYAE6OF02IFJ2O.16.73.G07.1.454.CMB.1.raw
  modified_base (229)..(229): a, c, t, g, unknown or other
  misc_feature (229)..(229): n is a, c, g, or t
  modified_base (479)..(479): a, c, t, g, unknown or other
  misc_feature (479)..(479): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatctaccgggaatccggggtcctgaccgattcagtggcagcgggtctgggacagatttcactctcaccatcagcagcctgcaggctgaagatgtggctagtttatactgtacaaacatattataataattacctatttaacgttcggacggtaggaacctaagggtggaanacgtacaaacgtaactggtaggcctaggtaaccagtcttacg

SEQ ID NO: 247881 - DNA, 531 bp, Homo sapiens
  misc_feature: GYAE6OF02I4IFP.16.73.G07.1.454.CMB.1.raw
  modified_base (229)..(229): a, c, t, g, unknown or other
  misc_feature (229)..(229): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatcgtacccgggaatcccggggtcctgaccgattcagtggcaggcgggtcgtggggacagtactttccacttctacacccatcagcacgcctgcaggctgaagatgtggtctagtttatactgtacaactatattaataatatactatttaagttcggacggtacggacaagggtggaacgtataacgaacgtacgtggtacggtccgtgacctacctatacg

SEQ ID NO: 247882 - DNA, 518 bp, Homo sapiens
  misc_feature: GYAE6OF02I23QR.16.73.G07.1.454.CMB.1.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
  modified_base (411)..(411): a, c, t, g, unknown or other
  misc_feature (411)..(411): n is a, c, g, or t
  modified_base (487)..(487): a, c, t, g, unknown or other
  misc_feature (487)..(487): n is a, c, g, or t
  modified_base (515)..(515): a, c, t, g, unknown or other
  misc_feature (515)..(515): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttacngggcatccgtacccgggaacgtcccgggtcctcgaccgtatcgaggtcggcaggcgggtcngggacagtcttcactcacaccatcagcagcctgcgaggtcagaagntggcgtctagtttatactgtacaactaatattaataatacttactatttaagtcggaggtaggacgtaggtggaanataacgaacgagtgtggactgactactntcg

SEQ ID NO: 247883 - DNA, 497 bp, Homo sapiens
  misc_feature: GYAE6OF02JIVV3.16.73.G07.1.454.CMB.1.raw
  modified_base (229)..(229): a, c, t, g, unknown or other
  misc_feature (229)..(229): n is a, c, g, or t
  modified_base (400)..(400): a, c, t, g, unknown or other
  misc_feature (400)..(400): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctctaagctgctcatttactgggcatctacccgggaatcctgggtccctgaccgattcagtggcagcgggtctgggacagatttcactctcaccatcagcagcctgcaggctgaagntgtgctagtttatactgtcaacaatattataataatctaatttaattcggacggtagggaccaagggttgagatacaaacgactgtgctagcaccta

SEQ ID NO: 247884 - DNA, 559 bp, Homo sapiens
  misc_feature: GYAE6OF02JTAU5.16.73.G07.1.454.CMB.1.raw
  modified_base (303)..(303): a, c, t, g, unknown or other
  misc_feature (303)..(303): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctctaagctgctcatttacnggcatctaccgggaatccggggtcctgaccgattcagtgcagcgggtctgggacagtactttcgactctcgaccctatcacgtcagcctgcgtaggctagaacgagttgaggctagtttactactgtacaataatattaataattaactacctaatttaacgttcggacgggtaggtaaccgtaagggtaggtaagtaagtaaccgtaaacggtaacttacgggttacggtccgtaggacctacccgtattacccg

SEQ ID NO: 247885 - DNA, 493 bp, Homo sapiens
  misc_feature: GYAE6OF02F9VXA.16.73.G07.1.454.CMB.1.raw
  modified_base (453)..(453): a, c, t, g, unknown or other
  misc_feature (453)..(453): n is a, c, g, or t
  modified_base (490)..(490): a, c, t, g, unknown or other
  misc_feature (490)..(490): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcgagtggcagcgggtctgggacagatttcactctcaccatcagcagcctgcaggctagaagatgtggctagtttatactgtacaacatattataataatctatttattcggnggaggacaggtgagtatacaaacgatgtggctgcacntcg

SEQ ID NO: 247886 - DNA, 493 bp, Homo sapiens
  misc_feature: GYAE6OF02F5EDT.16.73.G07.1.454.CMB.1.raw
tcagtgtactactccacgaccggtgctcgatttagctctacgctcagggggctacaacgggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatataactccaacaataagagctacttagcttggtaccagcacaaatcaggacagcctcctaagctgctcatttactgggcatctacccgggaatcctgggtccctgaccgattcagtggcagcgggtctgggacagatttcactctcaccatcagcagcctgcaggctgaagatgtggctagtttatactgtcaacaatattaataataatcctatttaattcgacgagggaccaagggtgagatacaacgatgtggctgcacatc

SEQ ID NO: 247887 - DNA, 498 bp, Homo sapiens
  misc_feature: GYAE6OF02H59NJ.16.73.G07.1.454.CMB.1.raw
  modified_base (228)..(228): a, c, t, g, unknown or other
  misc_feature (228)..(228): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanataactccaacaataagagctacttagcttggtaccagcacaaatcaggacagcctcctaagctgctcattactgggcatctaccgggaatccggggtcctgaccgattcagtggcagcgggtctgggacagatttcactctcaccatcagcagcctgcaggctgaagntgngctagtttatactgtacaacatattataataatcctatttaattcggacgtaggaccaaggtggaagtagtacaaacgacgtgtggctagctaccatc

SEQ ID NO: 247888 - DNA, 592 bp, Homo sapiens
  misc_feature: GYAE6OF02G6NOU.16.73.G07.1.454.CMB.1.raw
  modified_base (173)..(173): a, c, t, g, unknown or other
  misc_feature (173)..(173): n is a, c, g, or t
tcagtgtactactccacgaccggtgctcgatttagctctacgctcaggggtccgggagatcatgagggtgtccttgagtctgggggaggcgtggtccagcctggggggtcgctgagactctcctgtgcagcctctggattcaccttcagtacctatgccatacactgggtccnccagcctccaggcaaggggctggagtgggtgctcttatatcatctgatggaggtactgaatactacgcagactccgtgaagggccgattcaccatctccagagacaattcccagaacacactgtatctgcaaatgaacagcctgagaactgaggacacggctctaatattactgtgcggagaggggggccgtggggacgctccgtccgacggggccagtgactccgtggggccaggggactcccgtggtccacccgtctccgtcacgtccctccaacccgaacgggccccaagttcccggtccttcccccgtcgggcccgccccttcgcctcccgacggtacgcccgaaccccgtccggaacggacgacccgaacgacggcccgggtcccgtcgggggtccctcggcccgttaccgggg

SEQ ID NO: 247889 - DNA, 499 bp, Homo sapiens
  misc_feature: GYAE6OF02JBB94.16.73.G07.1.454.CMB.1.raw
  modified_base (229)..(229): a, c, t, g, unknown or other
  misc_feature (229)..(229): n is a, c, g, or t
  modified_base (357)..(357): a, c, t, g, unknown or other
  misc_feature (357)..(357): n is a, c, g, or t
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatctacccgggaatccggggtccctgaccgattcagtggcagcgggtcngggacagatttcactctcaccatcagcagcctgcaggctgaagntgtggctagtttatactgtanaactaatattataataatctaatttaattcggcggaggacaaggtggaagatacgaaagactgtcgctgcactatcg

SEQ ID NO: 247890 - DNA, 529 bp, Homo sapiens
  misc_feature: GYAE6OF02G1ZF2.16.73.G07.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (312)..(312): a, c, t, g, unknown or other
  misc_feature (312)..(312): n is a, c, g, or t
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
tcagtgtactactccacgaccggtgctcgatttagctctacgctcagggggctacaaccaggcaggcaggggcagcaagatgggtgttgcagaccccaggtcttcatttctctgttgctctggatcctctggtgcctacggggacatcgtgatagacccagtctccagactccctggctgtgtctctgggcgagagggccaccatcaactgcaagtccagccagagtgttttanataactccaanaataagagctacttagcttggtaccagcacaaatcgaggacagcctcctaagctgctacatttaccnggcatccgtacccgggatcccggggtcctgaccgattcaggtggccaggcgggtctggggacagtatttcactctcaccatcagcagcctgcaggctagaagngtgcggctagtttatacngtacaatatattataataatactatttaagttcgaggtacggacaaggtggaatactacgaaacgtacgtggtacggactaggacctacgagtacg

SEQ ID NO: 247891 - DNA, 546 bp, Homo sapiens
  misc_feature: GYAE6OF02FHJ5I.16.73.G07.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (397)..(397): a, c, t, g, unknown or other
  misc_feature (397)..(397): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttacngggcatctacccgggaatccggggtcctgaccgtattcagtggcagcgggtctggggacagatttcactctcaccatcagcagcctgcaggcngaagatgtggctagttttatacttgtacaaactattaattaataaattaatcctaattttaagtttcggacgggtagggaacctaagggtacggaagtaactacgaaaacgtaacgttggtacggaccgttaggacctaccgtattccg

SEQ ID NO: 247892 - DNA, 589 bp, Homo sapiens
  misc_feature: GYAE6OF02H4YIW.16.73.G07.1.454.CMB.1.raw
  modified_base (130)..(130): a, c, t, g, unknown or other
  misc_feature (130)..(130): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
tcagtgtactactccacgaccggtgctcgatttagctctacgctctagggggcgtacaacgaggcaggccaggggcagcaagatggtgttgcagacccaggtcttcatttctctgttgctctggatcctntggtgccgtacggggacatcgtgtatgacccagtctccagactccctggctgtgtctctgggcgagagggccaccagtcaactgcaagtccagccagagtgtttanataactccaanaataagagctacttagcttggtaccagcacaaatcagacagcctcctaagctgactctattactgggcatcgtaccgggagtccgggtcctggtaccgattcagtggcaggcggtctggggactagattcactactcaccatcgacgctacgcctgccgaggcctagaacgactgtgacctagtttattactcgtacaaactaataacttaataataactcctaaagttttaaactttaccgggacggtacggggacccgtaagggtaggtaacggtaacttaccgaaaacggtaccgttagggtacgggtaccttacggaccggtaacccctattacccgg

SEQ ID NO: 247893 - DNA, 525 bp, Homo sapiens
  misc_feature: GYAE6OF02G3QH0.16.73.G07.1.454.CMB.1.raw
  modified_base (333)..(333): a, c, t, g, unknown or other
  misc_feature (333)..(333): n is a, c, g, or t
  modified_base (424)..(424): a, c, t, g, unknown or other
  misc_feature (424)..(424): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatataactccaacaataagagctacttagcttggtaccagcacaaatcaggacagcctcctaagctgctcatttactgggcatctacccgggaatcccggggtcccngaccgattcagtggcagcgggtctgggacagatttcactctcaccatcagcagcctgcaggctagaagatgtgctagtttatactgtcaanatattaataataattcctaatttaagttcggacggtagggacctaagggtggaacgtagtaccgaaacgtaacgttggtacggtctaggacaccgtatccg

SEQ ID NO: 247894 - DNA, 611 bp, Homo sapiens
  misc_feature: GYAE6OF02HZGF1.16.73.G07.1.454.CMB.1.raw
  modified_base (248)..(248): a, c, t, g, unknown or other
  misc_feature (248)..(248): n is a, c, g, or t
  modified_base (307)..(307): a, c, t, g, unknown or other
  misc_feature (307)..(307): n is a, c, g, or t
  modified_base (393)..(393): a, c, t, g, unknown or other
  misc_feature (393)..(393): n is a, c, g, or t
  modified_base (413)..(413): a, c, t, g, unknown or other
  misc_feature (413)..(413): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccacatcaactgcaagtccagccagagttgtttatataactcaacaataaganctattagcttggtaccagcaacaaatcaggacagccctactaagctgctctatttacgngggcatccgtaacccgggaatcccggggtcctaggacccgtattcgaggtgcgaggcgggtctgggacagtatttcactctcactntcagcacgctcgacgacggntagaagagttgtaggtctaagtttactacgttagtacctaaagtaattagtttaaataacgttaaacttccgttaaatttaaacgtttcgggaacggtaacgggtaacccgttaaggggtacgggtaacgtaaccgtaacgtaaaaccggtaacgtttcggtacgggtaccgttacggaccgttaccgtacttaccgg

SEQ ID NO: 247895 - DNA, 557 bp, Homo sapiens
  misc_feature: GYAE6OF02G1K6D.16.73.G07.1.454.CMB.1.raw
  modified_base (404)..(404): a, c, t, g, unknown or other
  misc_feature (404)..(404): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
tcagtgtactactccacgaccggtgctcgatttagctctacgctcaggggtccgggagatcatgagggtgtccttgagtctgggggaggcgtggtccagcctggggggtcgctgagactctcctgtgcagcctctggattcaccttcagtacctatgccatacactgggtccgccagcctccaggcaaggggctggagtgggtggctcttatatcatctgatggagtactgaatactacgcagactccgtgaagggccattcaccatctccagagacaattcccaagaaaccacactgtatctgacaaatgaaacagcctagacgaactgaggacacggctactatattactgtgcggaggaggggggccgtgggagcctccgcgacggggccagtcgactcgngggccagggctcccgtggtaccacccgtctccctcgacgccctaccgaaccgaacgggcccctagtcccggtccttccccgnggcccnccctgcctaccgaggcnccgacccgtcggagtcgccaacgcggcccggcctgggctcgcgtacgg

SEQ ID NO: 247896 - DNA, 505 bp, Homo sapiens
  misc_feature: GYAE6OF02G2UX4.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtcctgaccgattcagtggcagcgggtctgggacagatttcactctcaccatcagcagcctgcaggctgaagatgtggcagtttatactgtacaacaatattataattaatcctaatttaatttcggcggaggaccaagggtggaagtatacaaacgatgtaggctgactaccattcg

SEQ ID NO: 247897 - DNA, 519 bp, Homo sapiens
  misc_feature: GYAE6OF02IANLC.16.73.G07.1.454.CMB.1.raw
  modified_base (229)..(229): a, c, t, g, unknown or other
  misc_feature (229)..(229): n is a, c, g, or t
  modified_base (401)..(401): a, c, t, g, unknown or other
  misc_feature (401)..(401): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatctacccgggaatcccggggtccctgaccgattcagtggcagcgggtctgggacagatttcactctcacatcagcagcctgcaggctgaagntgtggctagtttatactgtcaactaatattaataattaatactatttaagtttcggacggtagggacctaagggtggagaataccgaaaacgtatggtacggctggactaccattccg

SEQ ID NO: 247898 - DNA, 514 bp, Homo sapiens
  misc_feature: GYAE6OF02HY2U7.16.73.G07.1.454.CMB.1.raw
  modified_base (497)..(497): a, c, t, g, unknown or other
  misc_feature (497)..(497): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctaccgggaatcctgggtccctgaccgattcagtggcagcgggtctgggacaggtattcactctcaccatcagcagctgcaggctagaagatgtgctagtttatactgtacaaactaatattaataataactctaatttaattcggaggaggtaccaagggtggaagtatacgaaacgtacgtaggngtacgtgacgacctacg

SEQ ID NO: 247899 - DNA, 501 bp, Homo sapiens
  misc_feature: GYAE6OF02J2FOR.16.73.G07.1.454.CMB.1.raw
  modified_base (229)..(229): a, c, t, g, unknown or other
  misc_feature (229)..(229): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctactagcttggtaccagcacaaatcaggacagcctcctaagctgctcatttactgggcatctacccgggaatccggggtcctgaccgattcagtggcagcgggtctgggacagatttcactctcaccatcagcagcctgcaggctgaagntgnggcagtttatactgtcaacattattataatactcctaatttaacgttcggacggtaggacctaaggtggaanatacaaagactgnggctgctaccagtc

SEQ ID NO: 247900 - DNA, 522 bp, Homo sapiens
  misc_feature: GYAE6OF02HSOCL.16.73.G07.1.454.CMB.1.raw
  modified_base (403)..(403): a, c, t, g, unknown or other
  misc_feature (403)..(403): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatataactcaacaataagagctacttagcttggtaccagcacaaatcaggacagccctacctaagctgctcatttactgggcatctacccgggaatcccggggtcctgaccgattcagtggcagcgggtctagggacagtatttcactctcacactcagcagcctgcagctagaagntgtggctagttttatactgtacaacaatattaataattaatcctaatttaagtttcgggacggtagggacctaagggtggaacgtagtacaaacgagtcgtggaccttgactactatcg

SEQ ID NO: 247901 - DNA, 554 bp, Homo sapiens
  misc_feature: GYAE6OF02FK1RR.16.73.G07.1.454.CMB.1.raw
  modified_base (301)..(301): a, c, t, g, unknown or other
  misc_feature (301)..(301): n is a, c, g, or t
  modified_base (405)..(405): a, c, t, g, unknown or other
  misc_feature (405)..(405): n is a, c, g, or t
tcagtgtactactccacgaccggtgctcgattagctctacgctcaggggctacaacaggcaggcagggcagcaagatggtgttgcagaccccaggtcttcatttctctgttgctctggatctctggtgcctacgggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttacnggcatctacccgggaatccggggtccctgaccgattcagtgggcaggcgggtctggggacagtactttcactctcaccatcagcagccctgcaggctagaagtntgtggcagttttatactgtacaaactaatattaataaatactacctaagtttaacgttcgggacggtagggacctaagggttcgggaataacttaccgaaaacggtaaccgttgggtacgggtaccttacggaccctacctagttaccg

SEQ ID NO: 247902 - DNA, 550 bp, Homo sapiens
  misc_feature: GYAE6OF02F3R5N.16.73.G07.1.454.CMB.1.raw
  modified_base (307)..(307): a, c, t, g, unknown or other
  misc_feature (307)..(307): n is a, c, g, or t
  modified_base (330)..(330): a, c, t, g, unknown or other
  misc_feature (330)..(330): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataactccaacaataagagctacttagcttggtaccagcaacaaatcaaggacagcctcctaagctgctcatttacnggcatcaccgggatccgggtccngaccgatcagtgcagcggtctgggacagtactttcactctcaccatcagcagcctgccaggctaggaaagtgtaggtggacttagttttaacttacgtgtacctaaataattaattaataaattaacttaccttaatttttaacgtcgggaccggtagggacctaaagggtggaatagtaaccgaaaggtaatggtacggactaggaccaccgtattccg

SEQ ID NO: 247903 - DNA, 602 bp, Homo sapiens
  misc_feature: GYAE6OF02FIWAY.16.73.G07.1.454.CMB.1.raw
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (319)..(319): a, c, t, g, unknown or other
  misc_feature (319)..(319): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgacaagtccagccagagttgttttanataactccaanaataagagctacttagcttaggtaccagcaacaaatcaaggacacgtccctacctaagctgcctactattttacgngggcattaccgtacccgggagtcccggggtcctggaccgtattcgagtggcaggcgggtctagggacagtactttcactctacacntcagccagcctagnggctagaagtntggtcgtattagtttactactgtacaaactaattagtttaataaattaacttacctaatttttaaacggttccgggacgggtaacgggtaaccgtagggtacgggaagtaacgttaacgaaaaccggtacgttggtacgggacttacggacctaacccgtagtttcgttacg

SEQ ID NO: 247904 - DNA, 587 bp, Homo sapiens
  misc_feature: GYAE6OF02JII02.16.73.G07.1.454.CMB.1.raw
  modified_base (229)..(229): a, c, t, g, unknown or other
  misc_feature (229)..(229): n is a, c, g, or t
  modified_base (414)..(414): a, c, t, g, unknown or other
  misc_feature (414)..(414): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatccgtacccgggaagtcccggggtcctgaccgtattcaggtcgcaggcgggtctgggacagtatttccactctccaccatcagcagcctgcgaggtctagaagtntaggtcgacgtaagtttacttacgtgttacaactaattaatttaagtaaattaacttacctaaagttttaacgttcgggtaacgggtacggtaaccggaagggttcgggaacgtaacgtaaccgtaaaacgtaacgttacggttaggtaccttacgacgtacctacgttaccg

SEQ ID NO: 247905 - DNA, 552 bp, Homo sapiens
  misc_feature: GYAE6OF02GTR3I.16.73.G07.1.454.CMB.1.raw
  modified_base (312)..(312): a, c, t, g, unknown or other
  misc_feature (312)..(312): n is a, c, g, or t
  modified_base (403)..(403): a, c, t, g, unknown or other
  misc_feature (403)..(403): n is a, c, g, or t
  modified_base (430)..(430): a, c, t, g, unknown or other
  misc_feature (430)..(430): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgaggacgggccaccatcaactgcaagtccagccagtagtgttttatataactaccaaacaataagagctacttagcttggtaccagcacaaatcaggacagcctacctaagctgctctatttacgngggcatccgtacccgggaacgtcccggggtcctgaccgtattcgagtggcaggcgggtcgtgggactaggtatttcactcctcaccatcancacgcctgcaggctagaagtgtgtggntagtttatactgtacaataattattaataattaactacttaatttaagttacggacggtacgggtaccaaggggtgaagtagtaaccgaaagtacgtggtacgtctagacctactattaccg

SEQ ID NO: 247906 - DNA, 579 bp, Homo sapiens
  misc_feature: GYAE6OF02I5QS3.16.73.G07.1.454.CMB.1.raw
  modified_base (146)..(146): a, c, t, g, unknown or other
  misc_feature (146)..(146): n is a, c, g, or t
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgngatgacccagtctccagactccctggctgtgtctctgggcgagagggccaccatcaactgcaagtccagccagagtgtttanataactaccaaanaataaganctaacttagcttaggtaccagcaacaaatcaggacacgcctacctaagctgctacatttacgngggcactcgtacccgggaacgtcccgggtcctggaccgtattcgagtcggacgaggacgggtcgaggggactaggtactttacactcctacaacctatcagcgagccctgcgaggcagaagatgtggtactagtttattacgtgtactaactaatattaataaataacttactaatttaacgttcggacggtagggaaccgtaagggtggaagtaagtaaccgaaacgtaacgtagtaggtaccgtaggtaaccctacctagttacg

SEQ ID NO: 247907 - DNA, 620 bp, Homo sapiens
  misc_feature: GYAE6OF02G5NAE.16.73.G07.1.454.CMB.1.raw
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacacgcctactaagctgcctctatttacnggcatcctaacccgggaatccgtcgggtccctgaccgtnttcgacggtggacaggcgggtctaggggactagtatttccacttctaccacctatccagcacgtccctggccgaggcctaggaagtagttggtacggtacgttaagttttacttacgtagttacctaaacgttaaatttaatttaattaaacgttaacttacccttaaagtttttaacgttccgggaacggtaacgggtaaccgtaaggggtacggaagtaacgtaaccgtaaaacgtacggttaggtaccggtactacggtaccctaactacg

SEQ ID NO: 247908 - DNA, 519 bp, Homo sapiens
  misc_feature: GYAE6OF02F4OB9.16.73.G07.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctaacttagcttggtaccagcacaaatcaggacagcctcctaagctgctcatttacnggcatcctacccgggaatccgtggtccctgaccgattcagtgcaggtcgggtctggggaccagtactttcactctcaaccatcagcagcctgcagctagaagntgnggctagtttattactgtacaataatattataaataactcctaatttaattcgggaggtaaggaccgtaagggtagagtatacgaaacgactgtaggctcgactactac

SEQ ID NO: 247909 - DNA, 500 bp, Homo sapiens
  misc_feature: GYAE6OF02GRLTH.16.73.G07.1.454.CMB.1.raw
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctctaagctgctcatttacnggcatctacccgggaatcagggtcctgaccgattcagtgcagcgggtctgggacagatttcactctcaccatcagcagcctgcagctgaagntgngtctagtttatactgtacaactatattataataatcctaatttattcggagtacggacgtaaggtgagtactacgtaacgtactcggtagctcgcacctacg

SEQ ID NO: 247910 - DNA, 538 bp, Homo sapiens
  misc_feature: GYAE6OF02JIP1S.16.73.G07.1.454.CMB.1.raw
  modified_base (239)..(239): a, c, t, g, unknown or other
  misc_feature (239)..(239): n is a, c, g, or t
  modified_base (304)..(304): a, c, t, g, unknown or other
  misc_feature (304)..(304): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatataactccaanaataagagctacttagcttggtaccagcacaaatcaggacagcctacctaagctgctcatttacnggcatctaccgggaatccggggtccctgaccgattcagtggcagcggtctgggacagtattcactctcaccatcagcagcctgctaggctaggaagatgtggactagtttatactgtacaactatattaataataatacctattttaacgttcgggtacggtacgggacgtaagggtcggaaggaataacgaaacgtaacgtcggttacggacgtagtacctacctagttaccg

SEQ ID NO: 247911 - DNA, 637 bp, Homo sapiens
  misc_feature: GYAE6OF02I2IHA.16.73.G07.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
tcagtgtactactccacgaccggtgctcgatttagctctacgctcgagggggctacaacaggcaggcaggggcagcaagatggtgttgcagacccaggtcttcatttctctgttgctctggatctctggtgcctacgggacatcgtgatgacccagtctccagactccctggctgtgtctcgtgggcgagaggccacatcaactgcaagtccagccagagtgtttanataactccaaacaataagngactacttagcttaggtaccagacaacaaatcaaggacagcctctaagctgctcatttacgnggcatccgtacccgggtaatcccggggtcctagacccgtagttcgagtcggcgaggtcgggtctagggactagtactttaccgactctaccgaacctagtacgaacgtaccgtacgtcccgttagaccgtaacggcgttaaggaacgtagttcggtcgtacttaagttttattaccgtagtaaccaaactaattaagttaaattaacttaaagttcccttaaagttttaaacggtttccgggaacggtacgggaaccgtagggtaagggaacttacgtaaccgtaaaacggtacgttagggttacggtctacgtacctaccgtattccg

SEQ ID NO: 247912 - DNA, 556 bp, Homo sapiens
  misc_feature: GYAE6OF02JVEK4.16.73.G07.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (506)..(506): a, c, t, g, unknown or other
  misc_feature (506)..(506): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttanataactccgaacaataagagctacttagcttggtaccagcacaaatcaggacagcctacctaagctgctcatttacnggcatcctaccgggaatccggggtcctgaccgattcgagtcggcagcgggtctggggacagtatttcgactctccacatacgagtcacgcctgcaggcctagaacgatggtacgactagtttagtacctagtacaacgtaattaattaataacttaatcgtaatttaacgttcggacggtacggaacctaagggtggtaanagttaccgaaaccgtaagtcgggttagaccgtacggtacaccgtattccg

SEQ ID NO: 247913 - DNA, 506 bp, Homo sapiens
  misc_feature: GYAE6OF02GKFA8.16.73.G07.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttacngggcatctacccggggaatccggggtcctgaccgattcagtggcaggcggtctgggacagatttcactctcaccatcagcagcctgcaggctgaagngtgtgctagtttattactgtacaataattataataataatctaatttaagttcggaggtacggactaagggtgagtataccaaagtactgtggctagcacctatc

SEQ ID NO: 247914 - DNA, 583 bp, Homo sapiens
  misc_feature: GYAE6OF02IN8CE.16.73.G07.1.454.CMB.1.raw
  modified_base (400)..(400): a, c, t, g, unknown or other
  misc_feature (400)..(400): n is a, c, g, or t
tcagtgtactactccacgaccggtgctcgatttagctctacgctcagggggctacaacaggcagccaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataactccaacaataagagctacttagcttggtaccagcaacaaatcaggacagcctacctaagctgcctctatttacgtgggcatccgtaacccgggaatccgtcggtccctgacccgattcagtggcaggcgggtctgggacagtactttcactctacacatcagcancctgcgtaggctaggaagtgtgtggactagtttattactgtaacaaactaattaattaataaacttaactaccttaaagttttaacgtttccgggacgggtaacgggtaccgtaaagggtaggtaacgtaacttaaccgaaaacggttacgttgggtaggtaccgtacggaccctaacctacg

SEQ ID NO: 247915 - DNA, 490 bp, Homo sapiens
  misc_feature: GYAE6OF02GW5F5.16.73.G07.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
  modified_base (394)..(394): a, c, t, g, unknown or other
  misc_feature (394)..(394): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaaanaataagagctacttagcttggtaccagcacaaatcaggacagcctcctaagctgctcatttacngggcatctaccgggaatcccgggtcctgaccgattcagtggcagcggtctgggacagatttcactctcaccatcagcagcctgcaggcngaagatgtggctagtttatacgtgtacaatatattaataataactctaatttattacggcgaggacaggtgagatacaacgatgtgctgcacatcg

SEQ ID NO: 247916 - DNA, 551 bp, Homo sapiens
  misc_feature: GYAE6OF02HWYV3.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttatataactcaaacaataaagagctacttagcttggtaccagacaacaaatcaggacagccctacctaagctgctactatttacgtgggcatccgtacccgggaatccggggtccctggaaccgtattcagtggcgagcgggtctggggacagatttcactctcaccatcaagcacgcctgcgaggctagaagagtgtggactagtttacttatgtacaactaataattaataattaatcctaatttaacgttcggaggacgggaacctaaggtggaagtataaccgaaacgtacgttagtcggtactacggacaccgtattcg

SEQ ID NO: 247917 - DNA, 557 bp, Homo sapiens
  misc_feature: GYAE6OF02F86DE.16.73.G07.1.454.CMB.1.raw
tcagtgtactactccacgaccggtgctcgatttagctctacgctcaggggtccgggagatcatgagggtgtccttgagtctgggggaggcgtggtccagcctggggggtcgctgagactctcctgtgcagcctctggattcaccttcagtacctatgccatacactgggtccgccagcctccaggcaaggggctggagtgggtggctcttatatcatctgatggagtactgaatactacgcagactccgtgaagggccgattcaccatctccagagacaattcccagaacacactgtatctgcaaatgaacagcctagagaactgaggacacggctctatattactgtgcgaggaggggggccggtgggagctcctccgacgggccatgactccgtggggccagggactcccgtggtccaccgtctcctcacgcctccgaccgaacgggccccagtccggtccttcccccgtggcccgccctgcctccgaggacgcctacccgtccgacggacgaccaccgacgcccggtccccgtggggcccttcggccctacggg

SEQ ID NO: 247918 - DNA, 548 bp, Homo sapiens
  misc_feature: GYAE6OF02IILTW.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggaccaccatcaactgcaagtccagccagagtgttttatataactccaacaataagagctacttagcttggtaccagcacaaatcaggacagcctcctaagctgctcatttactgggcatctacccgggaactccggggtcctgaccgattcagtggcaggcgggtcgtgggacagtatttcactctcaccatcagcacgcctgcaggctagaagatgtggctagtttatactgtacaataatattaataattaatacctaattttaacgttcggacggtagggtaaccgtaagggtggaacgtataacgtaaaacgtaacgttaggtacggtaccgtaggacctaccgtagttaccg

SEQ ID NO: 247919 - DNA, 649 bp, Homo sapiens
  misc_feature: GYAE6OF02HOIZY.16.73.G07.1.454.CMB.1.raw
  modified_base (318)..(318): a, c, t, g, unknown or other
  misc_feature (318)..(318): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagagttgttttaatataacctaccaaacaataagagctacttagcttaggaccagacaacaaatcaaggacagccctactaagctgctactattacgnggcacgtaccggtaccggtacgtcccgggtacctcggtaccgtntacgngtcggacgacgggtcggtcggtacggactagttacttccactcgtaccactactcgacgccgtacgtaccgtgacggacggtacgtaagtaaggttagtcggtacggttacctttaagtttactttacgagtaaacctaattaaatttaacgttaaattaacttaccgttactttaaagtttaacgggtcgggacgggtaacggtaacggttaacgggtaggactaaactaaccggtaaacggttgtcgggtacctacgtaccggaccctactaggttaccg

SEQ ID NO: 247920 - DNA, 543 bp, Homo sapiens
  misc_feature: GYAE6OF02GIEP7.16.73.G07.1.454.CMB.1.raw
  modified_base (490)..(490): a, c, t, g, unknown or other
  misc_feature (490)..(490): n is a, c, g, or t
tcagtgtactactccacgaccggtgctcgatttagctctacgctcaggggtccgggagatcatgagggtgtccttgagtctgggggaggcgtggtccagcctggggggtcgctgagactctcctgtgcagcctctggattcaccttcagtacctatgccatacactgggtccgccagcctccaggcaaggggctggagtgggtggctcttatatcatctgatggaggtactgaatactacgcagactccgtgaagggccgattcaccatctccagagacaattccccagaacacactgtatctgcaaatgaacagcctgagaactgagacacggctctatattactgtgcgaggaggggggccggtgggagctcctccgacggggccagtgactccgtggggccagggactcccgtggtccaccgtctcctcagcctccaccgaagggcccagtccgtccttccccgtggccgccctgcctcccgaggcnccaccgtccgacgacgccgacgacggccggcccgtgggcctcggccgtacggg

SEQ ID NO: 247921 - DNA, 617 bp, Homo sapiens
  misc_feature: GYAE6OF02IO6AS.16.73.G07.1.454.CMB.1.raw
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
  modified_base (309)..(309): a, c, t, g, unknown or other
  misc_feature (309)..(309): n is a, c, g, or t
  modified_base (434)..(434): a, c, t, g, unknown or other
  misc_feature (434)..(434): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagtgttttanataactccaacaataagagctaacttagcttggtaccagacanaaatcgagacagcctcctaagctgactcatttacgnggcatctacccgggaatccggggtcctgaccgtattcaggtggacgagcgggtactgggacagtatttcactctcaacctatccgagtcacgtcctgacgacggctagaaacgtgtggtacggtntaacggttttactacgtacggttaacctaaaccgtaagtttaattaattaaaagttaacttacccttaaagttttaaacgtttccggggaacgggtaacgggtaaccgttaaagggtaccgggaagtaacttaaccggaaaacgttacgtagggtcgacgttacggaccctaactacgttacc

SEQ ID NO: 247922 - DNA, 790 bp, Homo sapiens
  misc_feature: GYAE6OF02H7IF5.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacggcccaccatccaactgacaacgtccagccagtagttgttttaatataacctaccaaactaaataaagacgtacttaacgttaagtccgtttacgggtaaccagaccaaactaaacttacggaacgggaccaaccggtacccccttaacccgttaaacgggtcccttacggacctttaccgttaacgtttttaacccggtacgggggtaccctaaccggtttacccgggtaaacccccgggggtaaacgggtttcccccggggggtttacccctacgggtaacccgttacgtttaccggaagggttcggtaccggtacgggtccgggggttacggttacgggggaacctacgggtttaacctttccaacccgtttccctaccctaaccgtactacgacggaccgtaacgtccgttacgacgtaacggcctaaggaacgttagtcggttaggtacttagttttactacgttacgaataactaattaattaattaattacttaactagttttaacgtacggcggtacgaacgtaagggtacggaactaacgaacgttaaacgagttcgggtacggtaccacgacctaccgtattaccg

SEQ ID NO: 247923 - DNA, 509 bp, Homo sapiens
  misc_feature: GYAE6OF02G4TEQ.16.73.G07.1.454.CMB.1.raw
  modified_base (305)..(305): a, c, t, g, unknown or other
  misc_feature (305)..(305): n is a, c, g, or t
  modified_base (478)..(478): a, c, t, g, unknown or other
  misc_feature (478)..(478): n is a, c, g, or t
  modified_base (498)..(498): a, c, t, g, unknown or other
  misc_feature (498)..(498): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataactccaacaataagagctaacttagcttggtaccagcacaaatcaggacagcctctaagctgctcatttacngggcatctacccgggaatcccggggtcctgaccgattcagtggcaggcggtcgtgggacagatttccactctcaccatcagtcagcctgcaggctgaagatgtggctagtttatctgtacaactatattataactaatcctaatttaacgttcggacgaggacagggtagganatacgaaacgtgtagcggtncgacactatcg

SEQ ID NO: 247924 - DNA, 564 bp, Homo sapiens
  misc_feature: GYAE6OF02GYGEG.16.73.G07.1.454.CMB.1.raw
  modified_base (310)..(310): a, c, t, g, unknown or other
  misc_feature (310)..(310): n is a, c, g, or t
  modified_base (365)..(365): a, c, t, g, unknown or other
  misc_feature (365)..(365): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgttttatataactccaacaataagagctacttagcttggtaccagcacaaatcaggacagcctacctaagctgctctatttacgngggcatcgtacccgggatcccggggtcctgaccgatcgagtggcaggcgggtcgngggacagtctttcactctcaccatcagcacgcctgcgaggctagaagatgtggtctagtttatacgtgtacaactaataattaataattaacttaccttaagttttaacgttcgggtaacggtacgggtaaccgtaagggtacggaagtaactaacgtaaacgtaacgtcggttacggctacggacctacgacttaccg

SEQ ID NO: 247925 - DNA, 611 bp, Homo sapiens
  misc_feature: GYAE6OF02F0JLS.16.73.G07.1.454.CMB.1.raw
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgcaagtccagccagtagttgttttaataattaacctaccaaacaaataagagactaacttagcttggtaccagcaacaaatcaggacagcctcctaagctgctactatttacgtgggctatccgtaacccgggtagtcccggggtccctggacccgtattccaggtcggcgacggcgggtcgngggacagttactttcacttcnccaccatcagcagtcctgcgaggctaggaagtgtggtgacgttagtttattacgtagtacctaaataattaatttaataacttaaacttccttaaattttaacgttaccgggacgggtacgggtaacctaaggggttaggaagtaactaaccgaaacggtacgttacgggtacggtacctaggaacccactacgttccg

SEQ ID NO: 247926 - DNA, 724 bp, Homo sapiens
  misc_feature: GYAE6OF02F4DSH.16.73.G07.1.454.CMB.1.raw
  modified_base (383)..(383): a, c, t, g, unknown or other
  misc_feature (383)..(383): n is a, c, g, or t
  modified_base (504)..(504): a, c, t, g, unknown or other
  misc_feature (504)..(504): n is a, c, g, or t
  modified_base (549)..(549): a, c, t, g, unknown or other
  misc_feature (549)..(549): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggaggccaccatcaactgcaagtccagccaggtagttcgttttaataacttaacctaccaaactaaagtaacggacgtaccttaacgtttaggtccgtttacgggtaacccaacggacctaaaccaaaattccgaaacgggaccacgtccccttaaccgtaagtccgtcgtaccttactaacgttttaaccggnggggtacctacgttaccggtaacccccggggtaacgttccccgggggtccctaggacccgtattcgaggttcggacgcgggtcgggtcgtagggactagtactttccactcgtaccaactntactagccacgtcctgacgacggtctaggaacgtgtagtacggtntaaggttttctacgtacgtaacaaacgttattaattaagttaaacttacttaccttaagttttacgttaacggggtacggtacgggtaaccggtaagggttacgggaagtaaacttaacggtaaaaccgttaacgttgggtacggtaccgtacgtaaccctaccgttagttaccg

SEQ ID NO: 247927 - DNA, 503 bp, Homo sapiens
  misc_feature: GYAE6OF02FLP5X.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtcctgaccgattcagtggcagcgggtctgggacagatttcactctcaccatcagcagcctgcaggctgaagatgtgctagtttatactgtcaactaatattataattaatcctatttaattcggcgtaggacaaggtggagatacgaaacgacgtggtacggctagcacattccg

SEQ ID NO: 247928 - DNA, 516 bp, Homo sapiens
  misc_feature: GYAE6OF02FV42D.16.73.G07.1.454.CMB.1.raw
  modified_base (304)..(304): a, c, t, g, unknown or other
  misc_feature (304)..(304): n is a, c, g, or t
  modified_base (407)..(407): a, c, t, g, unknown or other
  misc_feature (407)..(407): n is a, c, g, or t
  modified_base (512)..(512): a, c, t, g, unknown or other
  misc_feature (512)..(512): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttatataactccaaacaataagagctacttagcttggtaccagcacaaatcaggacagcctcctaagctgctcatttacngggcatcgtacccgggaatcccgggtccctgaccgattcagtggcaggcgggtctagggacagtactttcactctccaccatcagcagcctgcaggctgaagngtgtgctagtttatacgtgtacaactattattaataataatctaatttacgttcggacggtaggacctaggtgaagtatacgaaacgagtgtcggctgacctacnttcg

SEQ ID NO: 247929 - DNA, 748 bp, Homo sapiens
  misc_feature: GYAE6OF02HKMBN.16.73.G07.1.454.CMB.1.raw
  modified_base (173)..(173): a, c, t, g, unknown or other
  misc_feature (173)..(173): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
tcagtgtactactccacgaccggtgctcgatttagctctacgctcaggggtccgggagatcatgagggtgtccttgagtctgggggaggcgtggtccagcctggggggtcgctgagactctcctgtgcagcctctggattcaccttcagtacctatgccatacactgggtccnccagcctccaggcaaggggctggagtgggtgctcttatatcatctgagtggagtactagaatactacgcagacctccggtaggaacgggccgtattccaaccattctccagacgactaacttacccaagaaccactactgtactacgtagacaaatacgaacacgacgtagaacgaacgtagacggacgacgactactatattactgnggacggagggacgggggccgggngggacgtccgtcccgtccggaccgggcgtactacggtaccgtcccgggtgggaccggtaacgggtaccgttcccgttaccggtccgaacccgtttcccgcccttaccgaccgtacccctacccgaaacccggtaaccgggtaacccgtcccggttacccgggtttcccccgtttcccccggtccggaccccggtcccctcccgggtccgtacccggaccgggtaccggtccctaacccccgggttaccgggaacccgggtacccgaaccggacccggtaccccggggtccccgggttaccggggtccggggttaccctcccgggggttacccgttaacccgggg

SEQ ID NO: 247930 - DNA, 609 bp, Homo sapiens
  misc_feature: GYAE6OF02GWOCU.16.73.G07.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (319)..(319): a, c, t, g, unknown or other
  misc_feature (319)..(319): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagngggcccaccatcaactgcaagtccagccagtagttagtttanataactccaanaataagnctacttagcgttaggtaccagacaacaaatcaggacacgccctacgtaagctagctacaagtttacgngggctactccggtaacccggggtaatcccggggtcctagaccgtattcgagtcggcaggtcggtcgtacgggactagtacttaccgactctacaccagtcacgcacgtccgtgacgagtactagaagcgtaggtgtacttaagtttactacgtacgtactaaacttaattaagttaacttaattaccgttaccttaagtttaaacgttcggacggtaacggaaccgtaagggtgaaacgtactaacgaaacggtacgttaggacggttactacgacccgtacgtattccg

SEQ ID NO: 247931 - DNA, 627 bp, Homo sapiens
  misc_feature: GYAE6OF02G0KLE.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataactaccaacaataagagctacttagcttggtaccagcacaaatcaggacagcctcctaagctgctcatttactgggctatccgtacccgggaagtcccggggtcctgaccgtatcgagtggcaggcgggtctggggacagtatttccacttaccgtccacctactaccgaagtccgacgcccgtaggaccgtagggtacctagggaaacgtagtggtacggtacgttagttttaacttacgtagtactaaacttaattaagttaataaactaacttaccttaaagtttaacgttacgggtaccgggtacgggtaaccgaaggggttaggaacggtaactaaccgaaacggtacgttaggtacgggtaccttaggaccgtaaccgtattacccgg

SEQ ID NO: 247932 - DNA, 500 bp, Homo sapiens
  misc_feature: GYAE6OF02FYDLT.16.73.G07.1.454.CMB.1.raw
  modified_base (229)..(229): a, c, t, g, unknown or other
  misc_feature (229)..(229): n is a, c, g, or t
  modified_base (359)..(359): a, c, t, g, unknown or other
  misc_feature (359)..(359): n is a, c, g, or t
  modified_base (471)..(471): a, c, t, g, unknown or other
  misc_feature (471)..(471): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttactgggcatctacccgggaatccggggtccctgaccgacttcgagtggcagcgggtcngggacagatttcactctcaccatcagcagctgcagctgaagatgtggctagtttatactgtcaatatattaataataatcctattttaattcgcggaggaccaaggtggaanatacaaacgatgtggctgacacctatccg

SEQ ID NO: 247933 - DNA, 515 bp, Homo sapiens
  misc_feature: GYAE6OF02FOFVK.16.73.G07.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
tcagtgtactactccacgaccggtgctcgatttagctctacgctcagggggctacaacaggcagccaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctcctaagctgctcatttacnggcatctaccgggaatcctggtccctgaccgnttcagtgcagcggtctgggacagtatttcactctcaccatcagcagcctgcnggctgaantgtgctagttttatactgtacaataataattaataataatcctaatttaacttcgggacgtaacgggacctaagggtggaagtaataccgaaacgtacttggtagcgtagacctactac

SEQ ID NO: 247934 - DNA, 561 bp, Homo sapiens
  misc_feature: GYAE6OF02H13PD.16.73.G07.1.454.CMB.1.raw
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
  modified_base (518)..(518): a, c, t, g, unknown or other
  misc_feature (518)..(518): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagagttgtttatataactccaacaataagagactacttagcttggtaccagcaacaaatcaggacngccctactaagctgctctatttacgngggcatacgtacccgggagtcccggggtcctagaccgtattcaggtggcaggcgggtctgggacagtatttcactctcaccatcagcacgcctgcgaggctagaagagttgnggtacttagtttatacgtagtaactaaataataatttaataacttaactcttaaatttaacgttcgggacggtacggaacgtagggtaggaanacgtaacaaacgtacgtggtacgcgttacgacctactagttcg

SEQ ID NO: 247935 - DNA, 575 bp, Homo sapiens
  misc_feature: GYAE6OF02GE8VV.16.73.G07.1.454.CMB.1.raw
  modified_base (525)..(525): a, c, t, g, unknown or other
  misc_feature (525)..(525): n is a, c, g, or t
tcagtgtactactccacgaccggtgctcgatttagctctacgctcaggggtccgggagatcatgagggtgtccttgagtctgggggaggcgtggtccagccttgggggtcgctgagactctcctgtgcagcctctggattcaccttcagtacctatgccatacactgggtccgccagcctccaggcaaggggctggagtgggtggctcttatatcatctgatggaggtactgaatactacgcagactccgtagagggccgattcaccatctccagagacaattcccagaacacactgtatctgacaaatgaacagcctgagaactgaggacacggctctatattactgtgcggaggacggggggccggtgggagcctccgtcccgacggggccagtcgaccgtccggtggggccgaggggacttccccgtggtcccgacccgtccttcccgtccacgccctccgaacccgaacgggccccagttcccggtccttcccccgcgcccgccctcgccctccgaggacnccgacctccgacgacgcacgacgcccggcccgtggcgttcgccgttacgg

SEQ ID NO: 247936 - DNA, 692 bp, Homo sapiens
  misc_feature: GYAE6OF02FQ3P9.16.73.G07.1.454.CMB.1.raw
  modified_base (309)..(309): a, c, t, g, unknown or other
  misc_feature (309)..(309): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttatataactaccaacaataagagctacttagcttggtaccagcacaaatcaggacacgcctacctaagctgctcatttacgngggcagtccgtaaccccgggaagtcccggggtcctcggaccgtattccgagtcggacacggtcgggtcgtcggggaacaggtacttttccgaaccttcctacctaacccatccaggccacgccctcgcggtacggcctaggaaaggtgtcgggtggtaccttaggttttactttacgtacgttaaccgaaacgttaattaacgtttaaattaaagttttaaaccttaccgttaaagttttttaaaccgggtttaaccggggtaccgggtaacggggggtaaaccccgtaaaggggtttacgggtaacggtaaacttaacccggtaaaaccggttaacgttacgggtacggtaccgtacggtaccctaacccgtagtttacccg

SEQ ID NO: 247937 - DNA, 635 bp, Homo sapiens
  misc_feature: GYAE6OF02GJ8JZ.16.73.G07.1.454.CMB.1.raw
  modified_base (233)..(233): a, c, t, g, unknown or other
  misc_feature (233)..(233): n is a, c, g, or t
  modified_base (321)..(321): a, c, t, g, unknown or other
  misc_feature (321)..(321): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatacaactgcaagtccagccagtagttgttttanataactccaaataataagagctacttagcttggtaccagcaacaaatcacggacacgtccctaccgtaagctgctacgtactttacgngggctagtccgtacccgggaacgtcccggggtcctacggaccgtatcgagtcggcacggtcgggtctggggacagtactttccgacgtctaccacctactaccagccgtacgccgtgaccgagggtcctaggaagtagtacgggtaggtacgttagtttacttacgtacgtaccgtaaacttaacttacttaattaaacttaacttaccttaaagttttaacgttccgggtacgggtacgggtaccgtaagggtcggtaagtacgtaacgtaaaccgtacggttggtacgggtactacgtacctacgtattccg

SEQ ID NO: 247938 - DNA, 649 bp, Homo sapiens
  misc_feature: GYAE6OF02H8RWW.16.73.G07.1.454.CMB.1.raw
  modified_base (318)..(318): a, c, t, g, unknown or other
  misc_feature (318)..(318): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccacatcaactgacaagtccagccagtagttgttttaatataacctccaacaataagagacttacttagtcttggtaccagacaacaaatcaggacagccctactaagctgctctatttacgnggctagtccgtaacccgggacgttcccggggtccctggacccgtattccgaggtcggcgacggtcggggtcgtggggaactaggtctttaccactttcctaccacctactccgacgcgtaccgtccgtgaccgaggtctaggaagtagtcggtagtaccgtttagtttacttacgtacgttaacaaacgttaattaagtttaaactaaactttaacttacctttaaagttttaacggtttaccgggacgggtaacgggtaaccgtaaggggtgtaacgtaacgtaaccgtaaacgtacgtaggtacggccttacggacctacctagttccg

SEQ ID NO: 247939 - DNA, 618 bp, Homo sapiens
  misc_feature: GYAE6OF02F0C1R.16.73.G07.1.454.CMB.1.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgaggaggccaccatcaactgcaagtccagccagagtgttttanataactccaacaataagagctacttagcttggaccagcacaaatcaggacagcctactaagctgctcatttacngggcatccgtacccgggaagtcccgggtccctgaaccgattcgagtcggcgaggcgggtcgtgggacaggtactttcgacctctacaccactcgagcacgtcctgacgacggctaggaagagtgtggtactagttttactacgttacgtaacaaactatttaaattaattaaattaaactttacccgttaaagtttttaacggtttaccggggaacgggtacgggtaaccgtaaaggggttaggaaacggttaactaaccggtaaaacgttaacggtacggtacggtaccgtacgaccctaaccgtagttacccg

SEQ ID NO: 247940 - DNA, 652 bp, Homo sapiens
  misc_feature: GYAE6OF02ITX5B.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatgacccagtctccagacctcccgtggctgtgtctcgtgggcgagacgggcccaccatcaactgacaacgtccagccaagtagttgttttaatactaactaccaaacaataagagtctacgttagtcttacggtaccagacaacaaatcgaggacagcctactaagctgctctattacgtggacacgtaccgtaccgggacgtcccggggtcctcggaccgtattcgaggtcggcgtaggcgggttcgtagggactagtactttccaccttcacctaccagtcagccgagtcccgtgacgaggtctagaagtcgttggtacgtacttaagtttactacgttacgtaactaaacgttaaattaactttaaataaacgtttaacttaaccgttaaagtttttaaccggttacgggaaccgggtacgggtaaccggtaagggtaggtaacgtaacgtaaccgaaacgttcggtacggttacggaccttggacctaccgttcttaccg

SEQ ID NO: 247941 - DNA, 527 bp, Homo sapiens
  misc_feature: GYAE6OF02GEVEH.16.73.G07.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaaacaataagagctacttagcttggtaccagcacaaatcaggacagcctcctaagctgctcatttacngggcatcgtacccggaatccggggtcctgaccgattcagtggcaggcggtctgggacagatttcactctcaccatcagcagcctgcgaggcctagaacgatggtggtctagtttattactgtacaactaattattaataataattacctaattttaagtttcggacggtagggacctaagggtggaagatacgaaacgaacgtggtggactggactacatcg

SEQ ID NO: 247942 - DNA, 508 bp, Homo sapiens
  misc_feature: GYAE6OF02JHDVJ.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctacctaagctgctcatttactgggcatctacccgggaatccgggtcctgaccgattcagtggcagcgggtctgggacagacttcactctcaccatcagcagcctgcaggctaggaacgatgtggacagttttactacgtgtacaactaatattataatactctaatttagttcgacgtaggaccaggtgagatacgaaacgtagtgtcggctgactaccattcg

SEQ ID NO: 247943 - DNA, 628 bp, Homo sapiens
  misc_feature: GYAE6OF02GCE2L.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataacctccaaacaataagagctacttagcttggtaccagcaacaaatcaggacacgcctacctaagctgcctactatttacgcgggtcatccgtacccgggtaacgtcccggggtcctaggaccgtattccgaggtcggcaggtcgggtcgtggggacagtactttccactcacaccatcagcacgcctgacgaggctagaagtcgtaggtcggtacttaaggtttacttaacgttcgtaactaaactaaatttaactttaaattaaactttaaccttaccctttaaagtttttaacgttaccggggtacgggtacggggtaaccgtaaggggtaggaacgtaacgtaaccgtaaacggtacgttggtacggtcgtacgtacctaccgtagttaccg

SEQ ID NO: 247944 - DNA, 792 bp, Homo sapiens
  misc_feature: GYAE6OF02HB7WU.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggcccacatcaactgacaagtccagccagagttgttttatatactaccaaacaataagagctattacgcttggtaccagcaacaaatcaggacagccctacgtaacgtctcgcttacactttacgtcgggactagtcccgtaacccggggtaaccgttccccgggggtaccctacggaacccgttacgttccgtaagggtaccgggtaccgtaaggggtcccggggttacggttaacgggggaacgtaaacgttaacgttttccgtaaccctttccgtaccctaacccgtaacgttacccgaacggtacccgtaaccgggttcccctagggtaccgaaaccgggtaccgttaaagggaaacggttacgttacgggttacggggtaactttaacgggttttttaaacttacgggttactttaaacgaaaacctttaaattaaacttttaaagttaaaaccgttaattaacccgtttaaaatttttaaccgggtacgggtaacggggtaaccgggaacgttaaacggggtaggtaactaacccgttaacgaaaacggtacgttcgggtacggtaccttacggtacccacgttacgttaccg

SEQ ID NO: 247945 - DNA, 634 bp, Homo sapiens
  misc_feature: GYAE6OF02ITY9E.16.73.G07.1.454.CMB.1.raw
  modified_base (112)..(112): a, c, t, g, unknown or other
  misc_feature (112)..(112): n is a, c, g, or t
  modified_base (175)..(175): a, c, t, g, unknown or other
  misc_feature (175)..(175): n is a, c, g, or t
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (576)..(576): a, c, t, g, unknown or other
  misc_feature (576)..(576): n is a, c, g, or t
tcagtgtactactccacgaccggtgctcgatttagctctacgctcaggggtccgggagatcatgagggtgtccttgagtctggggggaggcgtggtccagcctggggggtcnctgagactctcctgtgcagcctctggattcaccttcagtacctatgccatacacgtgggtccnccagcctcaggcaaggggctggagtgggtgctnttatatcatctgatggagtactgaatctacgnagactcgngaggcgatcaccatcncagagactaatccagaacacatgtatctagacaaatgaacacgcctagaagaactgacggaccacggctactaattacttacgtgtgacggaaggggacgggggggtccggtaggggactcccgttcccgaccgggaccggggaccctacgtacggtaccgttccggtcgggggaccgacgggtacgtccccgtcgggtccctaccgttcctcccgtacaccgtccctacccgaaccgacgggtcccctacgttcccggttccccgttccccgtccggtcccgtccccgttcgcctaccggacgacgacccnccgttaccgacgtacgaccgacgacggcccgcccggtcggaccgttccgccgtacggg

SEQ ID NO: 247946 - DNA, 603 bp, Homo sapiens
  misc_feature: GYAE6OF02GMCGY.16.73.G07.1.454.CMB.1.raw
  modified_base (369)..(369): a, c, t, g, unknown or other
  misc_feature (369)..(369): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatataactccaaacaataagagctacttagcttggtaccagcacaaatcaggacagccctacctaagctgctactatttacgtgggcatccgtacccgggaagtcccggggtcctgaccgtattcgagtggcaggcgggtntgggacagtatttcacgtctaccaccatcagtcacgcctagcaggctagaagtcgtgtggcgttaagtttacttacgtagtacaaacgtaattaatttaattaaattaaaccgttaccttaaagttttaagtttaccgggacgggtacggtaccggtaaggggtacggaagtaacgtaaccgtaaaacggtacgttaggtacggtaccgtacgtacctaccgtagtttacccgg

SEQ ID NO: 247947 - DNA, 644 bp, Homo sapiens
  misc_feature: GYAE6OF02FTBM6.16.73.G07.1.454.CMB.1.raw
  modified_base (228)..(228): a, c, t, g, unknown or other
  misc_feature (228)..(228): n is a, c, g, or t
  modified_base (317)..(317): a, c, t, g, unknown or other
  misc_feature (317)..(317): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttanactaactccaaacaataagagctaacttagcttaggtaacccagacaacaaatcgaaggacagccctacctaagctgctctatttacgngggctatccgtacccgggaagtcccggggtcctggaccattcgagtcggcaggtcgggtacgngggactagtattcnctccgtcaccatcngacagcctgcgaggacagaagtgtggtggtctaagttttactacgttacgtacgtaaacttaagttaactttaaagttaaacttaacgttaaccgttaagttttttaaaccgggttaccgggtaacgggtaacgggtaaccgttaacggggtaacggtaacggttaaactaaccggtaaaaccggttacggttacgggtacggtaccgtacggtaacctacccgtagtttacccgg

SEQ ID NO: 247948 - DNA, 833 bp, Homo sapiens
  misc_feature: GYAE6OF02IK8BS.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctcagactccctggctgtgtctcgtcggggacgaggaggggcccaacgtatacaactgacaacgtccaagccagtaagttgttttaataataacctaccaaacaaagttaaagagtaccttaacttagtacgttacggtaccaggaccaaactaaatcgaaggacctacgcccttaacctaacggctgtccttactagttttaccggtcgggaccttacgtaccgttaaaccccgggggtagttccccgggggtaccctaggtacccctaagttaccgtaagggtcgggaccgtacggggtccgggggtaccggttagggggtaaccaaggtttaaccttttcccccgaaacggtttccccgtaacctaaacccgtattacccggaaggtaccctacggggcccttaagggaccgagggtacgtaggaacggttatcggggtaactacggtttaagtttacttacgtaagaaccgttaaacttaaatttaagttaaagtttaaaccttaaagttccgtttttaaaacgtttacggtttacccggggggacgggaaacccggggttaagtaacggggttaaacgggtacttaaacgttaacccgggtaaaaacggttacggtttacggcccggggttaacttacggtaacccttacccccgggttatttaacccggg

SEQ ID NO: 247949 - DNA, 556 bp, Homo sapiens
  misc_feature: GYAE6OF02GNBGZ.16.73.G07.1.454.CMB.1.raw
  modified_base (307)..(307): a, c, t, g, unknown or other
  misc_feature (307)..(307): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgtttatataactccaaacaataagagctacttagcttggtaccagcacaaatcaggacacgcctcctaagctgctcatttacngggcatcgtacccgggaatcccggggtcctgaccgtattcgagtcggacgaggcgggtcgtacggggactagtactttcacttcgtacacatcagcagcctgcgaggctacgaagtacgtgtcggtactagtttacttacgtgtacaactaataattaataatatacttatttaagttcggacggtacggactagggtggaagtactaacgaaacgtacgtaggtcgtacgtacgacctacagttaccg

SEQ ID NO: 247950 - DNA, 733 bp, Homo sapiens
  misc_feature: GYAE6OF02IJZ25.16.73.G07.1.454.CMB.1.raw
tcagtgtactactccacgaccggtgctcgatttagctctacgctcaggggcgtacaacaggcaggcagggcagcaagatggtgttgcagacccaggtcttcatttctctgttgctctggatctctggtgcctacggggacagtcgtggatgacccagtcctcagactcctggctgtgtctctgggacgagagggcctacataccaactgacaaggtccaagccaaggagttgtttttaactattaacctacgaaacctaataaagtacgctaacgtttacgagttcggttaaccaaggacaaccgaaaatcgaggaaccacgtccctaacccttaagtctcggaccttactacttttacgttacggggactaacgtaccgttaaccccggggtaaagttcccgggggtaccccttgggaaccccgttattacacgggttggaccctaagggtcgggccgttacggggactacggtaactttccaacgtttcctacgacctaactacgaaacgtcgaacgcccttgaccggtcggtacgtacggtaaagtaacgtggtacggtacgttacggtttaacttaacggttcgaactaaacctaactttaaagttacttaaacttaactaccgtttaaatttaaacgtttcggaacgggtacggaacccggttaggaacggtacgaactaagtaaaccgtaacgttggttaaccggcgttaccgacgtactattaccg

SEQ ID NO: 247951 - DNA, 733 bp, Homo sapiens
  misc_feature: GYAE6OF02H2A0U.16.73.G07.1.454.CMB.1.raw
  modified_base (259)..(259): a, c, t, g, unknown or other
  misc_feature (259)..(259): n is a, c, g, or t
  modified_base (370)..(370): a, c, t, g, unknown or other
  misc_feature (370)..(370): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctctgggcgaggacgggcccaccatccaactgacaagtccagccagagttgttttaatataacctaccaaacaataaganactacttagcttggtaccagcaacaactcgacggacacgcctactaagtctgcctactactttacgtggactacgtcgtacccgggacgttcccggggtcctaggaccgtnttcgaggttcggcgtaggccggggttcgtacgggacgtaagtacgttttacacgttcctaccaccgtactacgagtacccgacgtccgtagacgacgggtacgtagaaacggttagttcgggtaggttaacctttaacgttttaactaccgtttacgtaaaccgtaaaaagttaactttaagtttaaactaaagtttaaaccctttaaccgtttaaaggttttttaaacccggttacggggaaccggggttaacggtaacccgggttaagggttaggaaaccggttaacgttaaaccgtaaaacccggtttaggtaccgggttcggttaccctaaggttaacccccgacgtttaattacccgg

SEQ ID NO: 247952 - DNA, 671 bp, Homo sapiens
  misc_feature: GYAE6OF02I4QLT.16.73.G07.1.454.CMB.1.raw
  modified_base (652)..(652): a, c, t, g, unknown or other
  misc_feature (652)..(652): n is a, c, g, or t
tcagtgtactactccacgaccggtgctcgatttagctctacgctcagggggctacaacaggcaggcaggggcagcaagatggtgttgcagacccaggtcttcatttctctaaaaaaaaaaaaaaaaaaaaagttgctctggatctctggtgcctacggggacatcgtgatgacccagtctccagactccctggctgtgtctctgggcgagagggccaccatcaactgacaagtccagccagagtgttttatataactaccaaacaataaagagctaacttagcttaggtaacccagctaacaaatcaaggacagccctacctaaagcctgcctactaagttttaacgtcgggctaatacccgtaacccggggtaaatccccggggttccctacggaccgtaacttacgagtcggcgaggtcggggtcctaggggacaagtactttaccgaacttctaccaacctatacagacacgccctgacgacgcctaagaagtatggtaggctaagttttactacgtgttaaccaaactaagtttaacttaagtaaaacttaacgtttaccttaaagttttaagtttacccggggaggtaacgggtaaccgaagggttacggaaggtaactaaacgtaaaccgtaagtggtacgtaccnggtaacctaccgtattacg

SEQ ID NO: 247953 - DNA, 580 bp, Homo sapiens
  misc_feature: GYAE6OF02GQC4L.16.73.G07.1.454.CMB.1.raw
  modified_base (228)..(228): a, c, t, g, unknown or other
  misc_feature (228)..(228): n is a, c, g, or t
tcagtgtactactccacgaccggtgctcgatttagctctacgctcagggggctacaacaggcaggcagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaacaataagagctacttagcttggtaccagcacaaatcaggacagcctacctaagctgctcatttactgggcactcgtacccgggaatcccggggtcctcgaccgattcagtcggctaggcggtctgggactagactttcgaccttcgtcaccgatcgagcagcctgcgtaggcctaggaagtagtcgtggcgttagtttattacgtagtacgaaactaattattaattaattaaattaccttaattttaaacgtttcggacggtacgggtaaccgtaagggtcggaagtacgtaaccgtaaaacgtacgttaggtcggtacgtacggacctaccgtagttccg

SEQ ID NO: 247954 - DNA, 783 bp, Homo sapiens
  misc_feature: GYAE6OF02GXDBB.16.73.G07.1.454.CMB.1.raw
  modified_base (341)..(341): a, c, t, g, unknown or other
  misc_feature (341)..(341): n is a, c, g, or t
  modified_base (404)..(404): a, c, t, g, unknown or other
  misc_feature (404)..(404): n is a, c, g, or t
tcagtgtactactccacgaccggtgctcgatttagctctacgctcagggggctacaacaggcaggcaggggcagcaagatggtgttgcagacccaggtcttcatttctctgttgctctggatctcgtggtgccgtacggggacagtcgtgatcgacccagtcctccgagacctcccgtggctgtcgtctcgtgggcgaggacgggacccaccataccaacgtgacctaacgtcccaacgccgaagtagtttagttttaactaacttaaaccctacccaaaactaaaaagttaaacggacgtaccttaaccttaggaccttacggtaacccagaccctaaanaaaactcgaaaggtaaccaacgtccctaaccgtaaggcctacgtacctactaagtttaccggngggactaacgttacccggaaaccccgggttacggtccccgggtcctacggaacccgttactaccggaggtaccggacggacgggtccgggtacggtacgggtaacctggtttaactttacccgtaccttacccgtaccaaccctagtaacccgagtaccctaccggtaccgtgaacgggacgttacgaacgtagttacggttggtacgttacgttaagtttaccgtacgtactaaacgtaaattaaattaacttaaataacttaaactacgttttaaacgttagggaccggggtaacgtacggaacggaagggtacgaaactaaaccgtaaacgtaaacggtgttagggtctaaccgtacgtactaacccgtgttaccg

SEQ ID NO: 247955 - DNA, 600 bp, Homo sapiens
  misc_feature: GYAE6OF02F4LJG.16.73.G07.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaaacaataagagctacttagcttggtaccagcacaaatcaggacagcctcctaagctgctcatttacngggcatcgtaccggaatccggggtcctgaccgattcagtggcagcgggtcngggacaggatttacgactctcacctactcagcagcctgacgaggcgtgaagatgtggtacctagttttacttacgttagtacaaactaattaacttaaataaattaaacttacctaaagtttttaaacgttaacgggtaccggtaaggggtaacccgtaagggttacgggaaaggtaacttaaaccggaaaacgttaaaccgttaggtaccggggtactacgggtaccctaaccgatttaccgg

SEQ ID NO: 247956 - DNA, 585 bp, Homo sapiens
  misc_feature: GYAE6OF02F18NY.16.73.G07.1.454.CMB.1.raw
  modified_base (232)..(232): a, c, t, g, unknown or other
  misc_feature (232)..(232): n is a, c, g, or t
  modified_base (576)..(576): a, c, t, g, unknown or other
  misc_feature (576)..(576): n is a, c, g, or t
tcagtgtactactccacgaccggtgctcgatttagctctacgctcagggggctacaacaggcaggcaggggcagcaagatggtgttgcagaccccaggtcttcatttctctgttgctctggatctctggtgcctacggggacatcgtgatgacccagtctccagacctccctggctgtgtctctgggcgagagggccaccatcaactgcaagtccagccagagttgttttanataactccaacaataagagctacttagcttggtaccagcacaaatcaggacagcctcctaagctgctcatttactgggcatctacccgggaatcccggggtccctgaccgattcagtggcagcgggtctgggacagatttcactctacgaccatcagcgagccctgcaggctagaagtagtgtggactagtttatttacgtgtacaactaattaatttaataaattaaacttacctaatttttaaacgttcgggtacggacggggtaaccgtaacggggttagggtaagtaacgtaaccgaaaacggtaacgtaggttacgggtaccttaggacctaacccgtntttaacccg

SEQ ID NO: 247957 - DNA, 690 bp, Homo sapiens
  misc_feature: GYAE6OF02FVKZB.16.73.G07.1.454.CMB.1.raw
  modified_base (229)..(229): a, c, t, g, unknown or other
  misc_feature (229)..(229): n is a, c, g, or t
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaaacaataaagagctacttagcttggtaccagcanaaatcaggacagcctctaagctgctacatttcngggcatccgtaacccggagtcctgggtccctgaccgtattcgagtcgcgaaggccgggtntcgggacagtatttccactctacaccatcagactacgcctacggacgacggacttaggaagaacggttggtcgggtacgtacgtttttaagttaaccgttaggttaacgaaaacctttaaattaaacgttttaaaattaaaacttaaaacttacccgtttaaaagtttttaaaggtttcccggggttaacggggtaaaacggggttaacccggttaaaaggggttacgggttaaaggtaaacgtaaaccggttaaaaacccggtaaccggtttaacgggtttaccggggtacgtttaacccgggtacctaaaccccgggttaacc

SEQ ID NO: 247958 - DNA, 773 bp, Homo sapiens
  misc_feature: GYAE6OF02HAGPC.16.73.G07.1.454.CMB.1.raw
  modified_base (233)..(233): a, c, t, g, unknown or other
  misc_feature (233)..(233): n is a, c, g, or t
  modified_base (326)..(326): a, c, t, g, unknown or other
  misc_feature (326)..(326): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgttttaanataaacctccaaacaaataagagtacctacttagctttggtaaccagcaacaaatcgaggacacgcctacctaagctcgctactattttacgngggtacctagttaccgtaaccccggggtaacgttcccgggggtcccctacggaacccgtacttaccgagggttcggacgtacgggtccgggtcgttacggggaccgtaaggtaacttttaccgaccgtaccttaccgaaccctaacttcgaaaccggtcgtaaacggtcccttagggcccgtaacgggtacgtaacggaaagttacgtacgggtttacggtaccgtttaacggtttttaacgtttaaccgttacggttaaacctaaaacgtttaaagtttaacgtttaaattaaacgtttaaactttacccgtttaaagtttttaacgttaccggggtaacgggtaacggggtaaccggtaaaggggttacggtaaaggtaaccgttaaccgtaaaacggtaaccgttagggttaccgacttacggaactaccccgtagtttacccg

SEQ ID NO: 247959 - DNA, 728 bp, Homo sapiens
  misc_feature: GYAE6OF02F9502.16.73.G07.1.454.CMB.1.raw
  modified_base (183)..(183): a, c, t, g, unknown or other
  misc_feature (183)..(183): n is a, c, g, or t
  modified_base (248)..(248): a, c, t, g, unknown or other
  misc_feature (248)..(248): n is a, c, g, or t
tcagtgtactactccacgaccggtgctcgatttagctctacgctcagggggctacaacaggcaggcaggggcagcaagatggtgttgcagacccaggtcttcatttctctgttgcttctggatctctggtgccgtacggggactagtcgtgatcgaccctagtcctccagcctccctgctgtntctcgtagggcgaggacggcccactactactaactgaccaagtcccagccagtagttgttttaanactaacctaccgaaactaaagtaagacgtacttaacgtagtaccgttacggtaaccacgacaaacgtaactacggaaccggtaacgaccgtacccttaaccgtacgtaaccgtcgtacccttacgtaacttttaccgggcggaacctttaacggttaccccggtaaccccgggggttaacccgttcccggggtaccctacggtaacccgttaatccgtaagggttcggaccggtacgggtaccggtcgtacgggtaacgacgttacttacctaccgttaccgccactacgtacgagtacccaccggtccgtaggactaacggactacggaagtacgttcggtaagtaacgttacgtttactacgtacgtaacaaattataagttaataactttacgtaactttagtttacgacgggtacggtagaccgtagggtacgagtaactaacgaagtgacgtagtacctacgtactactattccg

SEQ ID NO: 247960 - DNA, 692 bp, Homo sapiens
  misc_feature: GYAE6OF02H8VN1.16.73.G07.1.454.CMB.1.raw
  modified_base (378)..(378): a, c, t, g, unknown or other
  misc_feature (378)..(378): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctaccagactccctggctgtgtctcgtggcgagagggccaccagtcaactgcaagtccagccagagttgtttaaataactcaacaataagagacttattagcttaggtaccagacaacaaatccaaggtacagccctactaagtctgactctaatttacgcgggtacctaagtacccggtaacccggaatcccgtacggggtaccctagacccgttatacnggtacgaccgtggaccgggttccagggaaatccgggttatttccaaccgttccttaccaaccgttacgacaacgaccgtacggtccgtaggaccgacggtactacgggtaaattacgtacggttaccggattaacggttttaaacgtttacccgtagtaaaccggtaactaaagtttaattaataaaacttaacgttacgttaaacttttaacgggtaccgggtaacggaacgggtaacccggtaaaggttcgggaaacgtaacgttaaccaaacggttgtaccggtaacggtacctacgaccgtacgttaacc

SEQ ID NO: 247961 - DNA, 757 bp, Homo sapiens
  misc_feature: GYAE6OF02IJEPL.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatcgacccagtctccagactccctggctgtgtctcgtgggcgagacggccaccatcaactgactaagtccagccagtagttcgtttaataactaactccaaactaaataagagtacttaacgttagtcttacggaacctagaccaaactaaacgtacgaaggacctacgcccttacctaagcgttacgccttacttaagtttaccgtcgggtacctacttaccccggtaaccccggggtaacgttccccgggggttcccacggtaacccgtagttccgaggtcggacggtacggtcgggtcgtaggggactaggtactttccacttccgtacaaccgtatacgtcgacgaacggtcctacggtcgaacgggtacgtaacggtaaacggtaggttcggtacgggttacttaacgttttacgtaaccgttagtaaacctaaacgttaaagttaactttaaagttaaacctttaacgttaaccgtttaaacgtttttaacgtaccgggggtaaaggtaccgggtaaccgtaaggggtacggttaaacgacgttaaaaccggtaaaccggttacgtcggttacggtaccgtacggacccttacgtacgttcccg

SEQ ID NO: 247962 - DNA, 703 bp, Homo sapiens
  misc_feature: GYAE6OF02G1U9E.16.73.G07.1.454.CMB.1.raw
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcggtgatacgaccctagtctccagacctcccgtggtctgtgtctcgtgggcgaggacggccaccataccaactcgactaacgtccacgaccagtacgttagttttaatactaacctaccaaactaaataaagacgacttaacgttagtcgttacggtaaccagaccaaacaaanacgacggacacgtcctactaacgctgtctatacgtttacgnggctactaccggtacccgggtacgtccgggtccgtacgtacgtacttcgaggtcgacgacggtcgggtcgtacggacgtagtacttacctcgtaccctaccactacgtcgaacgccgtacgtccgcgtacggagtaccgttacgaacggtgttacgggtacgttacctttaagttttactacgtagtaaaccttaactaactttaaattaacttaattactttaacgtttaagttttaacgggtaccggtacgggacggtaacggtaaggtacggaattaaaccggaaaccgtaacggttacgtacggttccggacctacgggtaccctaccggttacgttccg

SEQ ID NO: 247963 - DNA, 758 bp, Homo sapiens
  misc_feature: GYAE6OF02ILO4F.16.73.G07.1.454.CMB.1.raw
  modified_base (179)..(179): a, c, t, g, unknown or other
  misc_feature (179)..(179): n is a, c, g, or t
  modified_base (368)..(368): a, c, t, g, unknown or other
  misc_feature (368)..(368): n is a, c, g, or t
tcagtgtactactccacgaccggtgctcgatttagctctacgctcaggggtccgggagatcatgagggtgtccttgagtcgtgggggaggcgtggtccagcctgggggggtcgctgagactctcctgtgcagcctctaggattcaccttcagtacctatcgccatacacgtgggtcccncagccctccgaggcgaaggggctgggaggttgggtgcttcttatactcatctggatgggagttactagaacttacgtacgcaggacctccggtagaagggccgattcaaccatctccaagacgacaacttcccgaagaaccacactgttactctagacaaatacgaacagcctgaacgaagtgaggacncgacgtactatattactgtcggacggagggacggggggccggtaggggcgtaccgtccgtaccggaccggggcctaacggtcgaccgttccgggacggggtaccggacgggtcgtacccggttcgggttacccgtacccggtttcctacccgtccgacccgtaccccgtaacccgtaacccggaacccggggtacccctaaccgggtttccccgggttaccccgtttacccccggttccggaccccggttccccgtcccggtcccgttaacccgaccgggtaaccggtcccggtaaccccgttacccgggaacggtacccgaccggaacccgtaccggggccccggtaccccgggttccgggcccggttccggtacccggttaaccgggg

SEQ ID NO: 247964 - DNA, 844 bp, Homo sapiens
  misc_feature: GYAE6OF02GJ5YA.16.73.G07.1.454.CMB.1.raw
  modified_base (332)..(332): a, c, t, g, unknown or other
  misc_feature (332)..(332): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaacgtccagccagtagttagttttataactaacctaccaaacaaataagagtactacttagcttaggtaccagcaacaatcgaggacacgccctaccgtaagctcgcctatacgtttacgngggactacgttccgtaaccccgggtaacgttcccggggtacctacggacccgtagttaccgagggttcggaccgtacggggtccgggttacggtacggggtaacgtacggttaaacttttccgaaccctttaccgtaaccctaacccgtaacgtacccgtaacggtaccgtaccggtcccggttacgggaccgtaacggggtacgttaaacgggaacggttacggttacggggttcgggtaaccgttttaacggtttttaacctttaccggttaacggtaaaccgttaaacttaaacgtttttaacgttttaaattaaaacgtttaaccttttaaaccgttttaaaacgtttttaaacgggtttacccgggggaacccggggttaacgggggttaacccggttaaagggggttaggtaaaccgggttaaacgtaaaccggttaaaacccgggttacgtttacggggtacggttaccggttaccgggtacccttacccggtaagtttccccgg

SEQ ID NO: 247965 - DNA, 682 bp, Homo sapiens
  misc_feature: GYAE6OF02HZXUU.16.73.G07.1.454.CMB.1.raw
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (462)..(462): a, c, t, g, unknown or other
  misc_feature (462)..(462): n is a, c, g, or t
  modified_base (618)..(618): a, c, t, g, unknown or other
  misc_feature (618)..(618): n is a, c, g, or t
tcagtgtactactccacgaccggtgctcgatttagctctacgctcgagggggctacgaacaggcaggcaggggcagcaagatcggtgttgcagacccaggttcttcatttctctgttgctctggatctctggtgcctaacggggacagtcgtgatcgacccagtcctccagcctccctggctggtcgtctcgtgggcgaggacggccacatcaactgacaacgtccagccaggtagttagtttaanataccgtacaaanaatagngtctacgttagccgttaggtaccagaccaacgtaaatccgaaggcaacggtcccttacgaacgcgtcgctactactttaccggcgggctacgttacccggtaacccgggaagttccccggggtacctacggtaaccctgttacgaggtcgacgacggtcggtcgtagggactacggtcgtttccacgtctaccaacngtccgaagtccgtaggtccttgacgtgtacgtagaagtgtggtacgtactttaagtttacctacgttcgaaactaacgtaaattttagtaaactaacgttacgttaccgtttaaagttttaccggttaccgggaaggggtacgtaccggtaagggnggtaacctaagttaaccggaaacgttgttcgggtactccgttaacgacctaccggtattaccgg

SEQ ID NO: 247966 - DNA, 625 bp, Homo sapiens
  misc_feature: GYAE6OF02IOXE9.16.73.G07.1.454.CMB.1.raw
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (410)..(410): a, c, t, g, unknown or other
  misc_feature (410)..(410): n is a, c, g, or t
  modified_base (616)..(616): a, c, t, g, unknown or other
  misc_feature (616)..(616): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggcccaccatcaactgacaagtccagccagtagtgttttatataacctccaaacaataagagtctacttagcttcggtaccagacaacaaatcaggacagccctacctaagctgcctctatttacgnggctatccgtacccgggaactccggggtccctggacccgtnttcaggtcggcgaggcgggtctgggactagctttcactctcgacatcagcncgcctgacgaggtctagaagtgttcggtcgtacgttaagtttactacgttagtaactaaactagtttaattaattaacttaacttacctttaaagttttaacggtttccgggaacggggtacgggtaaccgttaaggggtacggtaacgttaacggtaacgtaaaccgtaagttcggtacggtaccgttacgtacccttaaccgtntttacccgg

SEQ ID NO: 247967 - DNA, 595 bp, Homo sapiens
  misc_feature: GYAE6OF02F0QMO.16.73.G07.1.454.CMB.1.raw
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttatataactccaacaataagagctacttagcttggtaccagcacaatcaggacagcctacctaagctagctcatttacgtggcatctacccgggaatccggggtcctgaccgntcagngngagcgggtntgggangtatttcactctcacatcagcacgctcgactagggcctggaacgtagtgtcggctaagttttacttactggttaacaaactaattactttaaattaacgttaaattaccttaaattttaaacggtttcgggaacgggtaggtaaacccggtaagggttgggaaacgtcgtaaacgtaaaaccggttaaccgtgggttaccggtacgttccggtaccgtacctaacgtttccgg

SEQ ID NO: 247968 - DNA, 890 bp, Homo sapiens
  misc_feature: GYAE6OF02I3HSP.16.73.G07.1.454.CMB.1.raw
  modified_base (766)..(766): a, c, t, g, unknown or other
  misc_feature (766)..(766): n is a, c, g, or t
  modified_base (862)..(862): a, c, t, g, unknown or other
  misc_feature (862)..(862): n is a, c, g, or t
  modified_base (881)..(881): a, c, t, g, unknown or other
  misc_feature (881)..(881): n is a, c, g, or t
tcagtgtactactccacgaccggtgctcgatttagctctacgctcgaggggggctacaacaggcaggcaggggcagcaagatggtgtgcagacccagggtcttcatttctctgttgctcgtggatctcgtggtcgacccggtacgggggactacgttcggtagtagttcggaccctaggtcctaccagtaccctcccgtgggcttgtcgttcgtcggtggggcggaaggtaccgggcccaaccaacgtacctaaaccgttaggaccgtaacggtaccgacggtacccgaagggttaggttttactttttaaacgtaaaccttaaacccgtaccgtaaaaacgtaaaacggttaacggtaccgtttaaccttaaaaccggtttcggtaccgttttaccgggaaaccccgtaacgaactaaaccggtaaaactaccggaaaacggaaccctacgtaccccgtttaaccggaaacgttccgttaccgtaccttaacgttaccgttttaacgggtacgggtaacctaacgtttacccccgggggtaaccggttaaacccggggtcccccgggggttaaccctaaccggtaacccggttacgtaccggtacggtacgggacccggtagggttccggggtaacggtaacggtagttaaccgttacccgttaccgtaacttcccgtactaacgttacgtaaccggagtaccccgtaacgcgttacgacgggtacgtcggtaaggtaaacgccgggtttgtccggttaacgttntttaaccgtcgacgtaactaactaatttactaagttaactacgttacttaacggtaggttaccggacgttagacgttaggaacgttacaggtaaanaccggttagtgacgcctanactcagttc

SEQ ID NO: 247969 - DNA, 876 bp, Homo sapiens
  misc_feature: GYAE6OF02FYCJV.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgaccaagtccagccagtagttagttttatactaacctaccaaacaaataagagtaccttaacgttagtccgtttacgggtaaccctaaggaccaaaccgtaaaacttccgaaacggggaacctaaccggacccccgtttaacccgtaaaacggccgttacggtcccctttaacctttaaacgtttttaccgggtacgggtaacccttaaccgtttaacccccggggttaaaccccggggtaaccgggggtttccccgggtacccccgtaacggttacccggttacgttaaccggtagggtccgggtaccgtacgggggtcccggggttacggttaacgggaaccgttaacggttttaccgttacccgacctttacccgacccctaaccgtacctacgaaccggtcgtacccgtaccgtccgggacgtaccgggtacgtaaggtaacggttggttacggttcggttaacctttaagttttctaacggttcgaaaactaaacttaagtttaacttttaaacgtaacttaaccgttttaactttaacggttttaacgggtacgggtaaccggggtaacgtaacggggtacgggttaacggaacgttaaaccggttaaaccggtaaaccggttaggttcgtacggtaccacgtacgttaactcggtttaccg

SEQ ID NO: 247970 - DNA, 985 bp, Homo sapiens
  misc_feature: GYAE6OF02I836T.16.73.G07.1.454.CMB.1.raw
  modified_base (235)..(235): a, c, t, g, unknown or other
  misc_feature (235)..(235): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagacggccacatacaactgcaacgtccagccagtagttgtttaanactaacctaccaacaagtaagagacttaacttagcgtttacggaacctacgacaacaaatacgaagggaccacgccctacccgtaagtctcgtcctactaacgttttaccggacgggtacctaacgttacccggtaaaccccgggggtaaccggttcccccgggggttaccctaccgggtaaacccgttacgttaccggtaacgggtcgggtaaccggtacggggtaccgggggtttacccggtaacggggggtactaaaccgggtttaaccggttttacccctaaaccccgttttcgttacccccgtaacccgttaacgttacccggttaaccggacccgggttaacccggtcccggttaccgggtaaccggtaaccggggtttacccttaaaacgggtaaacgggttacggtttcgggttaaccggtttaaccggttttaaacgttttttaaccggtttaaccggttaaccgtttaaacccgtaaaacggttttaaacgttttaaacctttttaaaattaaaccggttttaacctttaaacccgggtttttaaacgttttttaacccggggtttacccggggggtaaaccggggtaaccggggttaaacccgggtaacgggttttaaccggggggaaaacgtttaacccggttaaaacccgggttaaaaaccggtttcgggtttaaaccgggtttcggggtaaacccgttttcgggaaacccccgtaccgtttacggtttaaccccgg

SEQ ID NO: 247971 - DNA, 660 bp, Homo sapiens
  misc_feature: GYAE6OF02FO7P6.16.73.G07.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanataactccaanaataagngtctacttagcttggtaaccagacaacaaatcaggacagcctcctaagctagctactatttacgcgggcattcgacccgggaatccggggtccctgaccgtattcgagtcggcaggcggtntagggacagtactttcactcncacctactcagtcacgtccgtgcgtacgggccttaggaacgtagtggttacggtaccgttaagtttttacgttacgttcgtaacctaaaacttaagtttaaatttaacgttaaatttaaaccgttaaccttaaacgtttttttaaacggttccggggtaaccggggttacgggtaacccgtaagggggttagggtaaacctaacggttaacccgtaaaacggtaaccggttaggttacgggtacgttccggaccgtaaccgtagttaccgg

SEQ ID NO: 247972 - DNA, 869 bp, Homo sapiens
  misc_feature: GYAE6OF02GHKU9.16.73.G07.1.454.CMB.1.raw
tcagtgtactactccacgaccggtgctcgatttagctctacgctcagggggctacaacgaggcaggcaggggcagcaagatggtgttgcagacccaggtcttcatttctctgttgctctggactctctcggtgcctacggggaccatcggtgagtcgaccctagtctccacgtacctcccgtggactgtcgttcctcggtaggggacgacggacgggacccaccgataccgaacgttcgacctaacgtccagaccctaaggtacgtttagttttaataactaacctacaaacgtaataaggactacctaagttacgtccgttacgaaccgtagaccaacgtaacgtacgtaacggaactaccggtaccctacgttaagcgtcgtacctacgttaacgtttacgaccggtactaccgtacccggtaacccggtacttcccgggttaccggtacctacggtacccgtagtttaccgacggttacggacgtacgggtcccggttacggtaacggggtaactacggttttacgttcccgtaaccgtaccgtacccgtaaccggtactaccgggtacgtacccggttaacggtccgttacgggaaccggtaacggtcccgtaaaggtaaccgttacggttaccgggttacggttaacgtttacgtttttaacggttaccgtacggttaaccggtaaacttaacgttttaaacgtttaaattaaaccgttaaccgttttaacgttaaaaccgttttacgggttaaccgggacggggttaaccggtaacggtaaccggtaaggttaacccggtaaacgttaacggtaaaccgtacgggttcggttaaccgtccgtaaccccgagtaacccgttacg

SEQ ID NO: 247973 - DNA, 637 bp, Homo sapiens
  misc_feature: GYAE6OF02JBQEH.16.73.G07.1.454.CMB.1.raw
  modified_base (226)..(226): a, c, t, g, unknown or other
  misc_feature (226)..(226): n is a, c, g, or t
  modified_base (417)..(417): a, c, t, g, unknown or other
  misc_feature (417)..(417): n is a, c, g, or t
  modified_base (479)..(479): a, c, t, g, unknown or other
  misc_feature (479)..(479): n is a, c, g, or t
  modified_base (555)..(555): a, c, t, g, unknown or other
  misc_feature (555)..(555): n is a, c, g, or t
  modified_base (565)..(565): a, c, t, g, unknown or other
  misc_feature (565)..(565): n is a, c, g, or t
  modified_base (590)..(590): a, c, t, g, unknown or other
  misc_feature (590)..(590): n is a, c, g, or t
  modified_base (614)..(614): a, c, t, g, unknown or other
  misc_feature (614)..(614): n is a, c, g, or t
tcagtgtactactccacgaccggtgctcgatttagctctacgctcaggggtccgggagatcatgagggtgtccttgagtcgtggggaggccgtggtccagccgtgggggtcgctgagactctcctgtgcacgcctctggattctaccttcacgtacctatgccatacactcggtccgccagcctccgaggcgaagggcgtggagtgggtggctcatttttttttanctatcgtgaagtggtaggtacgtagtaataccttacgacgagaccgtccgtaggaaggccggacttacacacttctccgagaacgactaacttacccaagaacaccgactgtaacgtctacgacgtaactacaacgacgaccgtagaacgacgtacgagacgacgtacgtactatacgtatgtgagtaggnggggcggtaggcgtcctccgccggaaggcgtttacagaccgtcggtacggccgacgtcgtcncgtcgaccgtccttacgcctagccctacccggaaacgtccgctacccgtcccgttccctcccgttcgcccgttccnccgggttaanccggaccgtcgaccctacggaaccngtaacgccgagcccgttccgtccncgggtttccgactcgtacccggg

SEQ ID NO: 247974 - DNA, 758 bp, Homo sapiens
  misc_feature: GYAE6OF02JGB3J.16.73.G07.1.454.CMB.1.raw
  modified_base (262)..(262): a, c, t, g, unknown or other
  misc_feature (262)..(262): n is a, c, g, or t
tcagtgtactactccacgaccggtgctcgatttagctctacgctcagggggctacaacaggcaggcaggggcagcaagatgggtgttgcagacccaggtcttcatttctctgttgctctggatctctggtgcctacggggacatcgtgatgacccagtctccagactccctggctgtgtctcgtgggcgaggacgggcccaccatcaactgcaagtccagccagtagttagttttaatactaacctaccaaactaataaganctacttagcttacggtaaccagctaacaaagtcgaacggacacgtccctacctaacgtctacgtcctactaacgttttaacgtcgggtacctacgttacccggtaaccccggggtaaacgttcccgggggttacccctacgggtaacccgtacgttaccgacgggttcggaccgtacggggtccggggttaccgtacgggggtaacctaaggttacttttacccgaccgtccctaccaaccgtactaccgaacgtaccacgtcccgtaggaccgtaacggtcgtaggtaaagtacgttcggtaaggtaccgttaaggttttaacttaccggttacgttaaacctaaacgttaaatttaaagttaattaaacttaaccttaccgtttaaagttttaaccggttacgggtacgggtaacggtacggtaagggtaacggtaacgtaactaaccggtaaacgtaggtcgttacggacgttcgacgtaaccgttagtaccg

SEQ ID NO: 247975 - DNA, 650 bp, Homo sapiens
  misc_feature: GYAE6OF02FZ07L.16.73.G07.1.454.CMB.1.raw
  modified_base (359)..(359): a, c, t, g, unknown or other
  misc_feature (359)..(359): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccgtacggggacatcgtgatcgacccagtctccagacctcctggctgtgtctcgtgggcgaggacgggccacatacaactgacaagtccagccagtagttgttttaatactaacctaccaaactaacgtaagagacttacttagctttacgggaacctaacgaccaaactaaagtcgaacgggaaccacgtcccctaaccgtaacgcctcgccttactaacgtttacgngggactacgtcccgttaacccggggacgtcccggggttcctacggaccgtagttcgacggtcgcgtacgggtcggtcgacgggactagtactttccactccgtacaccatcacgtcgacgccgtgacgacggtctaaggaatcgtgttcgtacttacgttttatcgtacgtaactaactaaatttattaaactaattacttaacttaagttttaacggccggaacgggtagacgtaaggtgaacgttagtaaaccgaacggtgttcggagtacctacggcctagtcgttac

SEQ ID NO: 247976 - DNA, 715 bp, Homo sapiens
  misc_feature: GYAE6OF02F9CHY.16.73.G07.1.454.CMB.1.raw
  modified_base (253)..(253): a, c, t, g, unknown or other
  misc_feature (253)..(253): n is a, c, g, or t
  modified_base (607)..(607): a, c, t, g, unknown or other
  misc_feature (607)..(607): n is a, c, g, or t
  modified_base (614)..(614): a, c, t, g, unknown or other
  misc_feature (614)..(614): n is a, c, g, or t
  modified_base (622)..(622): a, c, t, g, unknown or other
  misc_feature (622)..(622): n is a, c, g, or t
  modified_base (700)..(700): a, c, t, g, unknown or other
  misc_feature (700)..(700): n is a, c, g, or t
tcagtgtactactccacgaccggtgctcgatttagctctacgctcagggggctacaacaggcaggcaggggcagcaagatggtgttgcagacccaggtctcatttctctgttgctctggatctctggtagccgtacggggacatcgtgatcgacccagtcctccagacctcccgtggactgtcgtctcggtagggcgagacgggccacctataccaacgtgacgtaacgtccacgcctagtagttagttttanaataacctaccaaactaagtaagacgtctaacttagcgttaggaaccctagacaaacgaatcgaacggactacgtaccctctaaggccttcggaccttacgtacgttttaccggcgggtacctaacggttaccccggtaacccggggtaaacggttcccccggggttacctacggtaacccgtacgtttaccgaacggggtccggcgttaaacgggtccggggttacgttaaacgggggactaaacggtttacctttaccacccggtttacctaccgtaaccgtactacgacgaccgtaccggtacctcggacgttacggacgtacggaagttcgtcggtacgtctacgtttanactcganaactaatnttaaataacttagtaacttagttagtcggaacgtacggtagaggtaagactataaacgacgtatcggtactccggtanacctacgtaattccg

SEQ ID NO: 247977 - DNA, 717 bp, Homo sapiens
  misc_feature: GYAE6OF02HSQS2.16.73.G07.1.454.CMB.1.raw
  modified_base (147)..(147): a, c, t, g, unknown or other
  misc_feature (147)..(147): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgccctacggggacatcgngatcgacccagtcctccagacctcccgtggtctgtgtcctgtgggcgaggacggccacagtaccaactgacaagtccagcctaggtagtttacgttttaataacttaacctaccaaaacaagttaaagactaccgtttaacttacgtccttaggtaaccagactaacaaatcgaagacacgccctacctaagctgctacttacgttcggtcggtactaccgtaccgttaacccgggacggtccccggggtacctacgaccgttactacggtacggtcggacgtacgggtcggggtaccgtacggggtacttacggttacctttccctacgtccctaacccgaacgtataccggtaaccgcaccggtcctacggaccgtaggacgtacgaagtggttcgtagtacgtttagttaacttcgtacgtaactaattaaacttaacgttaacttaaagtactttaaccgttatttaacgggttggtaacgggtaaggtacgtaacgggtacgtaagtaaaccgtaacgaaacggttagtaggtccgtaccgtaccgtaccgtacgttattacccg

SEQ ID NO: 247978 - DNA, 987 bp, Homo sapiens
  misc_feature: GYAE6OF02FXWOK.16.73.G07.1.454.CMB.1.raw
  modified_base (218)..(218): a, c, t, g, unknown or other
  misc_feature (218)..(218): n is a, c, g, or t
tcagtgtactactccacgaccggtgctcgatttagctctacgctcaggggtccgggagatcatgagggtgtccttgagtcgtgggggaggcgtggtccagcctgggggggtcgctgagactctcctgtgcagcctctggattcaccttcagtacctatgccatacacgtgggtccgccagccctaccagggcgaagggggctgggaggtgggtggctnttatatcatctgatgggagtatgaacttactacgcacggtcctccggtaggaacgggccgtaacttccgacctatcctaccgagaacggaacctaaacttaccccgaagaaaccaacgtaacccttagtaacgtaccttacgaaccgtaaaagtaacgaaaccgtacggtacccgtaggtaacggtaaaccgttagggaaacggtaacccggaaccgggtacccttactttaaattaaaccttttaaccggttgggttaaacgggcccggggtaaagggggggtaccggggggggggggtaaccccgggggttacgggggggaaccggttacccgggttaaccccccgtccccgggggtaaccggggggtcccctaaaggttaccgggtaccccgtttcccgggggaaccgggggttcccgggtaaacgggggtaccccgtttaccccggttcccgggttaacccggttaaccccggtttccccgttacccggtccccgtaacccgtaccccgtaacccccggtaaacccggaaacccggggtacccccttaaccgggtttccccggtttccccccgttttacccccggtacccggggttcccccggtccccggttcccggtaaccccgttacccggacccggggtaccgtaccccggttccccggaacccggggtccggtaacccgaacccgtaacccgggtacccgggaccccgggggtccccggttaccgggtcccggtaccgggaccccggttttaacccggggg

SEQ ID NO: 247979 - DNA, 773 bp, Homo sapiens
  misc_feature: GYAE6OF02HOR8I.16.73.G07.1.454.CMB.1.raw
  modified_base (194)..(194): a, c, t, g, unknown or other
  misc_feature (194)..(194): n is a, c, g, or t
  modified_base (482)..(482): a, c, t, g, unknown or other
  misc_feature (482)..(482): n is a, c, g, or t
  modified_base (748)..(748): a, c, t, g, unknown or other
  misc_feature (748)..(748): n is a, c, g, or t
  modified_base (757)..(757): a, c, t, g, unknown or other
  misc_feature (757)..(757): n is a, c, g, or t
  modified_base (769)..(769): a, c, t, g, unknown or other
  misc_feature (769)..(769): n is a, c, g, or t
tcagtgtactactccacgaccggtgctcgatttagctctacgctcagggggctacaacaggcaggcaggggcagcaagatggtgttgcagacccaggtcttcatttctctgttcgctctggatctcgtggtcgccgtacgggacagtcggtgatcgacccagtccaccgacgtcctccgtggctgtcgtctcgngggcgaggacggaccacatacactcgacgtaacgtccgacgtaccgaaggtacgtttagttttaactaactaaccgtaccaaaacgtaaacgttaaggaccggttacctttaacgttacgtaccgtttacggtaaccacgtaaccaaactaaacgtcgaacggtacacccgttaaccctaccgtaagtcgtacgtaccttacttacgtttaccggcggtactaacgtaccccggtaacccgggttaacggtccccggggtacctacggtaccgttaacggttaccggnggtaccggtcggtacgggtcccggttacggtacggtacgttacgttactcctaccgtccgtaccacctaacgtccgaacggcctaccgtccggtcgtaccgtacggtacgtacggaaggttaacgtggtacgtttcgtaacgtttacttacgtaacgtaaacgttaactaactttattaataacgttactaacgttttaacgttacggttacggacggtaacgggtagtacggaagtcgtaaacgttaacgaaccgttacgtacgnggtaaccgntacccaccgttntacg

SEQ ID NO: 247980 - DNA, 672 bp, Homo sapiens
  misc_feature: GYAE6OF02FJI19.16.73.G07.1.454.CMB.1.raw
  modified_base (111)..(111): a, c, t, g, unknown or other
  misc_feature (111)..(111): n is a, c, g, or t
  modified_base (200)..(200): a, c, t, g, unknown or other
  misc_feature (200)..(200): n is a, c, g, or t
  modified_base (347)..(347): a, c, t, g, unknown or other
  misc_feature (347)..(347): n is a, c, g, or t
tcagtgtactactccacgaccggtgctcgatttagctctacgctcaggggtccgggagatcatgagggtgtccttgagtctgggggaggcgtggtccagcctggggggtcnctgagactctcctgtgcagcctctggattccaccttcagtacctatgccatacacgtgggtccgccagcctccgaggcaaggggctggngtgggtcgctcttatatcatctgatgggagtactgaactactacgcacgaccttccggtaggaaacgggccgattccacctatcctaccagacgactaacttccccagaaccacacttagtatctgacaaatcgaacagcctagganaacgtgaggacacggctatattacttacgtgtacgcggagggaggggggcccggtagggacgccgttccgaccgtacggggctagtcgaaccgtcggtcgggaccgacggtactcccgtcggtaccgtcccgtctccctccaccgtcccgtaccctacccggaaccggtccctacgtcccggttccccgttaccccggttcgggaccccttcccggccgtacctacccggacggtaaccgacccgaacccccgttcggaaaccggtccgaaccgaccggaccgaccccgggtcccggtacgggcccttccggaccggttaccggg

SEQ ID NO: 247981 - DNA, 734 bp, Homo sapiens
  misc_feature: GYAE6OF02HATHL.16.73.G07.1.454.CMB.1.raw
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacgggacatcggtgatcgacccagtctccagtacctcccgtggtctggtcgtctcgtagggcgaggtacgggccacgtatacaacgtcgactaacgtccagccagtagttagtttanaactactacgaaacaagtaagacgtcttacgttacgtcgttacggacctagacaactaacgtcgaacgtaacncgtacccctacgaacgtctcgcttacgtacttacggtcggactacgtaccgtaacccggtacggtcccgggtcacgaccgtntcgaggacgcgtacggtcggtaccgngggtacacgttacttcgactaccgctaaccgtntacacgtaccncgttaccgngaacggcgtacgaacgtaaggttcgtacggtacgtttaacgttcgtttacgtaacgttccgaaacgttaaacgtttaacgtttaaacttaaaccgttaactttaaccgttacttttaaacggtttaccgggaaccggggtacgggtaacgtttacccgggtaaaggttcggtaaaccgtaacgttaaccgttaaacgggttcgttaccggcggtttaaacccgaccgttaacgtacccggtttcttaccg

SEQ ID NO: 247982 - DNA, 784 bp, Homo sapiens
  misc_feature: GYAE6OF02IS44L.16.73.G07.1.454.CMB.1.raw
  modified_base (165)..(165): a, c, t, g, unknown or other
  misc_feature (165)..(165): n is a, c, g, or t
  modified_base (189)..(189): a, c, t, g, unknown or other
  misc_feature (189)..(189): n is a, c, g, or t
  modified_base (556)..(556): a, c, t, g, unknown or other
  misc_feature (556)..(556): n is a, c, g, or t
tcagtgtactactccacgaccggtgctcgatttagctctacgctcaggggggctacaacaggcaggcaggggcagcaagatggtgttgcagacccaggtcttcatttctctgttgctctggatctcgtggtgaccgtacggggacatcgtgatacgacccagtcnccagacctcctggctgtgtctcgngggacgaggacgggccaacataccaactgacagtaccaggtaccagtagttagttttaactaacttaaaccaccgtaaaacaaagtaaacgtacgtaccttaacttaacggtacctttaacggggtaacccaaggaaccgaaactaaaacgtcgaaacggaccgaacggtccccgttaaccgtaacggctacggaccttacctaacgttttaaccggtgggaacctactacccgggtaaccccgggtaacggttacccggggtacccaggaacccgtattacccgagggtacgcgtacggtacgggttcgtaggggaactagtactttaccgaactccgtaaccacctaatcgaacgcaccgtaccnggacgaggtacgagtaacgtagttggacgtattaacggttttactaacgttacgtaaactaacgtaaattaactttaagtaaacttaaacgttaaccttaaaggttttaaacgtacccgggggtaacggacggggttaaaccgtaaggggtaacgtaaggtaaccgttaaacggaaaaccgtaggttaacggaggtaccgtaaccgtaccgtaacgttacgtttaccg

SEQ ID NO: 247983 - DNA, 613 bp, Homo sapiens
  misc_feature: GYAE6OF02GI94Z.16.73.G07.1.454.CMB.1.raw
  modified_base (244)..(244): a, c, t, g, unknown or other
  misc_feature (244)..(244): n is a, c, g, or t
  modified_base (381)..(381): a, c, t, g, unknown or other
  misc_feature (381)..(381): n is a, c, g, or t
  modified_base (454)..(454): a, c, t, g, unknown or other
  misc_feature (454)..(454): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagagtgttttaatataactccaanaataagagctacttagcttggtaaccagacaacaaatcgaggacacgtccctacctaagctgcttctatttacgtgggactacgtccgtaacccgggtaaggtcccgggtccctcggacccgtattcgaggtgacgnggtcgggtcgtggggaacagtacttccactcctacgtccagtcagccacgcctggacgaggtcctaggaacgngttcggtgtacttaagtttcttaacgtgtaacctaagtaaacttattaaagtaaacttacgttacttaagttttaacggttcgggacgggttacgtacgtaagggtcggaatacgtaaacgaaccgttagtgtacggacttaccgcgtacctagttccg

SEQ ID NO: 247984 - DNA, 642 bp, Homo sapiens
  misc_feature: GYAE6OF02FT5CJ.16.73.G07.1.454.CMB.1.raw
  modified_base (235)..(235): a, c, t, g, unknown or other
  misc_feature (235)..(235): n is a, c, g, or t
  modified_base (318)..(318): a, c, t, g, unknown or other
  misc_feature (318)..(318): n is a, c, g, or t
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtggggcgaggacgggcccaccatcaactgcaagtccagccagagttgttttanataactaccaaacaataagagcttaacttagcttaggtaccagacaacaatcaggacagccctacaagctgctctatttacgngggtacacgtaccgtaacccgggtagtcccggggtcctacggaccgtattcgaggtggacacggtcggtctagggactagtcttcgactctacgacctatccgagtcncgcctgacgaggactaggaagtntggtggtacttacgtttactacgttcgtaactaaactaagtttaacttaaagttaacttaacttaaccgttaaagttttttaacgttaccggggaacgggtaagggtaaccgtaggggttaacggaactacgtaaacccgtaaaggtaccgttagggtccggttaccgtacgaccccgtaacgtcgttaccgg

SEQ ID NO: 247985 - DNA, 719 bp, Homo sapiens
  misc_feature: GYAE6OF02IWRE7.16.73.G07.1.454.CMB.1.raw
  modified_base (146)..(146): a, c, t, g, unknown or other
  misc_feature (146)..(146): n is a, c, g, or t
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
  modified_base (664)..(664): a, c, t, g, unknown or other
  misc_feature (664)..(664): n is a, c, g, or t
tcagtgtactactccacgaccggtgctcgatttagctctacgctcaggggggctacaacaggcaggcaggggcagcaagatggtgttgcagacccaggtcttcattactctgttgctctggatctcgtggtgccggtaacgggganacgtcggtgagtacggaccctagtcctccagaccttccctggcctggtgtctcgtgggacgacggacgggccaccatacaactagacaagtccacgcaagtagttagttactaatacctaacaacaataagntactactagaccttagaacanacaacaaacncgaagaccacggtacccttacgtaacgcacggtcctacttaacgttacgtagggtacctaagtacccgtacccgggtaacggtcccgggtaccctaacggaccgttaagttcggaacggttcggacgtaggggtccggtcggtaacgggaactaggttaaccttccgaactctaacaaccngtaacagtacncctacggtccagtacgacggagaactcgggtacgtcggtaattacgtttaactacgtacgtaactaaactaagtaactttaaagtaaatttaactttaacgggtttaaattaaccgttaacgggaacggggtaacgttaacggaagggttaaggaaccgttanaaaaccgttaaacgtaccgagttacggttaccggtcgtaacccgacttagtaccg

SEQ ID NO: 247986 - DNA, 737 bp, Homo sapiens
  misc_feature: GYAE6OF02FJO1Y.16.73.G07.1.454.CMB.1.raw
  modified_base (147)..(147): a, c, t, g, unknown or other
  misc_feature (147)..(147): n is a, c, g, or t
  modified_base (420)..(420): a, c, t, g, unknown or other
  misc_feature (420)..(420): n is a, c, g, or t
  modified_base (475)..(475): a, c, t, g, unknown or other
  misc_feature (475)..(475): n is a, c, g, or t
  modified_base (676)..(676): a, c, t, g, unknown or other
  misc_feature (676)..(676): n is a, c, g, or t
tcagtgtactactccacgaccggtgctcgatttagctctacgctcagggggctacaacaggcaggcaggggcagcaagatggtgttgcagacccaggtcttcatttctctgttcgctctggactcctcgtggtgccgtacggggacnctcgtgtagtcgaaccctagttcctccgagacctccctgggcttcgttcgtccgttcggtggggcggtaggacgggacccaaccgtactacctaacgtgaccaacgtccacggaccgtaggtagttacgttttaactaacttaaccgtacctaaaactaaataaacggtacggtaccttactttaacgtcggtttacggtaccacgacaacgtaaactcggacggaaccacggtaccctacctaaggccgttagcctacttacgttttacggnggactacgttacccggaaccgggtaccggttccgggtcctacgaccgtattaccngggtcgcgacggtcggtcggtaggactgttctactcttcaccactacgtccacgcgtacgtccgtcgacggtacggtagtagtaacgtcgtacggtcgttcgtaagttttctaacggtactacgtaattataacgtttaactaactttacgttaactttacgtttaacggtacgggtcgggtaacggacggtaacgggtanaacggtaactaaccgttaagttacgtacgggtacgtccgtaagacccgtaattccgttacg

SEQ ID NO: 247987 - DNA, 686 bp, Homo sapiens
  misc_feature: GYAE6OF02G2AXW.16.73.G07.1.454.CMB.1.raw
  modified_base (110)..(110): a, c, t, g, unknown or other
  misc_feature (110)..(110): n is a, c, g, or t
  modified_base (172)..(172): a, c, t, g, unknown or other
  misc_feature (172)..(172): n is a, c, g, or t
  modified_base (252)..(252): a, c, t, g, unknown or other
  misc_feature (252)..(252): n is a, c, g, or t
  modified_base (350)..(350): a, c, t, g, unknown or other
  misc_feature (350)..(350): n is a, c, g, or t
tcagtgtactactccacgaccggtgctcgatttagctctacgctcaggggtccgggagatcatgagggtgtccttgagtctgggggagcgtggtccagcctggggggtcnctgagactctcctgtgcagcctctggattcaccttcagtacctatgccatacactgggtccncagcctcaggcaaggggctggagtgggtggctcgttatatcatctgatggagtactagaatacgtacgcagacctccggngaacggccgattcaccatctccagagaactaactccaagaacacactagtatcctagaactaaagtcgaacacgacctagaacgaacgtagaggaacncggtactactattaattacgtagtgcgggtaaggggacggggggtcggtagggacgaccgttccgtaccgggacgggtacccgtagtccggtactaccgggtacggggacggtaacgggtaccgttcccggttaccgggtacctaccggttcccttaccgtacgccgtccctaacccgtaacccgaccggtacccgtacgttacccggttacccgttcccccgttcggacccgtccgtaccgcccttacggaccgtacgacccgtacccggttaacgacggtaccgacccgagtacccggaccggtaccgccgggtcgtccggtaccgtaaccggg

SEQ ID NO: 247988 - DNA, 728 bp, Homo sapiens
  misc_feature: GYAE6OF02JNX71.16.73.G07.1.454.CMB.1.raw
  modified_base (362)..(362): a, c, t, g, unknown or other
  misc_feature (362)..(362): n is a, c, g, or t
tcagtgtactactccacgaccggtgctcgatttagctctacgctcagggggctacaacaggcaggcaggggcagcaagatggtgttgcagacccaggtcttcatttctctgttgctctggatctcgtggtcgccgtacggggacagttcgtggtatcggaccccagtcctccgaagtcctccctggctgttcgtcgtcgtggggacgaggacggccaaccattacaaccgtgctaagtccacgaccgtaggtacgtttacgttttataacgtaacctacccgaaataaagttaggacttacttaccgttagctttacggacacgctaaacgaaatcgaggtaccaacgtccctacgtaacgngtcgtctacgtagtcgtcggactacgtaccgtaccgggtaacgttccggggtaccttcggaaacgttcgttccgaaggttccggaagttccggggtaacggttcgggtacggttataacggtttcgttctacccgttaactaccgtacgtactaaccgaggtaccacggtaccgtgtacgtgaccggttagaacggtagtcgttcgtaagttcgtttacgtacgtaaggtacctaaaattcgtaaacttacgtaaacctttacttaaccttacgttaaaggttacgggacggtacgtaccggtaaggtaacccgaaggtaactacggtaacgtacggtcgacgtacgcgtacttcgtaacttccgg

SEQ ID NO: 247989 - DNA, 846 bp, Homo sapiens
  misc_feature: GYAE6OF02IRDF2.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctctggatctctggtcgccgtacggggactagtcggtgatcgaccctagtctccagacctcccgtggtctgtgtcgtcgtgggcgacggtcggaccctaccgtagtaccaacgtcgacctaaacggtccgaacgtacccgtaaggtacggttttacgttttaactaaacttaacccgtaaccaaaaccgtaaagtaacggacgtaccttaaacgtttacgtaccggtttaacggaacccgtaacggtacctaaaacgtaaacggttacccggaaaggacccgtaaccgttaccccgttaaccgtaagttccgtaccgtcctaccgtttaagttaccggtcgggtaacctacgtacccggtaacccggggtaacgttccccggggtaccctacgtaaccgtgttacggagtccggacgtacgggttccgggtcgtagggaaccttagttaccgttaccgaccgtacctacctaaccgtactaaccggcgtaccgaccggtccgtacgtacgggtacgtacgtaaggtacgttaacggtcggttaacgggtcctttaacgggttttactacgttaacgtaccttaaacgttaactttaaaggttaaacttaacgttaaccgtttaaccgtttaggttaaccgggtttacggaccggtaagggtaacgtgggtaacggtactaacgtaaccggtaacgttgtaggtacgtcctaggtaccctacgttggttaccg

SEQ ID NO: 247990 - DNA, 828 bp, Homo sapiens
  misc_feature: GYAE6OF02GLQK0.16.73.G07.1.454.CMB.1.raw
  modified_base (230)..(230): a, c, t, g, unknown or other
  misc_feature (230)..(230): n is a, c, g, or t
tcagtgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttanataactaccaacaataagagctacttagcttggtaccagcaacaaatcaaggacacgcctacctaaggcctaggccttactaacttttacgtggggacctacgttaccgtaaccccggggtaacgttcccgggggtccccttacggaccgtaacgttccgaaggttcgggacctagggtccggggttacgtacgggggaactacgggttaacttttccgaaccgtttcctaccgaacccctagttaccgaaacggtcctaacggtcccgttacggaccggtaacgggtccgtaacggaaaggtaacgtgggttacgggtacttacgttttaacttaacgttacggtaacctaaaacggttaactttaaactttaaacggttaaactttaaaccgtttaaccctttaaagttttttaaaaccgggttttccggggtaaccgggggtaaaccgggttaaaccggggttaaacgggggttaacgggaaaaccggtttaaccgggtttaaaaccgaaaaacccggggtttaaccggttaggggtttacccgggaaccggtttaacccgggtaacccttaacccggttaccgttttaacccgg

SEQ ID NO: 247991 - DNA, 733 bp, Homo sapiens
  misc_feature: GYAE6OF02G7V9V.16.73.G07.1.454.CMB.1.raw
tcagtgtactactccacgaccggtgctcgatttagctctacgctcagggggctacaacaggcaggcaggggcagcaagatggtgttgcagacccaggtcttcatttctctgttgctcgtggatctcgtggtcgaccgtacggggacagttcgtgacgttcgacccaggtcctccgagtacctcccgtgggtcttgtcgttctcggtgggcgaggacgggcccaacgactacaacgcgtacaacgtccaagacgtacgtaggttacgttttaatactaactaccaaagaaatacggacgtacttacgttaacgcgttacggtaacagacctaagaactcgaacggaactaccgccgttaaccaacggtcgtacgtacttacgtacgttaacgcggtactaccgtacggtaaccggtactaccgtcgtaccgagtacgtatcgaggttcgacggtacgcggttacgtacggactacggttacttaccgtacgttacaccgtacctacgacgaaccggttcgaaccgtccgtaacggtaccggacgttacggaacggttaaagtcgacggttagtaccctttaagtttaccggtataccgtaaataacggttaattaacgtaattaacttacgtaacttagttacgggtacgtacgggaactaacgggtaaggtacaacgggtactaaacggtaacgttacgttacggtaacggtacgttacggacgtacttacgg

SEQ ID NO: 247992 - DNA, 562 bp, Homo sapiens
  misc_feature: GYAE6OF01AIRGR.36.87.H10.1.454.CMB.1.raw
  modified_base (295)..(295): a, c, t, g, unknown or other
  misc_feature (295)..(295): n is a, c, g, or t
  modified_base (430)..(430): a, c, t, g, unknown or other
  misc_feature (430)..(430): n is a, c, g, or t
  modified_base (527)..(527): a, c, t, g, unknown or other
  misc_feature (527)..(527): n is a, c, g, or t
tcagtacgctgtctcacgaccggtgctcgatttagcagtactgcgttgggttttcctcgttgctcttttaagaggtgtccagtgtcaggtgcagctggtggagtctgggggaggcgtggtccagcctgggaggtccctgagactctcctgtgcagcctctggattcaccttcaatacctatggcatgcactgggtccgccaggctccaggcccaggggctggagtgggtgcagttatatggtatgatggaagtaataaatactatgcagactccgtgaagggccattcaccatcnccagagacaattaccaagaacacgctgtatgtgacaaatgaacagcctagagacgccggaggacacggctagtgtattactgtgcgagacgaccgcctctccgctccctagtcgggttcgggagttacggccagngtcggacgtcgtggggacgaaacgggccctacggtccaccgtctccctcgacgccctacccaccgaaccggcccacgttcccggtcccttcccccgngcccctacccctccctaccaacgcgccgtacccgg

SEQ ID NO: 247993 - DNA, 578 bp, Homo sapiens
  misc_feature: GYAE6OF01DQXLE.36.87.H10.1.454.CMB.1.raw
  modified_base (199)..(199): a, c, t, g, unknown or other
  misc_feature (199)..(199): n is a, c, g, or t
tcagtacgctgtctcacgaccggtgctcgatttagcagtactgcgttgggttttcctcgttgctcttttaagaggtgtccagtgtcaggtgcagctggtggagtctggggggaggcgtggtccagcctgggaggtccctgagactctcctgtgcagcctctggattcaccttcaatacctatggcatgcactgggtccnccaggcctccaggccaggggctgggagtgggtgcagttatatcatatgatggaaagtaataaaatactatgcagactcgtagaaggccgattcaccatctccagacgaacaacttccaagaacactactgtactctgacaaatgaaacagcctagagagctaggacggacacggcttgtacttattacgtgtacgacgaaagatcggaggtacgtaactcggtacagtattggtattggtttactattattacggtagtggacgtcgtgggaccgaagggccacggtcacccgttctccctcgaccgcctacccgaaccgacgggcccctacgttcccggttcccgttcccccgtaggcccctccccgtcccgtaaccg

SEQ ID NO: 247994 - DNA, 709 bp, Homo sapiens
  misc_feature: GYAE6OF01CILB5.36.87.H10.1.454.CMB.1.raw
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
tcagtacgctgtctcacgaccggtgctcgattagcagtactgcgttgggtttgggggggagaggagcccagcactagaagtcggcggtgtttccattcgatgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagactctccngtgcagcctctggattcaccttnaatacctatggcatgcacgtgggtcccnccaggcctccgagggcccaggggctgggagtgggtgacagttanagtcaattagtgaataggaaagttaataaaatctaatcgactaaggaaccttccggtaggaacgggtccgtaactttaccgaaccctataccgtaccgaaaggtacggtaacctaaacgtttaacccgaaaacgtaaacctaaccttacgttagttaacttaccgtaagtaacctaaaacgttacgaaacctaacggtacccttaagggaggaacggtaccggttaacggaaacggggtaaacccgtaacccggggttccgttaggttaacccgttttaaacgtttaaccggttaacgggttacggaaaccgggtaaaaaggttacggttaacgggtaacggggtttaacgtttaaacccgggg

SEQ ID NO: 247995 - DNA, 540 bp, Homo sapiens
  misc_feature: GYAE6OF01EQ99U.36.87.H10.1.454.CMB.1.raw
  modified_base (390)..(390): a, c, t, g, unknown or other
  misc_feature (390)..(390): n is a, c, g, or t
tcagtacgctgtctcacgaccggtgctcgatttagcagtactgcgttgggttttcctcgttgctcttttaagaggtgtccagtgtcaggtgcagctggtggagtctgggggaggcgtggtccagcctgggaggtccctgagactctcctgtgcagcctctggattcaccttcaatacctatggcatgcactgggtccgccaggctccaggccaggggctggagtgggtggcagttatatcatatgatggaagtaataaatactatgcagactccgtgaagggccgattcaccatctccagagacaattccaagaacactctgtatctgcaaaatgaaacagcctgagagctgagacacggctgtctattactgtgcgaaagatcgaggtnactggtaccagatggtatggtttactactattacggtatggacgtctggggccaagggaccacggtcaccgtctcctcacgccctccacccgaacgggccccaacgttccggtaccctttcccccgaggcccaccccgtcccgtaacccg

SEQ ID NO: 247996 - DNA, 717 bp, Homo sapiens
  misc_feature: GYAE6OF01DC2V1.36.87.H10.1.454.CMB.1.raw
  modified_base (172)..(172): a, c, t, g, unknown or other
  misc_feature (172)..(172): n is a, c, g, or t
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
tcagtacgctgtctcacgaccggtgctcgatttagcagtactgcgttgggttttcctcgttgctcttttaagaggtgtccagtgtcaggtgcagctggtggagtctgggggaggcgtggtccagcctgggaggtccctgagactctcctgtgcagcctctggattcaccttnaatacctatggcatgcactgggtccncaggctccaggccaggggctggagtgggtggctagttatatcatatgatggaagtaataaatactatgnagactccgtgaacggccattcaccatctacaganacaataccaaagaacactctagtactcgtagacaaaagtgaaacacgcctagaacgtacgcgtacggaacggaccgacggtcttacgttaccttaagttaaccgtggttacggaaccggtaaaaagtacggtacggttaagggttagttacccgtaagggtaaccctaaggtagttagggttacttaggttttaaaccttaagtttaaggtttaacgggttagtacggggtaccggttaccgggaggggttaacccggaaacgggacccggtaaccggttaccctacccggttaccttacccgtaccgtacccgccccgttaacccgaaacccggtaaaccccggggtcccctaaccgtttccccggtcccctttaccccccgacgggccccttaacccccgtcccgtaaacccgg

SEQ ID NO: 247997 - DNA, 550 bp, Homo sapiens
  misc_feature: GYAE6OF01AIK6X.36.87.H10.1.454.CMB.1.raw
  modified_base (389)..(389): a, c, t, g, unknown or other
  misc_feature (389)..(389): n is a, c, g, or t
  modified_base (477)..(477): a, c, t, g, unknown or other
  misc_feature (477)..(477): n is a, c, g, or t
tcagtacgctgtctcacgaccggtgctcgatttagcagtactgcgttgggttttcctcgttgctcttttaagaggtgtccagtgtcaggtgcagctggtggagtctggggggaggcgtggtccagcctgggaggtccctgagactctcctgtgcagcctctggattcaccttcaatacctatggcatgcactgggtccgccaggctccaggcccaggggctgggagtgggtggcagttatatcatatgatggaagtaataaatactatgcagactccgtgaagggccgattcaccatctccagagacaattccaagaacactctgtatctgacaaatgaaacagcctgagagctaggagacacggctgtctattactgtgacgtaaagngtacgaggtgtactaggtaccagagtgtattaggttactatattaggtataggtacgtcgtgggaccaagggaccacggtcaccgtcncctcacgtccctaccgaccgacgggccctacgtcccggtcccttcccccgtaggccctccccgtccgtacccg

SEQ ID NO: 247998 - DNA, 561 bp, Homo sapiens
  misc_feature: GYAE6OF01CBT3M.36.87.H10.1.454.CMB.1.raw
  modified_base (255)..(255): a, c, t, g, unknown or other
  misc_feature (255)..(255): n is a, c, g, or t
  modified_base (429)..(429): a, c, t, g, unknown or other
  misc_feature (429)..(429): n is a, c, g, or t
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
tcagtacgctgtctcacgaccggtgctcgattagcagtactgcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggacgtccctggagactctccgtgngcagcctctggattccaccctttcaattaccctatcggcatcgccacgtcggggtcccgccacgggcctaccgagggccgaggggctgggaggtgggtgctagttatatcaatagtgataggaataaataaatctatgacagacgtcgtagacggacgtatcacactcacaganactactaccaagaactactctatactctagactaatacgaacgtcgacctagacgagcgtaggacggacacggtntacgttntagttacgtcgtacgacgtaaacgtcgtaggtacggttgtaccgtacggg

SEQ ID NO: 247999 - DNA, 681 bp, Homo sapiens
  misc_feature: GYAE6OF01A5N3S.36.87.H10.1.454.CMB.1.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
tcagtacgctgtctcacgaccggtgctcgatttagcagtactgcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgctctcctgtncagcctntggacttccaccttnaactacctatcggcatcgctacgtcggggtccnccgacggcctccggacggccgaggggctgggacggtggggtcgacgtagttactagtacagttacgtagacggttaggaaaacgttaaataaacgttacttaagcgtaaccgtaaacggtaccgtacccgggtaagggtaaccgggtacccgtaactttaccgaacccttacgtccctaacccgaaggtaacgaacctaacgttacccgaaaagtacccgtaacttacgtaggttaactccgtacgaactaaatacgaaaccgtcgaccgtagaaggcgtacgacgggtacgacccgtacgggtccttggtcttaacgtcgttagggactaaggtaaacgtcaaggggttacctaggttacgttaacccgg

SEQ ID NO: 248000 - DNA, 774 bp, Homo sapiens
  misc_feature: GYAE6OF01B7EBF.36.87.H10.1.454.CMB.1.raw
  modified_base (220)..(220): a, c, t, g, unknown or other
  misc_feature (220)..(220): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
tcagtacgctgtctcacgaccggtgctcgatttagcagtactgcgttgggtttgggctgagctgggtttcctcgttgctcttttaagaggtgtccagtgtcaggtgcagctggtggagtcgtgggggaggcgtggtccagcctgggaggtccctgagacctctccgtgtgcagcctctggattccaccttcaataccctatggcatcgcacgtgggtccnccaggctccaggccaggggctggagtgggtggctagttanatcatangagtaggaagtaataaatactatgacagtactccgtagaaacgggccgtaattccacctactctaccaagacgaacctaacttacccgaaagaacctacgttactaggtaactaccgtaggaacctaaatacgaactacgacccgtaggaacgacgtaccggaggaacgggtacctacgggttcttcgttaaccttaacgtttaaacgtcggttaacggaaaccggtaaagaacggttacggtaagggttacgtttaacggtaacggttaacccgagggttacgtttagggttaacgttttaacggttttaacccgttaaacgtttaaccggtttaacgggtttacgtaacgggttaccgggttacggttacggggtaacccggtaaccggggtaaccccgtaccggtacccgttacccggtaccccgttcccgacccgtacccgtcccccgtaaaccggacccggtaaacccgggtccccgtaacgttcccccggtttacccccgg

SEQ ID NO: 248001 - DNA, 716 bp, Homo sapiens
  misc_feature: GYAE6OF01BG3EW.36.87.H10.1.454.CMB.1.raw
  modified_base (315)..(315): a, c, t, g, unknown or other
  misc_feature (315)..(315): n is a, c, g, or t
tcagtacgctgtctcacgaccggtgctcgatttagcagtactgcgttggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggacggtccctgacgacctctcctgtcgcagcctcgtggtacttccaccttcaattacctatggcatgcacgtcgggtcccnccaggcctccgaggccgaggggctgggaggtggggtgctagttatatactatagtgaagtagggtaaaagttaaaattaaaagtaccttaagtagaccgtaaacggtaccgttcccgggtaagggtaaaccggggtcccgtaaactttaccaaccctaattaccccgtaccgtaacggtaaacgtaaacctaaactttaacccgaaaagtaaacccttacttaccgttacggttaacttaccgtaacgaacctaaaacgtacggtaaaaccgtacggtaccgtaggaacggtacggtaccgtagggaacggtaccgaaccgggtcgttacgttacttaacgttcggtagtacggaacgtaaaaggtacgtacgggtaacggttacgttaacggttaacggg

SEQ ID NO: 248002 - DNA, 794 bp, Homo sapiens
  misc_feature: GYAE6OF01CZIUS.36.87.H10.1.454.CMB.1.raw
tcagtacgctgtctcacgaccggtgctcgatttagcagtactgcgttgggtttggggggagaggagcccagcactagagtcggcggtgttccattcggtgatcagcactgaacacagaggactcaccatggagtttgggctgagtctgggtttcctcgttgctactttaagaggtgtccagtgtcaggtgcagtctggtgagtcgtgggggagcgtggtccaggccgtgggacgtcctgagtacctctccgtgcgcacgtccttgtacggtattcccgacctttacgaattacccgtagttcggactaagttccgaccgtagttccggggtacccacggaggtcccgtaccggaagggccccggtaaggggtcccgtggggtaacgggttgggggtaccgaccttaaagggttttaccaccgtacggttaaacggttaagttacgggtaaaggtttacggggtaaaaaacttttaaacgtaaaaccttacttacgggacccgaagttaaaccggtacccgttcccgggtaagggaaacccggggttccctaacttttacccgaaacctccggtttaaccctaccgaaacggtaacgtaaaccttaacgttaacccgggaaaacttacccgacctttacgtttaaggactttaccgtaacgaattaaacgacgtaacacggtcctaaaggtacgacgtaccgttaaggaaccggtacctgggtaacgttcgttacgtttacaccggttaggacgtaacgtaaacgttacgtcggaacgtttcgtaaccggtaacg

SEQ ID NO: 248003 - DNA, 803 bp, Homo sapiens
  misc_feature: GYAE6OF01DB0Q7.36.87.H10.1.454.CMB.1.raw
  modified_base (702)..(702): a, c, t, g, unknown or other
  misc_feature (702)..(702): n is a, c, g, or t
tcagtacgctgtctcacgaccggtgctcgatttagcagtactgcgttgggttttcctcgttgctcttttaagaggtgtccagtgtcaggtgcagctggtggagtcgtgggggaggcgtggtccagccgtgggaggtccctgagactctcctgtgcacgcctcgtggacttcctaccttacaacttaccttagtggacagtgccacgtcggggtcccgccgacggcctccgacggccggaggggccgtgggaggttggggtcggacgttaggttactagtacgtattagtagtaagtaggtaaaagttaaataaaacttactagtacgacgaacgtacctacggtaggaacggtccctaactttaccgaacctactaccgtaccgaaggtaacgaaccttaacgttaacccaaaagtaaacccgttaccttacgtttacgttaacgttacccgagttaaaacctaacgtaacgaaacgtaaccgtcccggttaaggaaacggacggtaaccggtaagggaacccggtaacccggtaccggttacgttaccgttaacgtttaacgttacggtaggtaacgggtaaagtaaacgtcggttaacggtggttaacgtacgtacgtacgagttggtattacgtttacgtaactacgttagtacgtgtacggtaccgtcggtaccggacggtaacgcccgtacgtaccnccgttcgtcccacgtcccgaccctaaccggaccgtaacccgtcccgttacccgttcccggttcccccttcccggtaccgtccccaccccgttcgaaaccgg

SEQ ID NO: 248004 - DNA, 752 bp, Homo sapiens
  misc_feature: GYAE6OF01CXK9I.36.87.H10.1.454.CMB.1.raw
  modified_base (199)..(199): a, c, t, g, unknown or other
  misc_feature (199)..(199): n is a, c, g, or t
  modified_base (339)..(339): a, c, t, g, unknown or other
  misc_feature (339)..(339): n is a, c, g, or t
tcagtacgctgtctcacgaccggtgctcgatttagcagtactgcgttgggtttgggggggagaggagcccagcactagaagtcggcggtgtttccattcggtgatcagcactgaacacagaggactcaccatggagtttgggctgagcttgggtttttcctcgttgcttcttttaaggaggttgtccagtgtcagggtncagcgtgggtggagtcggtggggggagcgtggtccagccgtgggacgtccctgacgacctctcctgtcgcacgcctgtcggtacttccacctttacaacttacctagtcggactagtgacctacggttcggggtaccccnccgacggtcctacccggaagggcccggtagggggccgtaggggtacggggttggggttacggacttaaggtttactacgttctaaagttagttaggaaaggtttaacgggaaaatttaaattaaaacgtacgtagttaacggacgtaacgtaccgtccggtagggaaaccgggtcctaacgttacccaccgtacttacccgtaccaacggtaaacgtcctaaacgttaacccgaaaacgtaaccctacctttacggttacttaacgttacctaacggtaaacctaaagttacggaacccgtagtacccgaaggtaacgcggtaacggtacggaacgaccgtcggtacttacgttcttaaacttcggtagtacggaacgtaatacggtaggttaagggtccgttacggtaacgg

SEQ ID NO: 248005 - DNA, 700 bp, Homo sapiens
  misc_feature: GYAE6OF01C9P3E.36.87.H10.1.454.CMB.1.raw
  modified_base (407)..(407): a, c, t, g, unknown or other
  misc_feature (407)..(407): n is a, c, g, or t
tcagtacgctgtctcacgaccggtgctcgatttagcagtactgcgttgggtttgggggggagaggagcccagcactagaagtcggcggtgttccattcggtgatcagcactgaacacagaggactcaccatgggagtttggggctgagtcttggggtttttcctcgttagcttacgttttaagaggttgtccaggtgtcgaggtgcagcgtgggtggaggtcggtggggggagcgtggtccaggccgtggggacgtcctgacgcctctcctgtcgcaggtccttcgtcggaactttccaacctttcaaacttacctagtcggctaatcgacctacggtcgggtcccaccgaggtccaccgaagggcccggaggggtctgggacggtggggtcgtaacgtagttttanacttcgaattacggtgtaaagtaacggggtaaattaaaagtaaaacttacgtagtacgacgtagaccgttcgggtaaggaacggtaccggtactaccaccgtactacctacgaagtagtaccaaatttaccgaaatacctacttacgttagaacttcgagtaaacaagtaccgaaacgtcgtaccgagtacggtacgacgtaaggaaccggaccgtaggtccttagaccgtttataaccggtggtacggaaccgtaaaggtacgttaggtaacgggttgttaccgtaacgggg

SEQ ID NO: 248006 - DNA, 832 bp, Homo sapiens
  misc_feature: GYAE6OF01CKNMG.36.87.H10.1.454.CMB.1.raw
  modified_base (179)..(179): a, c, t, g, unknown or other
  misc_feature (179)..(179): n is a, c, g, or t
  modified_base (278)..(278): a, c, t, g, unknown or other
  misc_feature (278)..(278): n is a, c, g, or t
tcagtacgctgtctcacgaccggtgctcgatttagcagtactgcgttgggttgggggggagaggagcccagcactagaagtcggcggtgttccattcggtgatcagccactgaacacagaggactcaccatggtagttgggctgagtcgttgggtttcctgttgcttacgttttaaagnggtgtccagtcgtacgaggtcgcgagtcgtggtgggtaggtcggtgggggaggtcgtcgggtccaggtcccgtgggacgtccgtgacgtcttcgtccgngcgcgtcgacctgtacggtacttcctaaccttaacgaaacgttaccctaggtcggactagtcggtaccgtacccgggttccgggggtaccaaccggccggtcccgttacccggacgggtacccggtaggggtccggttaggggacggttcgggggtacacgtttaagttacttaacgtccgtaaattaaggtaacggaagttaaaggaaaagtttaaattaaaacggtcctttaaggaccgtaacgtaaccggtaaacccgtcggtaaacggtaacgggtaacccttaacgtaacccgacctaacgtacccctaacggtaacgtaacgtaaaccgttaacctaaaccggaaaacgttaacgtaaccgttaccgtaagttaactaccgttaacgaaacttaaacgtaccggtaaaccgacggttaccgtaaggacgtaccggtaacgtaacggaccgtaaccggtacgttaccgttaacgttagttaaccggttaccgtaggtaaaccgtacggtaaagtacggttaacggtcggtaaaccgttcggtaaaccgg

SEQ ID NO: 248007 - DNA, 710 bp, Homo sapiens
  misc_feature: GYAE6OF01BIBTZ.36.87.H10.1.454.CMB.1.raw
  modified_base (400)..(400): a, c, t, g, unknown or other
  misc_feature (400)..(400): n is a, c, g, or t
  modified_base (457)..(457): a, c, t, g, unknown or other
  misc_feature (457)..(457): n is a, c, g, or t
  modified_base (587)..(587): a, c, t, g, unknown or other
  misc_feature (587)..(587): n is a, c, g, or t
  modified_base (617)..(617): a, c, t, g, unknown or other
  misc_feature (617)..(617): n is a, c, g, or t
tcagtacgctgtctcacgaccggtgctcgatttagcagtactgcgttggtttgggggggagaggagcccagcactagaagtcggcggtgtttccattcggtgatcagcactgaacacagaggactcaccatggagtttgggctgagcgtggtttcctcgttgctctttaagaggtgtccagtgtcaggtgcagctggtggagtcgtgggggagcgtggtccagccgtgggacggtccctggacgtacctctccgtgtgcacgcctctggacttcaccttacaattacctatcggtacagtcggacctacgtcgggggtccccaccgtagggtacccctaccggacgggcccggacgggggtcttagggggaggttgggggtacggtacctaaggttttanattactagttagtaggtaagtaagggtaaaagttaaacttaaaactattaaggtacncgtaacgtaacccgttcgggtaacgggaccgggtactaacttaccacctaactcgtaaccgaagaaccgtaaacaacgttaacaaacgtacctaacttcggtacttaactcctaaggtaacctaaaagtnaaacccgtacggttacaaggaacggtacgngtaaccgggaaggtacccgtacggtacttcgttacttaacgttccgagtaccgaaagtaagttaccggtaggaacggttcgtaacggtaacgg

SEQ ID NO: 248008 - DNA, 718 bp, Homo sapiens
  misc_feature: GYAE6OF01A5IKU.36.87.H10.1.454.CMB.1.raw
  modified_base (135)..(135): a, c, t, g, unknown or other
  misc_feature (135)..(135): n is a, c, g, or t
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (429)..(429): a, c, t, g, unknown or other
  misc_feature (429)..(429): n is a, c, g, or t
  modified_base (459)..(459): a, c, t, g, unknown or other
  misc_feature (459)..(459): n is a, c, g, or t
tcagtacgctgtctcacgaccggtgctcgattagcagtactgcgttgggttggggggagaggagcccagcactagaagtcggcggtgtttccattcggtgatcagcactgaacacgagagacctcaccgtatggngtttggctagacgtcgttcgggttttcctcggttgactttagttttaaagcggttcgtccgtagttgtcgaggtncgtgcgtagggtgngttacggngggggacgcgttcggtacctcgccgtggggactcccttagcgtacctctacgtncgcacgcctgagtcttctaccttacgaactaccgtatcggcactggacctacggtcggaccgacgtcggtcctaccgggaggtaccggtaggggacgtacggtagggtgggttacggattcgttaagtactagtacgtagtanaaacgggttagaaaacgttaaaggttaaanacgtaacgtacgaacgtaacgtaccggtaccgtaggaacggtactaccgttacacctacgtacgacccgaagtaaccgaactaacgtaacgtaacccgtaataaccggtactaacgttacctacgtaactaacctaacggtacaaccgtacgacttacggaaacgttagacgacgaacggtacgacgggttactcggttaacgtaggttacgacggtagaacggtaacgaacgtagttaaggtaccgttaacggtacgg

SEQ ID NO: 248009 - DNA, 530 bp, Homo sapiens
  misc_feature: GYAE6OF02H5UQI.36.87.H10.1.454.CMB.1.raw
  modified_base (149)..(149): a, c, t, g, unknown or other
  misc_feature (149)..(149): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (240)..(241): a, c, t, g, unknown or other
  misc_feature (240)..(241): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (262)..(264): a, c, t, g, unknown or other
  misc_feature (262)..(264): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
tcagtacgctgtctcacgaccggtgctcgattagcagtactgcgttgggtttggggggaggaggagcccagcactagaagtcggcggtgtttccattcggtgatcagcactgaacacagaggactcaccatggagtttgggctgagcgnggtttcgcgtaggctcttaagaggtgtcagtgtcaggtgcagctggtggatctggggagctggccagcctgggagtccngngncnctgngnnctctgntcnctcatactangnnncncgtcgtcgcncgcncncgcgnggngngngnggngngagtatatnatatgagtagaagtaaataaataactatagacagtacgtacgtaggacggacgtacgtactactactactacgacgaacgaactaactaacaaacgaactactactagtatacgtagtaacaataacgaacgaacgacgagaagacgagtacgacgacgacgacgtcgtacttacgttacgttacgtagacgaacgtacgtaggtacggtagtacgtacg

SEQ ID NO: 248010 - DNA, 676 bp, Homo sapiens
  misc_feature: GYAE6OF02GWEMO.36.87.H10.1.454.CMB.1.raw
  modified_base (327)..(327): a, c, t, g, unknown or other
  misc_feature (327)..(327): n is a, c, g, or t
tcagtacgctgtctcacgaccggtgctcgattagcagtactgcgttggggtttgggggggagaggagcccgagcactagaagtcggcggtgttccattcggtgatcagcactgaacacagaggactcaccatggagtttgggctgagcgtgggttttcctcgttgcttcttttaagaggtgtccagtgtcaggtgcagcgtggtggagtcgtgggggagtcgtggtccaggccgtggggacggtccccggagaccttcgtccgtggtcgcagccctgtggtacttccacctttcaaactacctagtggctatcgcacgtcgggtccnccgaggcctccgaggcccgaggggctgggagtggggtgccgtagttatacgtcaattagtaggactaggaaactaaataaaactctagtgacgtaacggtaccgttccggtaggaaacgggccgtacgttaccgaacctactcctaccgaagacgtaactaacttaccaaagtaacctacgttcgtagttactacctagaactaaagtacgaacgtacgacccgttaaggacgtacgtcgtaaggaacgggaaccgaccggtcgttacgttacgttaacgtttaacgtaggtacggtaacgtaaacggtacgtaccggttaagggttacgttacggtacggtaacccgg

SEQ ID NO: 248011 - DNA, 535 bp, Homo sapiens
  misc_feature: GYAE6OF02HTV98.36.87.H10.1.454.CMB.1.raw
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (513)..(513): a, c, t, g, unknown or other
  misc_feature (513)..(513): n is a, c, g, or t
tcagtacgctgtctcacgaccggtgctcgatttagcagtactgcgttggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggacggtccctggagactctcctgtgcagcctctggattcaccttcaactacctatggcatgcacgtgggtcccnccaggcctccgaggccaggggctggaggtgggnggctagttatatcattatgagtggaaagtaataaatatatgacagactccggtagaggcatcacatctcaganactaataccaacgacactntgtactctgacaaatcgaacacgcctagagagacgtagaaggacgacggtactgttacctaagttactggtgaacggtaaagngtacggtaggttatacgtacgg

SEQ ID NO: 248012 - DNA, 578 bp, Homo sapiens
  misc_feature: GYAE6OF02JYQHH.36.87.H10.1.454.CMB.1.raw
  modified_base (303)..(303): a, c, t, g, unknown or other
  misc_feature (303)..(303): n is a, c, g, or t
tcagtacgctgtctcacgaccggtgctcgatttagcagtactgcgttggtttgggggggagaggagcccagcactagaagtcggcggtgtttccattcggtgatcagcactgaacacagaggactcaccatggagtttgggctgagcgtgggtttcctcgttgctctttaagaggtgtccagtgtcaggtgcagctggtggagtcgtgggggagcgtggtccagccgtggggacgtccctgagactctcctgtgcagcctctggattcaccttcaatacctatggcatcgcacgtgggtcccncaggcctccgagggccgaggggctgggaggtggggtgctaggttatatcatagtgataggaaataaataactactatgacagactcggagacggctatcactatctaccagacgacaacttaccaaacgaactacgttacgtacgttaactctacgacgtaaactacggtaacacggtacctagaagtacgacgtaggacggtacgacggtccgtgttaccttagttaccaggttacgaacgtaacggagttacggaaggttacgtacgtaacgg

SEQ ID NO: 248013 - DNA, 556 bp, Homo sapiens
  misc_feature: GYAE6OF02GF1DW.36.87.H10.1.454.CMB.1.raw
  modified_base (342)..(342): a, c, t, g, unknown or other
  misc_feature (342)..(342): n is a, c, g, or t
  modified_base (450)..(450): a, c, t, g, unknown or other
  misc_feature (450)..(450): n is a, c, g, or t
tcagtacgctgtctcacgaccggtgctcgatttagcagtactgcgttggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcaatacctatggcatgcactggggtccgccaggctccaggccaggggctgggagtggggtggcagttanatcatatgatggaagttaaataaatactatgcagtacctccggtagaagggccgattaccaaccgatctaccagaacgacaacttccaaagaacactctagtatctanacaaagtacaaacgagtacctagacgagtctaggacggacgacggacgtgttacttagttactaggttagacgtaaagagtacggaggttacggtacgttaacggg

SEQ ID NO: 248014 - DNA, 567 bp, Homo sapiens
  misc_feature: GYAE6OF02GRVW2.36.87.H10.1.454.CMB.1.raw
tcagtacgctgtctcacgaccggtgctcgatttagcagtactgcgttgggttttcctcgttgctcttttaagaggtgtccagtgtcaggtgcagctggtggagtctgggggaggcgtggtccagcctgggaggtccctgagactctcctgtgcagcctctggattcaccttcaatacctatggcatgcactgggtccgccaggctccaggccaggggctggagtgggtggcagttatatcatatgatggaagtaataaatactatgcagactccgtgaagggccgattcaccatcctccaagagacaattccaagaacactactgtatctgacaaatgaacagcctagagagctagaggacacggtctgtactattactagtgacgaaagtatacggaggttgtacgtggtaccagtatggtattgttactatagttaggttatggacgtcggtcgggacgtaacgggaccgtacggtccaccgttcctacccgtcacgccctaccaccgaaccgggacccacgttcccggttccttcccccgtcggcccctacccctcctaacccg

SEQ ID NO: 248015 - DNA, 539 bp, Homo sapiens
  misc_feature: GYAE6OF02G9KLN.36.87.H10.1.454.CMB.1.raw
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagtacgctgtctcacgaccggtgctcgatttagcagtactgcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggacggtccctgagacctctcctgtgcagcctcgtggacttcaccttcaattacctatggcatgcacgtcggggtcccnccgaggcctccgaggccgaggggctgggagtgggtgctagttanatcatatgataggaataataaatctatgacagactcgagacggctatcacntctcaganacatacaagacactctagtatctagactaagtacgaacgacgtacctagacgacgacgtacgagacgacggtcgtgtacttatacgtgtagacgtaagtacgtacggtacggttcgtacgtacgg

SEQ ID NO: 248016 - DNA, 699 bp, Homo sapiens
  misc_feature: GYAE6OF02IQE1Z.36.87.H10.1.454.CMB.1.raw
  modified_base (308)..(308): a, c, t, g, unknown or other
  misc_feature (308)..(308): n is a, c, g, or t
tcagtacgctgtctcacgaccggtgctcgatttagcagtactgcgttggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctggggacgtccctgagacctctcctgtgcagcctctggacttccaccttcaactacctatggcatcgcacgtcgggtccnccgaggcctccgaggcccgaggggcctggggaggttggggtcggctaaggtttactagtacctatagtggaagtagggtaaaagtttaaagtaaattactagtcggactagtacctccgggtaaggaacggggccgtaacttaccaaccgtacgtacctaccgaacgaacgtaactaaacgttaccgaaaacgtaacctaccgttaccgttacgttactaccgttaacgactaaaacgttacgtaaaccgacggtacccgtaagggaacgtacggtaccgtaacgggtaaccgggaccggtaaccggtacggttcggttaccgttacgttaaccggttagtacggtaacgtaaaggtacgttacggtacgggttacggtacgttaaccggg

SEQ ID NO: 248017 - DNA, 781 bp, Homo sapiens
  misc_feature: GYAE6OF02FFQRN.36.87.H10.1.454.CMB.1.raw
  modified_base (199)..(199): a, c, t, g, unknown or other
  misc_feature (199)..(199): n is a, c, g, or t
  modified_base (699)..(699): a, c, t, g, unknown or other
  misc_feature (699)..(699): n is a, c, g, or t
  modified_base (752)..(752): a, c, t, g, unknown or other
  misc_feature (752)..(752): n is a, c, g, or t
tcagtacgctgtctcacgaccggtgctcgatttagcagtactgcgttgggtttcctcgttgctcttttaagaggtgtccagtgtcaggtgcagctggtggagtctgggggaggcgtggtccagcctgggaggtccctgagactctcctgtgcagcctctggacttcaccttcaatacctatggcatgcacgtgggtccnccaggcctccgaggccaggggctgggagtgggtgctagttatatcatagtgaagtaggaaagttaataaactactagtgactaagtaccgtccggtaggaacggggtccctatttccaacctatcctaccaaggtacaaccaaactttaccaaagaacctacgttctaggttaactctacgtaacaaagttacggaaacctaggtaccccttagggaaacgtacggtacccgttaaggggaaaccgggtaccgtaaccgggtcgtttaacgttaccgttaaacgttttaccggtaggttaacgggtacgtaaaaacggtacggttacggtaacggttacggttaaccgtaacgggtaaaccgtaggttaacgttagggttaacgtttacggtttaacgttaaccgttaacgtttaacgggtacgtcgggttaacgtacgggtaccgggaccgtaaacgggcctaacccgggtcaacccgttcctaccacgtaccgacccnccggaaccgtaaccggtacccgtaacgttccccgggttaacctttcccccggnggtaccccctacccgttacccgtaacccg

SEQ ID NO: 248018 - DNA, 609 bp, Homo sapiens
  misc_feature: GYAE6OF02JR8UM.36.87.H10.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
tcagtacgctgtctcacgaccggtgctcgatttagcagtactgcgttgggttttcctcgttgctcttttaagaggtgtccagtgtcaggtgcagctggtggagtctggggggaggcgtggtccagcctgggaggtccctgagactctcctgtgcagcctctggattcaccttcaatacctatggcatgcactggggtccnccaggcctccaggcccgagggggtctgggagtggggtggctagttatatcaattatgataggaagtaactaaagtctaatgcaagtctcgtgaaggcatcacancncanancaatacaagacnctcgtatatcganacaaatnaacgcgcctagagacgngagaacggacgaagtntcgtacttagtactaggtagaaacgtaagtacgtggtaggtacgtacgtacgacgtagtagttacgttaagttagttaacttaagttaagttaggtacgttggtaccggttacggacggtaccgtaaccgggacgtacgtccgtaccgtaccttcgacctacgtcccgtaaccaccggaccgtaccgtacgtacccgttcccgtcccctacggtaccctaccccgtacctacg

SEQ ID NO: 248019 - DNA, 685 bp, Homo sapiens
  misc_feature: GYAE6OF02G772B.36.87.H10.1.454.CMB.1.raw
  modified_base (170)..(170): a, c, t, g, unknown or other
  misc_feature (170)..(170): n is a, c, g, or t
  modified_base (200)..(200): a, c, t, g, unknown or other
  misc_feature (200)..(200): n is a, c, g, or t
  modified_base (245)..(245): a, c, t, g, unknown or other
  misc_feature (245)..(245): n is a, c, g, or t
tcagtacgctgtctcacgaccggtgctcgatttagcagtactgcgttgggttttcctcgttgctctttaagaggtgtccagtgtcaggtgcagctggtggagtctgggggagcgtggtccagcctgggagtccctgagactctcctgtgcagcctctggacttcaccttnaatacctagtggcatgctacgtgggtcccncgaggcctccgagggccaggggtctgggagtgggtgctagtttantcatagtgagtaggaagtaataatactatgacagtactcggtaggaacgggtcctattaccacctactccgtaccgagacgtactaacttaccgaaacgtaacctacgttcgtagtactcgtagactaaacgtacgaacgtacgtccgtaggacgagtcgtaggaacggtacgacggtcgtacgttacttacgttacgtgtacgtaacgtaaagtacgtacggtaggttacgtacgtacggtaccgtagttaagttacggttagtttacgtttaacgtaacgttacggttaaggtagtacggtacggttcgggtaccgggaaccgtaacgggtaccgtacggtaccgtaccgtcctaccgtccgaccgtccgtaccgaaccggtaaccggcccgtacgttcccgttcccgttcccgtcggtaccctcccgtcccgtaacg

SEQ ID NO: 248020 - DNA, 647 bp, Homo sapiens
  misc_feature: GYAE6OF02HOQ52.36.87.H10.1.454.CMB.1.raw
  modified_base (199)..(199): a, c, t, g, unknown or other
  misc_feature (199)..(199): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
tcagtacgctgtctcacgaccggtgctcgatttagcagtactgcgttgggttttcctcgttgctcttttaagaggtgtccagtgtcaggtgcagctggtggagtctgggggaggcgtggtccagcctgggaggtccctgagactctcctgtgcagcctctggattcaccttcaatacctatggcatgcacgtgggtccncaggctccgagggagggctggagtggtctcagctaattagtgggtagggtnacttcaccanacttacgcggacgtcggtgggggccgttcacatcacagagacactcaggacgcacgctatatctagacaaatcgacacacgcctgagtacgtcggagaccgacggccgtagttacgttagttggtcgacggtagacgtactaccgtaacggtacgaacccacgtagttggtagttcgttttaggtttacgttttttacggaccgtacgggtaacttaacgtcggttacctaccggttcttccgttaccgtaccgtccctacccgtaacccgaaccgggtcccctacgttcccgttacccgttcccccgtacggtcccgtcccgtcgtcccgtaccgacggtaccgcctacccgtaccggacgaccgactaccgaccggtaccccggg

SEQ ID NO: 248021 - DNA, 740 bp, Homo sapiens
  misc_feature: GYAE6OF02G84N8.36.87.H10.1.454.CMB.1.raw
  modified_base (687)..(687): a, c, t, g, unknown or other
  misc_feature (687)..(687): n is a, c, g, or t
tcagtacgctgtctcacgaccggtgctcgatttagcagtactgcgtttgggtttggggggggagaggagcccagcactagaagtcggcggtgtttccattcggtgatcagcactgaacacagaggactcaccatggagtttgggctgagcgttgggttttcctgttgcttactttttaaggaggttgtcccaggttgtcgagggttgcacgtcgttgggtgggagttcgggtggggggaggtccgtgggtccaggtccgtggggacggtcccaggacgtaccttctccgtgtcgcacgtcctacgtggtacttccgaccttacaacttacctatcggactagtcgctaccgtgggtaccccgcgacggtccctacccggagggcccggtaaggggtcctagggggtacgggttcggggtcggtacgtaacggtttaattaacgtctaaagtgtaagtaaggtaagggtaaaaactttaaagttaaacgttaacgtagttacccgagtaaccggtaccgtacccgggtaagggaaccgggtccgttaaccttaaccgaccgttacgttaccaacgtaacggaacgtaactaaaccttaaccggaaacgtaaccttaccgtagttcgtaactcgtaaccggaataacgtagaacgctaacgtggaagctagacgacgtcgacgtcggtntaccgttagtacgtgtacggaactaggaaccgttggtacgtacgtacgtacgg

SEQ ID NO: 248022 - DNA, 738 bp, Homo sapiens
  misc_feature: GYAE6OF02FIF6V.36.87.H10.1.454.CMB.1.raw
  modified_base (264)..(264): a, c, t, g, unknown or other
  misc_feature (264)..(264): n is a, c, g, or t
tcagtacgctgtctcacgaccggtgctcgatttagcagtactgcgttggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgctctcctgtcgcagcctcnggtacttcacccttcaattacctatggacctatcgcaccgtgggtcccgccaggcctccagggcccgtagggggcctgggacgggttggggtcggtactacggttagtattaccaagttacgtagtacgttaggggtaaaagttaaacgttaaaataaccttaagttcggaacaggtacccgttaccgggtacggaaacgggtccgtacgtttaccgaaccctacgtaccttaccgaagtaacgaaacctaaccgtttaacccaaaacgtaaaccgtaaccttaccgttacgttaacttaccgtacgtaaccaaaagtttacgaaaaccgtacgtaccgttaagaacggtaacgtacggttaacggaacgggtaaccgacccgggtacgtttaccgggttaattaaccgttacgttacggtagtaacggtaaacgtacggttacgggtaacgggttacggttaacgtaaccggg

SEQ ID NO: 248023 - DNA, 705 bp, Homo sapiens
  misc_feature: GYAE6OF02GNKUS.36.87.H10.1.454.CMB.1.raw
  modified_base (198)..(198): a, c, t, g, unknown or other
  misc_feature (198)..(198): n is a, c, g, or t
tcagtacgctgtctcacgaccggtgctcgatttagcagtactgcgttgggttttcctcgttgctcttttaagaggtgtccagtgtcaggtgcagctggtggagtctgggggagcgtggtccagcctgggaggtccctgagactctcctgtgcagcctctggattcaccttcaatacctatggcatgcacgtgggtccnccaggctccaggccaggggctgggagtgggtgctaggttatatcatatgatggaataataaatactatgacagacctccggagaacgggccattcacctatccaccagagactaattaccaaagaacactctagtactctagactaaataggaacaggacctaggacgacggtactaggacgggaacaccggtctagttacttaagttacgttggtacgaacgtaaagtaggtacggtagggttaccgtacgttacggtaaccaggttaacgtttaggttaagtttacgggtttaaacttaagtttaacggtttaacggtaagtcgggtaaccggttcggtacggggaacccgtaaaccggggtaccgtaaccgggttacctaacccgttccgtttacccgaccgtacccgtccccgttaacccggaacccgtaccggggtacccctacggttccccggttcccctttacccccggtacggtcccctaccccgttcccgtaacccgg

SEQ ID NO: 248024 - DNA, 752 bp, Homo sapiens
  misc_feature: GYAE6OF02FOCM7.36.87.H10.1.454.CMB.1.raw
tcagtacgctgtctcacgaccggtgctcgatttagcagtactgcgttgggttttcctcgttgctcttttaagaggtgtccagtgtcaggtgcagctggtggagtctggggggaggcgtggtccagcctgggaggtccctgagactctcctgtgcagcctctggacttccacctttcaacttacctatcggcatcgcacgtcgggtcccgccgaggcctaccgacgggcccgaggggctgggtaggtggggtgactagttactatctatatagattaggaaataaataaatactatgacaagtacgtccgtaggaacgggtcctaattccaccacttcctaccgagaacgaaccgtaacttaacccgaaagtaacctaacgttcttaagttactacgtacgtaaactaaagacgggtaaacctacggccgtaagacggtacgacgtaacgggaacggtaaccacgggttccttagttaccgtttaacttaacggtggtacgaaacgggtaaaagtccggttaaggttacggtaacgttaccggtaacggtaacctaaggttaacggtttagttaacggttttaacgttaacgttaaccgtttagggttaaccgtagtaacggtacgtgggtaccgggaaccgtaacggaccgtacgtccgtaccgtctcccgacgacctcccgaaccgaccggaccgtacccttaggtccccgtttccctccccggtacgccccgttacccgtcccgtaaccg

SEQ ID NO: 248025 - DNA, 702 bp, Homo sapiens
  misc_feature: GYAE6OF02HGC9S.36.87.H10.1.454.CMB.1.raw
tcagtacgctgtctcacgaccggtgctcgatttagcagtactgcgttggtttgggggggagaggagcccagcactagaagtcggcggtgtttccattcggtgatcagcactgaacacagaggactcaccatggagtttgggctgagtcgttgggttttcctcgttgcttacttttaaggaggttcgtccgtagttgtcgtagggtgcagtcgttgggtggagttcggtggggggagtcggtcggtccgacggccggtggggacggttcccgtggacgtaccttccttccgtggtcgccacgtccgtcgtcggtacttctaccttactaactactagtcgactatcgtcgtacgtcggtccgccgacgtcgtccgacggcggacgggcgtaggaggtgggtggtcgtagttagtagtacccccccccccccctagtagtagtagtagtaaagtaaagtaaactaactagtacgtacgtacgtacgtacggtacggtacggtaccgtacgtaccgtaccgtacgtactacgtaacgtaacgtaactaactaaccgaacgtaactactacgtacgtacgtacgtacgtaacgtaacgtacgtacgtacgtacgtacgacgtacgacgtacgacgacgacgtacgtacgttacttacgtacgtacgtacgtacgtaacgtacgtacggtacggtacgtacgtacgg

SEQ ID NO: 248026 - DNA, 801 bp, Homo sapiens
  misc_feature: GYAE6OF02JFK22.36.87.H10.1.454.CMB.1.raw
tcagtacgctgtctcacgaccggtgctcgatttagcagtactgcgttgggtttgggctgagctgggtttcctcgttgctcttttaagaggtgtccagtgtcaggtgcagctgggtggagtcgtgggggagcgtggtccagccgtggggacggtccctgagtacttctaccctgtcgctacggccttcgtacggtacttacctacccgttactaacgtcctaagtcggcctagtgggtacccccacgttcggggtcccaccgaaggggtcccctaacgggggactccgggagggttcgggtagggacggtggggttacacgttacgttaattactcgaattggtaacgtaagtaacggtaacgttaaataacgtactaagtcgacgtagtaccggtcgtaaggaccgactagtaccaactacgtaccaacgtacaacgtaactaacgttaccgaagacctactcgtataacgtaccgaagtaacgtaacgtagaaccgtacgtccgtaaggaacgtacgtacgggtccgtaacggtaccgtacgttaccgttacggttaacgtacgttaacggtagtacggtaacggtaacggtacgtacggttacggtacgtacggttacgtaacgtacgtaacggttacgttaacgttacgttaacgttaacgtacggttacggtacggtacggtacggtaaccggtacggtaccgtacggtaccgtaccgtccgtaacccggtcctaccgtacccgacggtccccacggtacccggtacccgtaccccggtacggtaccccgtaccccg

SEQ ID NO: 248027 - DNA, 743 bp, Homo sapiens
  misc_feature: GYAE6OF02H7NUJ.36.87.H10.1.454.CMB.1.raw
  modified_base (202)..(202): a, c, t, g, unknown or other
  misc_feature (202)..(202): n is a, c, g, or t
tcagtacgctgtctcacgaccggtgctcgatttagcagtactgcgttgggttttcctcgttgctcttttaagaggtgtccagtgtcaggtgcagctggtggagtctgggggagcgtggtccagcctgggaggtccctgagtactctcctgtgcagcctctggtattccactttaatacctagtggccatgcacgtgggtccncaggctccgaggtccagggtctgggagtgggtggctagttatactctaattgtagataggaagtaaataagtactatgcagtacctcggtaggaacggtcctaagttaccacctaatccgtccgaaggtacaactaacttaccaagtaacctactcgtagttaacttcgacgtactaaaagttcgaaaacgacgtaccgtaggaacggtacgtcgtaaggtaaccggggtaccaaccgggttcgtacggtttaaccttacgtttacggtagttacggaaacggtaaagtacgtagggtaacggttgttaaacgtcggttaaaccctagggttaacgttaggttaacgtttcggtttaaacgttacgttacggtagggttacgtgggtacgggttcggtaacggggacccgtaaagggacccgttcggtaccgtaccgttccgtacctccgaacgtcccgtaacccgaacggtaccggtacccgtaccggtttcccgttcccgtaccccgtgtccccctaacccgttccgtaccgtaaccgg

SEQ ID NO: 248028 - DNA, 672 bp, Homo sapiens
  misc_feature: GYAE6OF02I4Z57.36.87.H10.1.454.CMB.1.raw
  modified_base (422)..(422): a, c, t, g, unknown or other
  misc_feature (422)..(422): n is a, c, g, or t
  modified_base (612)..(612): a, c, t, g, unknown or other
  misc_feature (612)..(612): n is a, c, g, or t
tcagtacgctgtctcacgaccggtgctcgatttagcagtactgcgttggtttgggggggagaggagcccagcactagaagtcggcggtgtttccattcggtgatcagcactgaacacagaggactcaccatggagtttgggctgagcttgggttttcctcggttgcttcttttaaggagtgtccagtgtcaggtgcagcgtggtggagtcgtgggggaggtcggtggtccaggcctggggacggtccctggacgacttctccgtgtcgacacgccttgtggtacttcctaccttacaaacttaccctaagtcgggctaatggacctaccggtcggggtcccgccgacgggcctcccgaaaccgggccgtaacgggggcctacggggaggttcggggtcggactacggttaatatacaagttntaggtaagtaagggaaattaaaagtaaattaacgtatacgtacaaacggtccgtccgggtaaggaacgggccgtaagttcccaaccgtactacctacgaacgaagaaacctaacgtaaccaaagtaaccctattcgtatagttacctaagtaacaagtacgactaaccggctagagcgagtagacgacgngtcgtatcgttattacgtcggtagtaacggaagtagcgggtacgttaggtcgttaacggg

SEQ ID NO: 248029 - DNA, 906 bp, Homo sapiens
  misc_feature: GYAE6OF02IF2E7.36.87.H10.1.454.CMB.1.raw
tcagtacgctgtctcacgaccggtgctcgatttagcagtactgcgttggtttgggggggagaggagcccagcactagaagtcggcggtgtttccattcggtgatcagcactgaacacagaggactcaccatggtagtttgggctgagtcgttgggttttcctcgttgtcttcttttaaaggaggtcgttaccgaggttgtacgagggttgcagtcgtggtggtagtcggtagggggacggtcggtcgggtaccacggccggttggggaaccggttccccgtaggacggttacccttccgtcccgttggtcgaccctcggcccgttacggttacggtaaccttttcccgtaaaccccgttttactaaaacgttaccgttaacgtcggtaccaagttcggaccgtaaccggtccgggttacccgccggaacggttccgtacccggacggtacccgggtaggggtccggttagggggtaacggttcgggggtaaccggtagttaacggttttaacttaacgtaccgtaagttaggtacggttaaaggttaacggtaaaaagttaaaaacttaaaacgttaaccgttagtaacggtaccgtaacggttacccggtttacgggttaaacggggtaaccggtaaccgttaaccgttaaccccgtaacggtaaccttacccggttaccgtaacgtaacggtaaacctaaccgtttaaacccggaaaccttaaccgtaaccgttacgttaccgttaaataccgggttaaactaaaacgtaacgtaaacggtacgtaaccggtaccgttaacgggaagtacgggtacggtaacggtaccgtaaccggcgttaccgttgttacttacggttacgtaggtaccgtaaggacgtacggtaggtacgtggttaagtcgg

SEQ ID NO: 248030 - DNA, 810 bp, Homo sapiens
  misc_feature: GYAE6OF02HZKJT.36.87.H10.1.454.CMB.1.raw
tcagtacgctgtctcacgaccggtgctcgatttagcagtactgcgttgggtttgggctgagctgggttttcctcgttgctctttaagaggtgtccagtgtcgaggtgcagctggtggacgtcgtgggggagcgtcggtaccagcgtgggacggtccctgagtactctctgtcgcacgtcctcgtaggtacttaccacccgttacaaacgttaccttagtcggactagtcgtaccgtacggttcgggtaccccgaccgtaacgggtcctaccccggtaacggccgggtacgggggtccgttaggggtaaggggttcgggggtcgtaacgttacgtttaattaacgtacttaagttaggtaacgaagttaagggtaaaacttaaagttaaaactacgttagtacgacgtaacgtaccgtacggtaaggtacggtacgtactaccctaactcgtaccgaccgaagtaacgtaactaactaaccgaactactacgtctagtactcgtaagaactaagtacgaacgtactcgagagacgtgtacgaaaccgtacgtacgtacgtacgttaacttacgttacgtagtacgacgtaacgtacgtacggttacgttacgtacgtaacgtaacgtagtaacgttagttacggttacgttacgttaagttagtacgttcgtacgggttacggtaccggtaccgggtaaccggtaccgtaccggtacccggttccgtacccggttaccgtacccgtacccgtaccgacccgttaaccggaacccgttaccggtacccgttacccggttcccgttaccccgg

SEQ ID NO: 248031 - DNA, 315 bp, Homo sapiens
  misc_feature: GYAE6OF01CJENN.11.7.A07.1.454.CMB.1.raw
  modified_base (290)..(290): a, c, t, g, unknown or other
  misc_feature (290)..(290): n is a, c, g, or t
  modified_base (296)..(315): a, c, t, g, unknown or other
  misc_feature (296)..(315): n is a, c, g, or t
tcagcgagagataccacgaccggtgctcgatttagcacgtgtcgcgagggccctcagggattccctgagcgattctctggctccaactctgggaacacagccactctgaccgatcagcgggacccaggctatggatgaggctgactattactgtcaggcgtgggacagcttcactgatgtggtattcggcggagggaccaagctgaccgtcctaggtcagcccaaggctgccccctggtcactctgttcccgcctctcgtatctactcgctgagcgggctaggcaaggcncatagnnnnnnnnnnnnnnnnnnnn

SEQ ID NO: 248032 - DNA, 299 bp, Homo sapiens
  misc_feature: GYAE6OF01D8TH5.11.7.A07.1.454.CMB.1.raw
  modified_base (296)..(299): a, c, t, g, unknown or other
  misc_feature (296)..(299): n is a, c, g, or t
tcagcgagagataccacgaccggtgctcgatttagcacgtgtcgcaggggccctcagggatccctgagcgattctctggctccaactctgggaacacagccactctgaccatcagcgggacccaggctatggatgaggctgactattactgtcaggcgtgggacagcttcactgatgtggtattcggcggagggaccaagctgaccgtcctaggtcagcccaaggctgccccctcggtcactctcgttcccaccctcctcgtatctctcgctgagcgggctggcaaggcgcatagnnnn

SEQ ID NO: 248033 - DNA, 318 bp, Homo sapiens
  misc_feature: GYAE6OF01B6UJP.11.7.A07.1.454.CMB.1.raw
  modified_base (292)..(292): a, c, t, g, unknown or other
  misc_feature (292)..(292): n is a, c, g, or t
  modified_base (298)..(318): a, c, t, g, unknown or other
  misc_feature (298)..(318): n is a, c, g, or t
tcagcgagagataccacgaccggtgctcgatttagcacgtgtcgcgaggggccctcagggatccctgagcgattctctggctccaactctcgggaacacagccactctgaccatcagcgggacccaggctatggatgaggctgactattactgtcaggcgtgggacagcttcactgatgtgggtattcggcggagggaccaagctgaccgtcctaggtcacgcccaaggctcgccccctggtcactctcgtcccaccctctcgtatctctcgctgagcgggctggcaaggcncatagnnnnnnnnnnnnnnnnnnnnn

SEQ ID NO: 248034 - DNA, 127 bp, Homo sapiens
  misc_feature: GYAE6OF01CABB8.52.41.D08.1.454.CMB.1.raw
  modified_base (127)..(127): a, c, t, g, unknown or other
  misc_feature (127)..(127): n is a, c, g, or t
tcagcgcagtacgacacgaccggtgctcgatttagtcacgcgagaaagggaaaggggctggccctgacgtgtttctgttcccaccctcctctatacgatcgctgagcgggctggcaaggcgcatagn

SEQ ID NO: 248035 - DNA, 124 bp, Homo sapiens
  misc_feature: GYAE6OF01ESZW1.52.41.D08.1.454.CMB.1.raw
  modified_base (124)..(124): a, c, t, g, unknown or other
  misc_feature (124)..(124): n is a, c, g, or t
tcagcgcagtacgacacgaccggtgctcgatttagtcacgcgagaaagggaagggctggccctgacgtgtttctgttcccacctcctctatacgatcgctgagcgggctggcaaggcgcatagn

SEQ ID NO: 248036 - DNA, 126 bp, Homo sapiens
  misc_feature: GYAE6OF01BL0RZ.52.41.D08.1.454.CMB.1.raw
  modified_base (126)..(126): a, c, t, g, unknown or other
  misc_feature (126)..(126): n is a, c, g, or t
tcagcgcagtacgacacgaccggtgctcgatttagtcacgcgagaaagggaaagggctggccctgacgtgtttctgttcccaccctcctctatacgatcgctgagcgggctggcaaggcgcatagn

SEQ ID NO: 248037 - DNA, 136 bp, Homo sapiens
  misc_feature: GYAE6OF01BYA11.52.41.D08.1.454.CMB.1.raw
  modified_base (127)..(136): a, c, t, g, unknown or other
  misc_feature (127)..(136): n is a, c, g, or t
tcagcgcagtacgacacgaccggtgctcgatttagtcacgcgagaaagggaaaggggctggccctagcgtgttcctgttcccaccctcctctatacgatcgctgagcgggctggcaaggcgcatagnnnnnnnnnn

SEQ ID NO: 248038 - DNA, 127 bp, Homo sapiens; identical to SEQ ID NO: 248034
  misc_feature: GYAE6OF01CJNHH.52.41.D08.1.454.CMB.1.raw
  modified_base (127)..(127): a, c, t, g, unknown or other
  misc_feature (127)..(127): n is a, c, g, or t

SEQ ID NO: 248039 - DNA, 127 bp, Homo sapiens
  misc_feature: GYAE6OF01BCVGI.52.41.D08.1.454.CMB.1.raw
  modified_base (127)..(127): a, c, t, g, unknown or other
  misc_feature (127)..(127): n is a, c, g, or t
tcagcgcagtacgacacgaccggtgctcgatttagtcacgcgagaaagggaaaggggctggccctgacgtgtttctgttcccgccctcctctatacgatcgctgagcgggctggcaaggcgcatagn

SEQ ID NO: 248040 - DNA, 127 bp, Homo sapiens; identical to SEQ ID NO: 248039
  misc_feature: GYAE6OF01CVLRI.52.41.D08.1.454.CMB.1.raw
  modified_base (127)..(127): a, c, t, g, unknown or other
  misc_feature (127)..(127): n is a, c, g, or t

SEQ ID NO: 248041 - DNA, 127 bp, Homo sapiens; identical to SEQ ID NO: 248034
  misc_feature: GYAE6OF01BF42Q.52.41.D08.1.454.CMB.1.raw
  modified_base (127)..(127): a, c, t, g, unknown or other
  misc_feature (127)..(127): n is a, c, g, or t

SEQ ID NO: 248042 - DNA, 127 bp, Homo sapiens; identical to SEQ ID NO: 248039
  misc_feature: GYAE6OF01C8E22.52.41.D08.1.454.CMB.1.raw
  modified_base (127)..(127): a, c, t, g, unknown or other
  misc_feature (127)..(127): n is a, c, g, or t

SEQ ID NO: 248043 - DNA, 132 bp, Homo sapiens
  misc_feature: GYAE6OF01BM4E6.52.41.D08.1.454.CMB.1.raw
  modified_base (127)..(132): a, c, t, g, unknown or other
  misc_feature (127)..(132): n is a, c, g, or t
tcagcgcagtacgacacgaccggtgctcgatttagtcacgcgagaaagggaaaggggctggccctgacgtgtttctgttcccaccctcctctatacgatcgctgagcgggctggcaaggcgcatagnnnnnn

SEQ ID NO: 248044 - DNA, 124 bp, Homo sapiens
  misc_feature: GYAE6OF01D3HS6.52.41.D08.1.454.CMB.1.raw
tcagcgcagtacgacacgaccggtgctcgatttagtcacgcgagaaagggaaaggggctggccctgacgtgttctgttccgccctcctctatacgatcgctgagcgggctggcaaggcgcatag

SEQ ID NO: 248045 - DNA, 127 bp, Homo sapiens; identical to SEQ ID NO: 248034
  misc_feature: GYAE6OF01AR4KV.52.41.D08.1.454.CMB.1.raw
  modified_base (127)..(127): a, c, t, g, unknown or other
  misc_feature (127)..(127): n is a, c, g, or t

SEQ ID NO: 248046 - DNA, 128 bp, Homo sapiens
  misc_feature: GYAE6OF01DYHQF.52.41.D08.1.454.CMB.1.raw
  modified_base (127)..(128): a, c, t, g, unknown or other
  misc_feature (127)..(128): n is a, c, g, or t
tcagcgcagtacgacacgaccggtgctcgatttagtcacgcgagaaagggaaaggggctggccctgacgtgtttctgttcccaccctcctctatacgatcgctgagcgggctggcaaggcgcatagnn

SEQ ID NO: 248047 - DNA, 154 bp, Homo sapiens
  misc_feature: GYAE6OF01D979W.52.41.D08.1.454.CMB.1.raw
  modified_base (129)..(154): a, c, t, g, unknown or other
  misc_feature (129)..(154): n is a, c, g, or t
tcagcgcagtacgacacgaccggtgctcgatttagtcacgcgagaaagggaaaggggctgggccctgacgtgtttctgttcccacccttcctctatacgatcgctgagcgggctggcaaggcgcatagnnnnnnnnnnnnnnnnnnnnnnnnnn

SEQ ID NO: 248048 - DNA, 126 bp, Homo sapiens
  misc_feature: GYAE6OF01AEP37.52.41.D08.1.454.CMB.1.raw
  modified_base (126)..(126): a, c, t, g, unknown or other
  misc_feature (126)..(126): n is a, c, g, or t
tcagcgcagtacgacacgaccggtgctcgatttagtcacgcgagaaagggaaggggctggccctgacgtgtttctgttcccgccctcctctatacgatcgctgagcgggctggcaaggcgcatagn

SEQ ID NO: 248049 - DNA, 126 bp, Homo sapiens
  misc_feature: GYAE6OF01C4DL9.52.41.D08.1.454.CMB.1.raw
tcagcgcagtacgacacgaccggtgctcgatttagtcacgcgagaaagggaaaggggctggccctgacgtgtttctgttcccgccctcctctatacgatcgctgagcgggctggcaaggcgcatag

SEQ ID NO: 248050 - DNA, 131 bp, Homo sapiens
  misc_feature: GYAE6OF01B8864.52.41.D08.1.454.CMB.1.raw
  modified_base (128)..(131): a, c, t, g, unknown or other
  misc_feature (128)..(131): n is a, c, g, or t
tcagcgcagtacgacacgaccggtgctcgatttagtcacgcgagaaagggaaagggggctggccctgacgtgtttctgttcccaccctcctctatacgatcgctgagcgggctggcaaggcgcatagnnnn

SEQ ID NO: 248051 - DNA, 129 bp, Homo sapiens
  misc_feature: GYAE6OF01BG2I9.52.41.D08.1.454.CMB.1.raw
  modified_base (127)..(129): a, c, t, g, unknown or other
  misc_feature (127)..(129): n is a, c, g, or t
tcagcgcagtacgacacgaccggtgctcgatttagtcacgcgagaaagggaaaggggctggccctgacgtgtttctgttcccgccctcctctatacgatcgctgagcgggctggcaaggcgcatagnnn

SEQ ID NO: 248052 - DNA, 131 bp, Homo sapiens
  misc_feature: GYAE6OF01ENPG9.52.41.D08.1.454.CMB.1.raw
  modified_base (127)..(131): a, c, t, g, unknown or other
  misc_feature (127)..(131): n is a, c, g, or t
tcagcgcagtacgacacgaccggtgctcgatttagtcacgcgagaaagggaaaggggctggccctgacgtgtttctgttcccgccctcctctatacgatcgctgagcgggctggcaaggcgcatagnnnnn

SEQ ID NO: 248053 - DNA, 124 bp, Homo sapiens
  misc_feature: GYAE6OF02F8DYZ.52.41.D08.1.454.CMB.1.raw
  modified_base (124)..(124): a, c, t, g, unknown or other
  misc_feature (124)..(124): n is a, c, g, or t
tcagcgcagtacgacacgaccggtgctcgatttagtcacgcgagaaaggaaggggctggccctgacgtgtttctgttcccgcctcctctatacgatcgctgagcgggctggcaaggcgcatagn

SEQ ID NO: 248054 - DNA, 129 bp, Homo sapiens
  misc_feature: GYAE6OF02IL02O.52.41.D08.1.454.CMB.1.raw
  modified_base (127)..(129): a, c, t, g, unknown or other
  misc_feature (127)..(129): n is a, c, g, or t
tcagcgcagtacgacacgaccggtgctcgatttagtcacgcgagaaagggaaaggggctggccctgacgtgtttctgttcccaccctcctctatacgatcgctgagcgggctggcaaggcgcatagnnn

SEQ ID NO: 248055 - DNA, 126 bp, Homo sapiens
  misc_feature: GYAE6OF02HO0CP.52.41.D08.1.454.CMB.1.raw
  modified_base (126)..(126): a, c, t, g, unknown or other
  misc_feature (126)..(126): n is a, c, g, or t
tcagcgcagtacgacacgaccggtgctcgatttagtcacgcgagaaagggaaggggctggccctgacgtgtttctgttcccaccctcctctatacgatcgctgagcgggctggcaaggcgcatagn

SEQ ID NO: 248056 - DNA, 125 bp, Homo sapiens
  misc_feature: GYAE6OF02IZ2YS.52.41.D08.1.454.CMB.1.raw
  modified_base (124)..(125): a, c, t, g, unknown or other
  misc_feature (124)..(125): n is a, c, g, or t
tcagcgcagtacgacacgaccggtgctcgatttagtcacgcgagaaagggaaagggctggccctgacgtgtttctgttccacctcctctatacgatcgctgagcgggctggcaaggcgcatagnn

SEQ ID NO: 248057 - DNA, 127 bp, Homo sapiens; identical to SEQ ID NO: 248039
  misc_feature: GYAE6OF02G2P8O.52.41.D08.1.454.CMB.1.raw
  modified_base (127)..(127): a, c, t, g, unknown or other
  misc_feature (127)..(127): n is a, c, g, or t

SEQ ID NO: 248058 - DNA, 127 bp, Homo sapiens; identical to SEQ ID NO: 248039
  misc_feature: GYAE6OF02GRORD.52.41.D08.1.454.CMB.1.raw
  modified_base (127)..(127): a, c, t, g, unknown or other
  misc_feature (127)..(127): n is a, c, g, or t

SEQ ID NO: 248059 - DNA, 127 bp, Homo sapiens; identical to SEQ ID NO: 248039
  misc_feature: GYAE6OF02HVUZS.52.41.D08.1.454.CMB.1.raw
  modified_base (127)..(127): a, c, t, g, unknown or other
  misc_feature (127)..(127): n is a, c, g, or t

SEQ ID NO: 248060 - DNA, 127 bp, Homo sapiens; identical to SEQ ID NO: 248034
  misc_feature: GYAE6OF02HCI0N.52.41.D08.1.454.CMB.1.raw
  modified_base (127)..(127): a, c, t, g, unknown or other
  misc_feature (127)..(127): n is a, c, g, or t

SEQ ID NO: 248061 - DNA, 126 bp, Homo sapiens
  misc_feature: GYAE6OF02H6RA7.52.41.D08.1.454.CMB.1.raw
tcagcgcagtacgacacgaccggtgctcgatttagtcacgcgagaaagggaaaggggctggccctgacgtgtttctgttcccaccctcctctatacgatcgctgagcgggctggcaaggcgcatag

SEQ ID NO: 248062 - DNA, 127 bp, Homo sapiens; identical to SEQ ID NO: 248034
  misc_feature: GYAE6OF02GS31D.52.41.D08.1.454.CMB.1.raw
  modified_base (127)..(127): a, c, t, g, unknown or other
  misc_feature (127)..(127): n is a, c, g, or t

SEQ ID NO: 248063 - DNA, 127 bp, Homo sapiens; identical to SEQ ID NO: 248039
  misc_feature: GYAE6OF02HGXUK.52.41.D08.1.454.CMB.1.raw
  modified_base (127)..(127): a, c, t, g, unknown or other
  misc_feature (127)..(127): n is a, c, g, or t

SEQ ID NO: 248064 - DNA, 125 bp, Homo sapiens
  misc_feature: GYAE6OF02JH9M2.52.41.D08.1.454.CMB.1.raw
  modified_base (125)..(125): a, c, t, g, unknown or other
  misc_feature (125)..(125): n is a, c, g, or t
tcagcgcagtacgacacgaccggtgctcgatttagtcacgcgagaaaggaaaggggctggccctagcgtgttcctgttcccgcctcctctatacgatcgctgagcgggctggcaaggcgcatagn

SEQ ID NO: 248065 - DNA, 129 bp, Homo sapiens
  misc_feature: GYAE6OF02GO5EG.52.41.D08.1.454.CMB.1.raw
  modified_base (128)..(129): a, c, t, g, unknown or other
  misc_feature (128)..(129): n is a, c, g, or t
tcagcgcagtacgacacgaccggtgctcgatttagtcacgcgagaaagggaaagggggctggccctgacgtgtttctgttcccgccctcctctatacgatcgctgagcgggctggcaaggcgcatagnn

SEQ ID NO: 248066 - DNA, 127 bp, Homo sapiens
  misc_feature: GYAE6OF02FJ73I.52.41.D08.1.454.CMB.1.raw
  modified_base (127)..(127): a, c, t, g, unknown or other
  misc_feature (127)..(127): n is a, c, g, or t
tcagcgcagtacgacacgaccggtgctcgatttagtcacgcgagaaagggaaaggggctggccctgacgtgtttctgttcccacccttctctatacgatcgctgagcgggctggcaaggcgcatagn

SEQ ID NO: 248067 - DNA, 127 bp, Homo sapiens; identical to SEQ ID NO: 248039
  misc_feature: GYAE6OF02JCABV.52.41.D08.1.454.CMB.1.raw
  modified_base (127)..(127): a, c, t, g, unknown or other
  misc_feature (127)..(127): n is a, c, g, or t

SEQ ID NO: 248068 - DNA, 147 bp, Homo sapiens
  misc_feature: GYAE6OF02G79WH.52.41.D08.1.454.CMB.1.raw
  modified_base (127)..(147): a, c, t, g, unknown or other
  misc_feature (127)..(147): n is a, c, g, or t
tcagcgcagtacgacacgaccggtgctcgatttagtcacgcgagaaagggaaagggggctggccctgacgtgtttctgttcccacctcctctatacgatcgctgagcgggctggcaaggcgcatagnnnnnnnnnnnnnnnnnnnnn

SEQ ID NO: 248069 - DNA, 139 bp, Homo sapiens
  misc_feature: GYAE6OF02IZTJX.52.41.D08.1.454.CMB.1.raw
  modified_base (128)..(139): a, c, t, g, unknown or other
  misc_feature (128)..(139): n is a, c, g, or t
tcagcgcagtacgacacgaccggtgctcgatttagtcacgcgagaaagggaaagggggctggccctgacgtgtttctgttcccaccctcctctatacgatcgctgagcgggctggcaaggcgcatagnnnnnnnnnnnn

SEQ ID NO: 248070 - DNA, 128 bp, Homo sapiens; identical to SEQ ID NO: 248046
  misc_feature: GYAE6OF02GFB9J.52.41.D08.1.454.CMB.1.raw
  modified_base (127)..(128): a, c, t, g, unknown or other
  misc_feature (127)..(128): n is a, c, g, or t

SEQ ID NO: 248071 - DNA, 137 bp, Homo sapiens
  misc_feature: GYAE6OF02GGAHZ.52.41.D08.1.454.CMB.1.raw
  modified_base (120)..(120): a, c, t, g, unknown or other
  misc_feature (120)..(120): n is a, c, g, or t
  modified_base (125)..(137): a, c, t, g, unknown or other
  misc_feature (125)..(137): n is a, c, g, or t
tcagcgcagtacgacacgaccggtgctcgatttagtcacgcgagaaagggaaggggcgtggccctgacgtgtttctgttcccacctcctctatacgatcgctgagcgggctggcaaggcnatagnnnnnnnnnnnnn

SEQ ID NO: 248072 - DNA, 140 bp, Homo sapiens
  misc_feature: GYAE6OF02HEJNC.52.41.D08.1.454.CMB.1.raw
  modified_base (128)..(140): a, c, t, g, unknown or other
  misc_feature (128)..(140): n is a, c, g, or t
tcagcgcagtacgacacgaccggtgctcgatttagtcacgcgagaaagggaaagggggctggccctgacgtgtttctgttcccgccctcctctatacgatcgctgagcgggctggcaaggcgcatagnnnnnnnnnnnnn

SEQ ID NO: 248073 - DNA, 136 bp, Homo sapiens
  misc_feature: GYAE6OF02FT93Y.52.41.D08.1.454.CMB.1.raw
  modified_base (127)..(136): a, c, t, g, unknown or other
  misc_feature (127)..(136): n is a, c, g, or t
tcagcgcagtacgacacgaccggtgctcgatttagtcacgcgagaaagggaaaggggctggccctgacgtgtttctgttcccgccctcctctatacgatcgctgagcgggctggcaaggcgcatagnnnnnnnnnn

SEQ ID NO: 248074 - DNA, 127 bp, Homo sapiens
  misc_feature: GYAE6OF01A3026.41.41.D08.1.454.CMB.1.raw
  modified_base (127)..(127): a, c, t, g, unknown or other
  misc_feature (127)..(127): n is a, c, g, or t
tcagtctatactatcacgaccggtgctcgatttagtcacgcgagaaagggaaaggggctggccctagcgtgttcctgttcccaccctcctcatagtatagactgagcgggctggcaaggcgcatagn

SEQ ID NO: 248075 - DNA, 127 bp, Homo sapiens
  misc_feature: GYAE6OF01DKKI0.41.41.D08.1.454.CMB.1.raw
  modified_base (127)..(127): a, c, t, g, unknown or other
  misc_feature (127)..(127): n is a, c, g, or t
tcagtctatactatcacgaccggtgctcgatttagtcacgcgagaaagggaaaggggctggccctgacgtgtttctgttcccgccctcctcatagtatagactgagcgggctggcaaggcgcatagn

SEQ ID NO: 248076 - DNA, 127 bp, Homo sapiens
  misc_feature: GYAE6OF01EHX28.41.41.D08.1.454.CMB.1.raw
tcagtctatactatcacgaccggtgctcgatttagtcacgcgagaaagggaaagggggctggccctgacgtgtttctgttcccaccctcctcatagtatagactgagcgggctggcaaggcgcatag

SEQ ID NO: 248077 - DNA, 125 bp, Homo sapiens
  misc_feature: GYAE6OF01C6WAC.41.41.D08.1.454.CMB.1.raw
tcagtctatactatcacgaccggtgctcgatttagtcacgcgagaaagggaaggggctggccctagcgtgttcctgttcccgccctcctcatagtatagactgagcgggctggcaaggcgcatag

SEQ ID NO: 248078 - DNA, 150 bp, Homo sapiens
  misc_feature: GYAE6OF01C8Q3P.41.41.D08.1.454.CMB.1.raw
  modified_base (131)..(150): a, c, t, g, unknown or other
  misc_feature (131)..(150): n is a, c, g, or t
tcagtctatactatcacgaccggtgctcgatttagtcacgcgagaaagggaaagggggctggccctagcgtgttcctgttcccgccctcctccatagtatagactggacgcgggctggcaaggcgcatagnnnnnnnnnnnnnnnnnnnn

SEQ ID NO: 248079 - DNA, 128 bp, Homo sapiens
  misc_feature: GYAE6OF01BZ4VG.41.41.D08.1.454.CMB.1.raw
  modified_base (128)..(128): a, c, t, g, unknown or other
  misc_feature (128)..(128): n is a, c, g, or t
tcagtctatactatcacgaccggtgctcgatttagtcacgcgagaaagggaaagggggctggccctgacgtgtttctgttcccaccctcctcatagtatagactgagcgggctggcaaggcgcatagn

SEQ ID NO: 248080 - DNA, 709 bp, Homo sapiens
  misc_feature: GYAE6OF01AXUCT.41.41.D08.1.454.CMB.1.raw
  modified_base (204)..(204): a, c, t, g, unknown or other
  misc_feature (204)..(204): n is a, c, g, or t
tcagtctatactatcacgaccggtgctcgatttagtcacgcgagaaagggaaagggggaggaactgctcagttaggacccagagggaaccatggaagccccagctcagcttctcttcctcctgctactctggctcccagagatcaccggagatattgtgttgacacagtctccaggccaccctgtctttgtctccgaggggganagacgcccaccctctcctggtacgggccaggtcggagttgttgactaacgtacctagcctaggtaaccaaacgaacgtaaacccgtcgggacccaagggtccctaccccgacggtcccttccctacacttcctaatgactgacctactacccgaacgagggtccacgtcggacccaccccgagtaccgtaggttcaggtcggcgtagggtggggtacgtggggaactacggtacgttcacctctaccaacctatccgagccacgtccgtgacgtacgtcgtaaggtaagttgtttacgtacgtttaagttttacttacgtcgtacgtagtacgttaaagttagtaacgttcggtaaccgttccggtaccccgttacccggttaccggaaccggtaacggggtacctacggtacggtaaggtaacgtaaacgttaaaccggtagtcgggtacgcgtacgacccgtacgttacttcgttaccgttacttacgtccttcccgtacccg

SEQ ID NO: 248081 - DNA, 128 bp, Homo sapiens; identical to SEQ ID NO: 248079
  misc_feature: GYAE6OF01EG5AJ.41.41.D08.1.454.CMB.1.raw
  modified_base (128)..(128): a, c, t, g, unknown or other
  misc_feature (128)..(128): n is a, c, g, or t

SEQ ID NO: 248082 - DNA, 108 bp, Homo sapiens
  misc_feature: GYAE6OF02F22TF.41.41.D08.1.454.CMB.1.raw
  modified_base (108)..(108): a, c, t, g, unknown or other
  misc_feature (108)..(108): n is a, c, g, or t
tcagtctatactatcacgaccggtgctcgatttagtcacgcgagaaagggaaggtctgttcccaccctcctcatagtatagactgagcgggctggcaaggcgcatagn

SEQ ID NO: 248083 - DNA, 126 bp, Homo sapiens
  misc_feature: GYAE6OF02F5EXZ.41.41.D08.1.454.CMB.1.raw
  modified_base (126)..(126): a, c, t, g, unknown or other
  misc_feature (126)..(126): n is a, c, g, or t
tcagtctatactatcacgaccggtgctcgatttagtcacgcgagaaagggaaggggctggccctagcgtgttcctgttcccgccctcctcatagtatagactgagcgggctggcaaggcgcatagn

SEQ ID NO: 248084 - DNA, 126 bp, Homo sapiens
  misc_feature: GYAE6OF02FM501.41.41.D08.1.454.CMB.1.raw
tcagtctatactatcacgaccggtgctcgatttagtcacgcgagaaagggaaagggggctggccctgacgtgtttctgttcccaccctctcatagtatagactgagcgggctggcaaggcgcatag

SEQ ID NO: 248085 - DNA, 138 bp, Homo sapiens
  misc_feature: GYAE6OF02JM8UZ.41.41.D08.1.454.CMB.1.raw
  modified_base (127)..(138): a, c, t, g, unknown or other
  misc_feature (127)..(138): n is a, c, g, or t
tcagtctatactatcacgaccggtgctcgatttagtcacgcgagaaagggaaaggggctggccctagcgtgttcctgttcccaccctcctcatagtatagactgagcgggctggcaaggcgcatagnnnnnnnnnnnn

SEQ ID NO: 248086 - DNA, 766 bp, Homo sapiens
  misc_feature: GYAE6OF01ARCSB.47.64.F09.1.454.CMB.1.raw
tcagagctcacgtacacgaccggtgctcgatttagcgcgtatacaaggggtagggtaactcgcctcagttagggacccgagagggaaccactggaagccccgacgctccaggcttctaccttcctcctggcttacgtcctggctcccgagagtaccctagtcggacgtaagttacttttgaccacagtctccagcctacccgtgtcctttcgtctccaaggggtaaagtggtccctaccctcggtcccttggccgagggccacgtccaagggaggtgttggacagcttacgtagcctggtaccaacagaaaccgtggacctaggctacccaggtcctcctcatacgtatcggaatcgaccattccaacgtgggcccaactcggccaagtccccaagtccctaaggtttccaggtaggcaggtgtacgtcgtggggaacctacggtactttcgaaccttccggttccttaaaccctattccgaaggcccgtaacggacccgtaacggacgtacccgttaaggtaaacggttaagttttttggaacgtttaacgtttttaacgttttaaccgttacgttacccgtaagtaccgtaacgggtaccgggttaacgtaccgtaaacccgttcggggtacccttaccgggttacctaccggttttccgggaccgggtaacgggtacccgtacgggtacggaccgtacgtaccgaacggaccgtaacgttcggtacggtcccgtcggacccacctacgtcctagtccgttacc

SEQ ID NO: 248087 - DNA, 705 bp, Homo sapiens
  misc_feature: GYAE6OF01D03Y5.47.64.F09.1.454.CMB.1.raw
tcagagctcacgtacacgaccggtgctcgatttagcgcgtatacaaggggtaggaactgctcgaagttaggaccccagacgggaaccatggtaacgccccgagcttccaagtcgttctcttcctcctgctactactggctacccagactaccagtcggtacgaaagttgtgttgacgttacctaggttctccagtaaccacctcgtctttgtctaccgaggggaaagacgccgacccgtctcctgggacgacgggccaagtcgacggggtaactagtcactcctacttagccgtggtacccaacaggaaaaccttggtacagggtctacccaggcttcctcactctagtcgattggcctactaccggaaccggaggggccacgtggtcgtactccccaagtactaggttacctagggtggcgaggtaggggtacctaggggaactaggaccttacgaccttcgtccgaaccgaagttccgagtaccacgaccctaacgacgaccgtagaaacgtactttcggaaactttaacttacctgtactacgcgacgtacgtggacgttcgtcggtccctccgtcctacgtacgtttccgggaccggggtacccgtagggttcggtaagtagtaccggtaaacggtacgtagggtcggtcgtaggaccgtacgacgttcgtacgttaccgtacccgtcgttccgtaccccg

SEQ ID NO: 248088 - DNA, 499 bp, Homo sapiens
  misc_feature: GYAE6OF01CBPLU.47.64.F09.1.454.CMB.1.raw
  modified_base (495)..(495): a, c, t, g, unknown or other
  misc_feature (495)..(495): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctctactttcggcggagggaccagggtggagatacaaacgaactgtggctgcacatctgtcttnatcc

SEQ ID NO: 248089 - DNA, 515 bp, Homo sapiens
  misc_feature: GYAE6OF01EES8X.47.64.F09.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccatcctgtctttgtctccaggggaaagngccaccctctcctgcagggccagtcagaatattcactcctacttagcctggtaccaacagaaacctggtcaggctcccaggctcctcatctatgatgcatccaacngggccactggcatcccagacaggttcagtggcaggtgggtctgggacagacttcactctcaccatcagcagcctagagcctagaagtactttggtactttattactgtcagcagcgtgagttctggcctccgcttcctacgtttcgggcggacgggaccgaggggtggagagtacgaaacgtatggtggctgccacatcttcgtcttctacg

SEQ ID NO: 248090 - DNA, 516 bp, Homo sapiens
  misc_feature: GYAE6OF01C2TVO.47.64.F09.1.454.CMB.1.raw
  modified_base (196)..(196): a, c, t, g, unknown or other
  misc_feature (196)..(196): n is a, c, g, or t
  modified_base (510)..(510): a, c, t, g, unknown or other
  misc_feature (510)..(510): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacgagggccactggcatcccagacaggttcagtggcagtgggtctgggacagacttcactctcaccatcagcagctagagcctagaagtactttggactttattactgtcagcagtcgtgagttcgtggtcctccgctcgtacgtttcggcggtaggaccgagggtggagacgtacgaaacgtacgtggtggctgcactactctgtcttcncttccg

SEQ ID NO: 248091 - DNA, 586 bp, Homo sapiens
  misc_feature: GYAE6OF01B26OC.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggctcctcatctatgatgcgtccaccaggccactggtttcccagccaggttcagtggcagtgcgtctgggacaggagttcactctcaccatcaacacgcctgcagtctagaagtattttgctagtttattactgtacagtacaaacgttaaatacgtcggcctccgctaccgtacgtttcgggcgggtacgggaccgtaggggtcggaacgagtacggaaaacgtacgtggtacggcttaggacctaacccgtacgttaccgttcggttacctttaccgtaactttccccgttccccggtcccttaaccg

SEQ ID NO: 248092 - DNA, 500 bp, Homo sapiens
  misc_feature: GYAE6OF01BNR7I.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatccccagccaggttcagtggcagtgagtctgggacagacttcactctcaccatcagcagcctagagcctgaagtattttgctactttattactgtcagcagcgtagcaactggcctctctactttcggcggtagggaccgagggtggagagtcgagacgaacgtgtggctcgcaccatctgtcttc

SEQ ID NO: 248093 - DNA, 536 bp, Homo sapiens
  misc_feature: GYAE6OF01C22BY.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggcctcctcatctatgatgcatccaacagggccacgtggcatcccagacaggttcagtggcaggtgggtctgggacagacttcactctcacatcagcagcctagacgcctagaagtactttggtactttattactgtcagcagtcgtgagttcgtcggtcctccgctccgtacgtttccgggcgggtacgggaccgaggggtggagacgtacgaaacggtacgtggtcggctcgaccacctatcttgtcttcgtctcccg

SEQ ID NO: 248094 - DNA, 518 bp, Homo sapiens
  misc_feature: GYAE6OF01B163H.47.64.F09.1.454.CMB.1.raw
  modified_base (196)..(196): a, c, t, g, unknown or other
  misc_feature (196)..(196): n is a, c, g, or t
  modified_base (512)..(512): a, c, t, g, unknown or other
  misc_feature (512)..(512): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggcctccaggctcctcatctatgatgcatccaacagggccactggcatcccagacaggttcagtggcagtgggtctgggacagacttcactctcaccatcagcagcctagacgcctagaagtactttggtactttattactgtcagcagcgtgagttctggcctcgctctacgtttcggcgggacgggaccgagggtggagtacgtacgaaacggtacgtggtggctgcacctatctgtcttcgnttcccg

SEQ ID NO: 248095 - DNA, 522 bp, Homo sapiens
  misc_feature: GYAE6OF01BLW01.47.64.F09.1.454.CMB.1.raw
  modified_base (196)..(196): a, c, t, g, unknown or other
  misc_feature (196)..(196): n is a, c, g, or t
  modified_base (516)..(516): a, c, t, g, unknown or other
  misc_feature (516)..(516): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagacgcctgaagtactttggtactttattactgtcagcagcgtgagttctggcctccgctcgtacgtttcggcggacgggaccgagggtggagacgtacgaaacgacgtggtggtctgccaccgtacttctgttccttcgnttcccg

SEQ ID NO: 248096 - DNA, 581 bp, Homo sapiens
  misc_feature: GYAE6OF01CYQWI.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (363)..(363): a, c, t, g, unknown or other
  misc_feature (363)..(363): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaanagaaacctggtcaggctcccaggctcctcatctatgatgcatccaacagggcccactggcactcccagacaggttcagtggcaggtgggtctgggacagacttcactcncacatcagcagcctagagcctagaagtactttggaactttatactgtcagcagtcgtgtacgttcgtcggtcctccgtcttccgtacgtttcgggacgggtacgggaccgtaggggtcggaacggtaacgttaccgaaaacggtaacgttgggtacgggtccttacggaccctaacccgtacgttaccgttaggtttaccttcctaccgtttcccccg

SEQ ID NO: 248097 - DNA, 498 bp, Homo sapiens
  misc_feature: GYAE6OF01D7B9H.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaanagtcaccctctcctgcagggccagtcagaatattcactcctacttagcctggtaccaacagaaacctggtcaggctcccaggctcctcatctatgatgcgtccaccagggccactggtttcccagccaggttcagtggcagtgcgtctgggacagagttcactctcaccatcagcagcctgcagtctgaagtattttgctagtttatactgtcagcagtataatactggcctcgcttcggccaggacacgactggagtataaacgactgtggctgcacagtctgtcttacattcctccgctac

SEQ ID NO: 248098 - DNA, 516 bp, Homo sapiens
  misc_feature: GYAE6OF01CO7GH.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaanagaaacctggtcaggctcccaggctcctcatctatgatgcatccaacaggccactggcatcccagacaggttcagtggcaggtgggtctggggacagacttcactctcaccatcagcagcctagacgcctgaagtactttggaactttatactgtcagcagcgtgagttctggcctccgctctacgtttcgggcggacgggaccagggtgagatacgaaaacggtctggtcggctggccaccgtatctgtcttcgattcccg

SEQ ID NO: 248099 - DNA, 520 bp, Homo sapiens
  misc_feature: GYAE6OF01B2BWS.47.64.F09.1.454.CMB.1.raw
  modified_base (195)..(195): a, c, t, g, unknown or other
  misc_feature (195)..(195): n is a, c, g, or t
  modified_base (363)..(363): a, c, t, g, unknown or other
  misc_feature (363)..(363): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaanagccaccctctcctgcagggccagtcagaatattcactcctacttagcctggtaccacagaaacctggtcaggctcccaggctcctcatctatgatgcatccaacagggccactggcatcccagacaggttcagtggcagtggtctgggacagacttcactctcaccntcagcagcctagagcctagaagtactttggactttattactgtcagcagcgtgagttctggcctccgctcgtacgtttcggcggtagggaccgaggggtcgaggactacgaaacgtaacgtggtcggctcggcacctattctgttcttcgcttcccg

SEQ ID NO: 248100 - DNA, 553 bp, Homo sapiens
  misc_feature: GYAE6OF01AJZ3S.47.64.F09.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaanagaaacctggtcaggctcccaggctcctcatctatgatgcatcccaacaggccactggcatccccagacaggttcagtggcagtgggtctgggacagacttcactctcacatcagcagcctagacgcctgaagtactttaggtactttattactgtcagctagcgtgagttctggtcctccgcttcctacgtttccgggcgggtaggggacccgaggggtacggaggtacgtacgaaaccggtaacttggtcggcgttacgcgtacctacgttccttagtcctttccacgtttccccg

SEQ ID NO: 248101 - DNA, 556 bp, Homo sapiens
  misc_feature: GYAE6OF01BLVVU.47.64.F09.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
  modified_base (345)..(345): a, c, t, g, unknown or other
  misc_feature (345)..(345): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtcttgtctccaggggaaangccaccctctcctgcagggccagtcagaatattcactcctacttagcctggtaccaanagaaacctggtcaggctcccaggctcctcatctatgatgcatccaacgcggccactggcatcccagacaggttcagtgcagtggtctggganagacttcactctcaccatcagcagctagagctagaagtacgttaggtactttattacttgtctagcagtcgtgtacgttcgtcggtccttccgctcgtaccgtttcgggcggtacgggaccgtagggtaggacgtagtacgaaacggtaacgtaggtacggtcgtacgaccgaccctacgttaccgttacgttccttacgtccgttacccg

SEQ ID NO: 248102 - DNA, 535 bp, Homo sapiens
  misc_feature: GYAE6OF01C68TU.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (362)..(362): a, c, t, g, unknown or other
  misc_feature (362)..(362): n is a, c, g, or t
  modified_base (513)..(513): a, c, t, g, unknown or other
  misc_feature (513)..(513): n is a, c, g, or t
  modified_base (524)..(524): a, c, t, g, unknown or other
  misc_feature (524)..(524): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcgggagaagttgtgttgacacagtctccagccaccctgtctttgctccaggggaaangccaccctctcctgcagggccagtcagaatattcactcctacttagcctggtaccaanagaaacctggtcaggctcccaggctcctcatctatgatgcatccaacagggccacgtggcactcccagacaggttcagtggcagtgggtctgggacagacttcactcncaccatcagcagcctagacgcctagaagtattttgcttaagtttattactgtcagactaacgtaatactcggcctccgctcgtaccgtttcgggcggagggaccgagggtacggactagtacgaaacgtacgtggtaggcgtcgactaccnttctgtcttcncttccgtcccg

SEQ ID NO: 248103 - DNA, 516 bp, Homo sapiens
  misc_feature: GYAE6OF01BWQVE.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctcccaggctcctcatctatgatgcatccaacagggccacgtggcatcccagacaggttcagtggcagtgggtctgggacagacttcactctcaccatcagcagcctagacgcctgaacgtactttggtactttattactgtcagcagcgtgtagttctggcctccgctctacgtttcggcggagggaccgagggtggagagtacgaaacgacgtgtcggctgcacctactctgtcttcattcccg

SEQ ID NO: 248104 - DNA, 540 bp, Homo sapiens
  misc_feature: GYAE6OF01A5G3A.47.64.F09.1.454.CMB.1.raw
  modified_base (385)..(385): a, c, t, g, unknown or other
  misc_feature (385)..(385): n is a, c, g, or t
  modified_base (535)..(535): a, c, t, g, unknown or other
  misc_feature (535)..(535): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccggctcccaggctcctcatctgggatgcatccaacagggccgctggcatcccagccaggttcagtgcaggtggctggacagtacttcactctcacatcagcagcctagacgctgaagtntttgactagtttattactgtcagactaacgtaatactggtcctccgctcgtacgtttcgggacgggacgggtaccgaggggttcgacgagtacggaaaccgaagtggtacggctggacacctatcctgttacttccattccctcccgctnttccg

SEQ ID NO: 248105 - DNA, 659 bp, Homo sapiens
  misc_feature: GYAE6OF01C87XE.47.64.F09.1.454.CMB.1.raw
  modified_base (193)..(193): a, c, t, g, unknown or other
  misc_feature (193)..(193): n is a, c, g, or t
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccaccctgtcttgctccgagggaaangccacctctcctgcagggccagtcagtaatattcactctattagcctgtacaanagaactgtcagctaccagctcncatctatcgatgcataccaacgacgggccaccgtggaccactcccagacaggttcaggtggcaggtcggtcgtggggacaggtacttccacttctaccacctatcacgcaacgtcctaagacgtaccgtaggaaacgttacgttttagggtaaccttttaacttaacgtttacgtaccgtaagtccgtaacggtccggttaggtaacggtttcctacggggtccccttcccggtccttacccgttaccggtttccggggaccggggtaacggggtacccgggaaggggttcggaaggtaaacgtaaccgaaaaacgggtacgtaacgggttcggccttacgggtacccaccgtacgttactacggtttaccttcgtacccgtttaccccg

SEQ ID NO: 248106 - DNA, 510 bp, Homo sapiens
  misc_feature: GYAE6OF01BNNVZ.47.64.F09.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
  modified_base (506)..(506): a, c, t, g, unknown or other
  misc_feature (506)..(506): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagaagttattttgacacagtctccagccaccctgtctttgtctccaggggaaangccaccctctcctgcagggtcagtcagagtgttgacagctacttagtctggtaccaagagaaacctggccaggttcccaggctcctnatctgggatgcatccaacagggccnctggcatcccagccaggttcagtggcagtgggtcnggacagagttcactctcaccatcaacngcctgcagtctgaagtatttgctagtttattactgtcagctagtatcataactgccgctcaccttcggaccaagggacacgactggaacgtattaaacgactggtgctgccacatctgtcttcaattccttcccgntacg

SEQ ID NO: 248107 - DNA, 531 bp, Homo sapiens
  misc_feature: GYAE6OF01CWMQF.47.64.F09.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccgtctcctgcagggccagtcagngtgttggcagctacttagcctggtaccaacagaaacctggccaggctcccaggctcctcatctatgatgcgtccaccagggccactcggtttcccagccaggttccagtggcagtgcgtctgggacagactcactctcaccatcagcagcctagacgcctagaagtatttgctagtttattacttgtacagacaacgtaatactcggcctccgctctacgtttcgggcggagggaccgaggggtcgacgagtaggaaacgacgtggtggctcggcacctatcgttctcttcacttccttcccgtacc

SEQ ID NO: 248108 - DNA, 525 bp, Homo sapiens
  misc_feature: GYAE6OF01DCCBZ.47.64.F09.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggcctcctcatctatgatgcatccaacngggccactggcactcccagacaggttcaggtggcaggtgggtctgggacagtacttcacttctcaccatcagcagcctagacgcctagaagtactttggtactttaattactgtacagcagtcgtgagttctcggcctccgctcgtacgtttcgggcggacgggaccggagggtggagacgtacgaaacggtacgtgtggctgcacntctntctntntccg

SEQ ID NO: 248109 - DNA, 494 bp, Homo sapiens
  misc_feature: GYAE6OF01D0HBR.47.64.F09.1.454.CMB.1.raw
  modified_base (196)..(196): a, c, t, g, unknown or other
  misc_feature (196)..(196): n is a, c, g, or t
  modified_base (406)..(406): a, c, t, g, unknown or other
  misc_feature (406)..(406): n is a, c, g, or t
  modified_base (455)..(455): a, c, t, g, unknown or other
  misc_feature (455)..(455): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagagtattagcagcaacttagcctggtaccagcagaaacctgggcaggctcccaggctcctcatctatggtgcatccaccagggcccactggtactcccagccaggttcagtggcagtgggtctggggacaggagttcactctcaccatcagcagcctgcagtctgaagtatttgactaatttnttactgtcagctagtataatactgcctcgcttcgcaaggcacgactganataacgacgtgtagctgacacatctntcttcntcgtccg

SEQ ID NO: 248110 - DNA, 496 bp, Homo sapiens
  misc_feature: GYAE6OF01A071T.47.64.F09.1.454.CMB.1.raw
  modified_base (195)..(195): a, c, t, g, unknown or other
  misc_feature (195)..(195): n is a, c, g, or t
  modified_base (370)..(370): a, c, t, g, unknown or other
  misc_feature (370)..(370): n is a, c, g, or t
  modified_base (485)..(485): a, c, t, g, unknown or other
  misc_feature (485)..(485): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctgtctctccaggggaanagccaccatctcctgtagggccgtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacngcctagacgcctgaagtattttgctactttattactgtcagcagcgtagcaactggcctctctactttcggcggagggacagggtggagatcgagacgaatggtggctgcacatntcgtcttctac

SEQ ID NO: 248111 - DNA, 516 bp, Homo sapiens
  misc_feature: GYAE6OF01BGEHJ.47.64.F09.1.454.CMB.1.raw
  modified_base (196)..(196): a, c, t, g, unknown or other
  misc_feature (196)..(196): n is a, c, g, or t
  modified_base (512)..(512): a, c, t, g, unknown or other
  misc_feature (512)..(512): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctggggacagacttcactctcaccatcagcagcctagagcctagagtactttggtactttattactgtcagcagcgtgagttcgtggcctccgctcgtacgtttcggcggtagggaccgagggtggagagtacgaaacgtacgtggtggcgtcgcactatctgtcttcntccc

SEQ ID NO: 248112 - DNA, 530 bp, Homo sapiens
  misc_feature: GYAE6OF01B3FOL.47.64.F09.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (383)..(383): a, c, t, g, unknown or other
  misc_feature (383)..(383): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctattagcctggtaccaanagaaacctggtcaggctccaggctcctcatctatgatgcatccaacagggccactggcatccccagacctaggttcagtggcaggtgggctggggacaggacttcgactctcaccagtcagcagcctagngcctgaagtctttggactttatactgtacagctagtcgtgtacgttcgtcggtcctccgtctcgttaccggttcggcggacggccgagggtgagtacacgaacgtagtggacggcncgaccncgtactctgttcctgtccttccccg

SEQ ID NO: 248113 - DNA, 662 bp, Homo sapiens
  misc_feature: GYAE6OF01CANQH.47.64.F09.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangcccaccctctcctgcagggccagtcagaatatcactcctacttagcctggtaccanagaactgtcagctccagctcctnatctatgatgcatccaagacgggccacgtggcactcccaagacctagtcgagaggcgaggtgggtcgtcggtacgagtacttctacctctccacactacgacgacacgtacgtacgtacgaccgtacgtaagtaacgtttacggttaacgtttaactttacgtacgttcgtacgacgtacgtacggtcggtacgtttaccgttcggtcccgtccgtccgttccgttaccggtttccgggtaccggggtacgggtaccggtacggggttcgggtaacggtaaccggtaaccggtaaaccggtaaccggttaggttacgggtccgttacgtaccgtacccgttaacgttaccgtttacggtttaccgtttcccgttcgttacccccg

SEQ ID NO: 248114 - DNA, 508 bp, Homo sapiens
  misc_feature: GYAE6OF01EQ9IL.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcaggtggtctgggacagacttcactctcaccatcagcagctagacgcctgaagtactttggactttattactgtcagcagcgtgtagttctggcctccgctcgtactttcggcggagggacgagggtggagatacgaaacggtactggtggctgcactatctgtcttcagttccc

SEQ ID NO: 248115 - DNA, 561 bp, Homo sapiens
  misc_feature: GYAE6OF01CQS52.47.64.F09.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctnacttgcattgtctctggtgctccatcactagtttaatnttggtgggctggatccgccagccccgagggaaggggctggaatggatgggagtattatttataagtgggactactctttacaaccctatccctcaagagtcgacgtttccatactccgcagacacgtcgagactcacttctcctagaactgacgctctgtcgacccgccgacagacacggcttcgtttatacttgttacgagtacagtcgccgacgagtagctaattagcggctaaggttacgggtttgaagttagtttcggggacaaggggtacgtaacggggtcacccggttctccggacacgcccgtccgaaacccgg

SEQ ID NO: 248116 - DNA, 566 bp, Homo sapiens
  misc_feature: GYAE6OF01ASCGZ.47.64.F09.1.454.CMB.1.raw
  modified_base (196)..(196): a, c, t, g, unknown or other
  misc_feature (196)..(196): n is a, c, g, or t
  modified_base (372)..(372): a, c, t, g, unknown or other
  misc_feature (372)..(372): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagatattcactcctacttagcctggtaccaacagaaacctggtcaggctcccaggctcctcatctatgatgcactaccaacgacgggccacgtcggcactcccagactggttcaggtgcaggtggtcgtgggacagtcttcactctcacntcagcagcctagacgcctagaacgtactttggtactttacttactgtacagctagtcgtagtacgttcgtcggtccctccgtctctaccgtttcgggcggtacggggacctaggggtggaagacgtaaccgaaaacgtccgttggtacggccgtcgacccaacgtcttccgttagttccgttctacgttccccg

SEQ ID NO: 248117 - DNA, 519 bp, Homo sapiens
  misc_feature: GYAE6OF01BAO3M.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcactcccagccaggttcagtggcagtgagtctgggacagacttcactctcaccatcagcagcctgcagtctgaagtattttgactaatttattactgtacagactaacgtaatactcggtcctccgctctaccgtttcggcggtacgggaccgagggtcgacgagtacgaaacgtacgtggtggctcgacactatctgttctgtac

SEQ ID NO: 248118 - DNA, 524 bp, Homo sapiens
  misc_feature: GYAE6OF01BFU6X.47.64.F09.1.454.CMB.1.raw
  modified_base (196)..(196): a, c, t, g, unknown or other
  misc_feature (196)..(196): n is a, c, g, or t
  modified_base (360)..(360): a, c, t, g, unknown or other
  misc_feature (360)..(360): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggctcccagagaccactggagaaatagtgatgacgcagtctccagccaccctgtctgtctctccaggggaaanagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactntcacatcaacagcctgcagtctgaagtattttgctagtttattactgtcagtcagtatctataactggcccgtcttccaccctttcggcccaaagggccaacgtacctgggagtaagttaaacgaacttggtaggtctaggcaaccctatcctggttcttaccg

SEQ ID NO: 248119 - DNA, 585 bp, Homo sapiens
  misc_feature: GYAE6OF01D3HGZ.47.64.F09.1.454.CMB.1.raw
  modified_base (300)..(300): a, c, t, g, unknown or other
  misc_feature (300)..(300): n is a, c, g, or t
  modified_base (424)..(424): a, c, t, g, unknown or other
  misc_feature (424)..(424): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagagtattagcagacaacttagcctaggtaccagcaagaaccgtgggcaggcctccgaggcctcctcatctagtggtncactcccaccgagggccacgtggtactcccgagccgtaggttcaggtggcgtaggttcggggtcgtaggggacagttactttccacttctccaaccgatacagcacgcctgcacgcctagaatntgttagactaactttattactagtaactaaaatataactagtccgcccgtctacgtacgttcgggacggaacggacgtaagggtgaagactacgaaacgtacgtggtacggctacgacctacgtacttccgttacgttccttacttcgttcccgtaccccg

SEQ ID NO: 248120 - DNA, 559 bp, Homo sapiens
  misc_feature: GYAE6OF01CJI9Z.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (323)..(323): a, c, t, g, unknown or other
  misc_feature (323)..(323): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaaggggaaangccaccctctcctgcagggccagtcagaatattcactcctacttagcctggtaccaanagaaacctggtcaggctccaggctctcatctatgatgcatccaacacgggccactggcactcccagacnggttcagtggcaggtgggtctgggacagacttcgactctcacatcagcagcctagcgcctagaacgtactttggaacttttattactgtctagcagcgtgtagttctggcctccgcttccgtacgtttcgggacggtaggggaccctagggggtggacggtaacgtaccgaaaacggtaaccttgggtacggcgttcgacccacgtactacgttcgttcctttcgacgtttccccg

SEQ ID NO: 248121 - DNA, 518 bp, Homo sapiens
  misc_feature: GYAE6OF01B69E1.47.64.F09.1.454.CMB.1.raw
  modified_base (197)..(197): a, c, t, g, unknown or other
  misc_feature (197)..(197): n is a, c, g, or t
  modified_base (499)..(499): a, c, t, g, unknown or other
  misc_feature (499)..(499): n is a, c, g, or t
  modified_base (509)..(509): a, c, t, g, unknown or other
  misc_feature (509)..(509): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagacgcctagaagtactttggtactttattactgtcagtcagcgtgtagttctggcctccgctctacgtttcgggcggagggaccgagggtggactacgttaaacgacgtggtggctgcacntctgtcttcnctcgtcccg

SEQ ID NO: 248122 - DNA, 580 bp, Homo sapiens
  misc_feature: GYAE6OF01A7BZW.47.64.F09.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggccagtcagaatattcactcctacttagcctggtaccaacagaaacctggtcaggctcccaggcctcctcatctatgatgcatccaaacgngggccacgtggcactcccagactaggttcagtggctaggtgggtctgggacagacttcactctcacatcagcagcctaagacgtcctaggaacgtacgtttacggtacttttagttaactgtaccagtctagtcgtagtacgttcgtcggcccttcgcttcgtacgtttcggggcggacgggaccgtaggggtacggagtacgtacgaaaacggtacgtggtcggactcggccaccgattccgtcgttccttactacttcccgttccccgtacc

SEQ ID NO: 248123 - DNA, 529 bp, Homo sapiens
  misc_feature: GYAE6OF01ECU9Q.47.64.F09.1.454.CMB.1.raw
  modified_base (196)..(196): a, c, t, g, unknown or other
  misc_feature (196)..(196): n is a, c, g, or t
  modified_base (522)..(522): a, c, t, g, unknown or other
  misc_feature (522)..(522): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacgagggccactggcatcccagacaggttcagtggcaggtgggtctgggacagtacttcactctcaccatcagcagcctagacgcctagaagtactttggtactttattactgtcagcagcgtgtagttctggccctccgctcgtacgtttcgggcgggacgggaccgaggggtggagtactacgaaacggtacgtggtggctgcaccgtactctgttcttcncttcccg

SEQ ID NO: 248124 - DNA, 603 bp, Homo sapiens
  misc_feature: GYAE6OF01A51F8.47.64.F09.1.454.CMB.1.raw
  modified_base (391)..(391): a, c, t, g, unknown or other
  misc_feature (391)..(391): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccatcggagaagttgtgttgacacagtctccagcccaccctgttctttgtcctccgaaggggaaagcgcccaccctctcctgcgagggccagtcagaatattcactcctacttagcctggtaccaacagaacctggtcaggctcccaggctcctcatctatgatgcactaccaacgacgggccacgtcggccactcccagacgtaggttcaggtggcaggtcgggtctggggactagtacttcactctaccactntccagcacgcctagacgtcctaggaacgtacgtttaggtaacttttagttactgtacacggcagtcgttgtacgttcgtcggcccttccgcttccgtacgtttccgggacgggtacgggaccgtaggggtggtaagtactaacgaaacgtacgttcggtagggtcctcggacctaaccgtacttaccgttgttcccttcgtacctttccccg

SEQ ID NO: 248125 - DNA, 519 bp, Homo sapiens
  misc_feature: GYAE6OF01BSNAZ.47.64.F09.1.454.CMB.1.raw
  modified_base (303)..(303): a, c, t, g, unknown or other
  misc_feature (303)..(303): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacngggccactggcatcccagacaggttcagtggcagtgggtctgggacaggacttcactctcacatcagcagcctagacgtcctgaagtactttaggacttttaattactgtcagctagcgtgagttctcggcctccgctctacgtttcggcggagggaccaggggtgagatacgaaacgaacgtggtggctcgacacctntctgtcttncgttcccg

SEQ ID NO: 248126 - DNA, 508 bp, Homo sapiens
  misc_feature: GYAE6OF01DHPAE.47.64.F09.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacgcagtctccagccaccctgtctgtctctccaggggaaangccaccatctcctgtagggccgtcagagtattagcatcaacttagcctggtaccagcagagacctgggcaggctcccaggctcctcatctatggtncatccaccgagggccactggtactcccagccaggttcagtggcagtgggtctgggacagacttcactctcaccatcagcagcctagagcctagaagtattttgactacttttattacttgtcagcagcgtagcaactggccttctctacgtttcggacggagggaccgagggtggagagtcgaaggacgaacgtggnggtcngcacatctgtcttc

SEQ ID NO: 248127 - DNA, 518 bp, Homo sapiens
  misc_feature: GYAE6OF01CLQL8.47.64.F09.1.454.CMB.1.raw
  modified_base (195)..(195): a, c, t, g, unknown or other
  misc_feature (195)..(195): n is a, c, g, or t
  modified_base (310)..(310): a, c, t, g, unknown or other
  misc_feature (310)..(310): n is a, c, g, or t
  modified_base (376)..(376): a, c, t, g, unknown or other
  misc_feature (376)..(376): n is a, c, g, or t
  modified_base (443)..(443): a, c, t, g, unknown or other
  misc_feature (443)..(443): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccaggggaaanagccacctctcctgcagggccagtcagaatattcactcctacttagcctggtaaccaacagaaacctggtcaggcctcccaggctcctcatctgggatgcatccaacaggggccnctggccatcccagccaggttcagtggcaggtggtctggggacagagttcactctcaccatcaaacngccctagctagtctagaagtattttgactagttttaattactgtcagctagtatcataacgtggccnctcgaccttcggaccaagggacacgactggataataaacgactggtagctgacacatctntcttcntccgtcccg

SEQ ID NO: 248128 - DNA, 628 bp, Homo sapiens
  misc_feature: GYAE6OF01BK21H.47.64.F09.1.454.CMB.1.raw
  modified_base (196)..(196): a, c, t, g, unknown or other
  misc_feature (196)..(196): n is a, c, g, or t
  modified_base (261)..(261): a, c, t, g, unknown or other
  misc_feature (261)..(261): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccgaggggaaancgcccaccctctcctgcgagggccagtcaagaatattcacttccgtacttagcctggtacccaanacgaaacctggtcaggctcccaggctcctcatctatgatcgcatccaactcgggccagtggcatcccagacaggttcagtcgctaggtgggtactgggacaggtacttcacgtcctacaaccctatccagccaacgaccctaggacgccgtagtaacgttacgtttagggtacttttaatacgttagtccgtaagtcgagtcgtacggtagttccgtcggtccctacgtccgttcgtaccgtttcgggcgggtaacgggacccggtaggggtacggtacgaacgtaccgaaaacggtaaccgttgggtacggcttacgggtacccaaccgttacgttacgttaccgttacttcgtcgtttacccccg

SEQ ID NO: 248129 - DNA, 624 bp, Homo sapiens
  misc_feature: GYAE6OF01B6RSW.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacgacgggccacgtggcactaccccagaccaggttcaggtggacgtaggtcggggtctagggggacacggtaccttcgaccttctccaacctatccgacgcacgtccgtaaggaccgtccgttaggaaacgtacctttttagtaaccttttaatttaccgtggttaccaaggcctaggccggttagacgtttcctcgggccccttcggtcctacgttaccggtttcgggacgggacgggtaccgaggggtcggagtacaacgaaaaccggtacgtgggttcggcctaggacctaccgtattcgttgtcctttcgacgtttccccg

SEQ ID NO: 248130 - DNA, 512 bp, Homo sapiens
  misc_feature: GYAE6OF01DTY3K.47.64.F09.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
  modified_base (430)..(430): a, c, t, g, unknown or other
  misc_feature (430)..(430): n is a, c, g, or t
  modified_base (505)..(505): a, c, t, g, unknown or other
  misc_feature (505)..(505): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagcccaccctctcctgcagggccagtcagaatattcactcctacttagcctggtaccaacagaaacctggtcaggctcccaggctcctcatctatgatgcatccaacngggccactggcatcccagacaggttcagtggcaggtgggtctggggacagtacttcactctacaccatcagcagcctagagcctgaacgtactttggaactttatactgtcagcagcgtgagttcnggcctccgctctacgtttcgggcggagggccagggtgagactacgaaacgtactgtggctgcactatctgtcttncttcccg

SEQ ID NO: 248131 - DNA, 648 bp, Homo sapiens
  misc_feature: GYAE6OF01CVFQ7.47.64.F09.1.454.CMB.1.raw
  modified_base (196)..(196): a, c, t, g, unknown or other
  misc_feature (196)..(196): n is a, c, g, or t
  modified_base (407)..(407): a, c, t, g, unknown or other
  misc_feature (407)..(407): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccgaggggaaanagccaccctctcctgcagggccagtcagaatattcactcctattacgcctaggtaaccaagaacgaaccgtggtacacggcctccgaggtcctcctactatctagtgatcgacctaactacccaacggacgggcccacgtcggaccactacccgaagaccgtaggttcaggtcgcgtaggtggtcgtagggacagtactcactctacactntacgagcacgtcgagcgtcctagtaattagtttagacgtttaagtttaacttacgtagtactaacgaactaaaacgttaaacgtcgtccggtacccttccgtaccttccgttaaccgggttccgggaccggggacgggtaccgtaggggtacgaacgtaaggaacggaaaaccgtcggtggacggtctaccggtaccacgttacgttccgttagttacctacctcgtttccccgttacccg

SEQ ID NO: 248132 - DNA, 545 bp, Homo sapiens
  misc_feature: GYAE6OF01BTQMT.47.64.F09.1.454.CMB.1.raw
  modified_base (407)..(407): a, c, t, g, unknown or other
  misc_feature (407)..(407): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggcctcccaggcctcctcatcgtgggatgcatccaacgacggggccgctggccactccccagcccaggttccaggtggcaggtggggtctggggacagaccttcactctcaccatcagcagcctagacgcctagaagtnttttgcttagtttattactgtacagtacaaacgtaatacgtcggccctccgctctacgtttcggacgggtacgggaccgagggtgacagtagaaacgtacgtggtcggctgcacatctgtcttcatccttcccgctac

SEQ ID NO: 248133 - DNA, 588 bp, Homo sapiens
  misc_feature: GYAE6OF01ET72F.47.64.F09.1.454.CMB.1.raw
  modified_base (416)..(416): a, c, t, g, unknown or other
  misc_feature (416)..(416): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggctcccagataccactggagaaatagagatgacgcagtctccagccaccctgtctgtgtctccgaggggaaagacgccaccctctcctgcagggccagtcagagtattagcagcaacttagcctggtaccagcagaaaccgtgggcaggcctcccaggcctcctcatctagtggtgccactcccaccgacgggcccacgtggtactcccgagcccgtaggttcaggtcggcaggtggggtctggggactagagttcactctacaccatcagcacgcctgcagtctagaagtntttgacttaatttatactgtacagactaagttataagtaactcggacctcgtaccgttcggaaccgacgggtaccaacggtacgtaggtaaacgtaacgtttaaaccggtacgttacggtcggtaccgtacgtaccgtaacccgtattaccgtcttaccgttcgttaacccg

SEQ ID NO: 248134 - DNA, 539 bp, Homo sapiens
  misc_feature: GYAE6OF01ADR1K.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagaatattcactcctacttagcctggtaccaacagaaacctggtcaggctcccaggctcctcatctatgatgcatccaacagggccactggcactcccagacaggttcagtggcaggtgggtctgggacagacttcactctcaccatcagcagcctagacgcctagaagtacgtttggtactttattactgtcagcagtcgtgtacgttcgtcggccgtccgctcgtacgtttcgggcggtacgggaccgagggtggagacgtacgaaacggtacgtggtcggctcgacgtacctactcgttagtccttcgtcttcccg

SEQ ID NO: 248135 - DNA, 565 bp, Homo sapiens
  misc_feature: GYAE6OF01A7ULI.47.64.F09.1.454.CMB.1.raw
  modified_base (200)..(200): a, c, t, g, unknown or other
  misc_feature (200)..(200): n is a, c, g, or t
  modified_base (447)..(447): a, c, t, g, unknown or other
  misc_feature (447)..(447): n is a, c, g, or t
tcagagctcacgtacacgaccggtgctcgatttagcgcgtatacaagggggaggtaacgtgctcagttaggacccagagggaaccatggaagccccagctcagcttctcttcctcctgctactctggctcccagataccatcggagaagttcgtgttgacacagtctccagccaccctgtctttgtcctccgaggggaanacgccaccctctcctgcagggccaggtcagaatattcactcctacttagcctggtaccaacagaaacctggtacaggctccgaggctcctcatctatgatgcatccaacgacggccacgtggcatcccgagacctaggttcaggtcgctagtggtctgggacagacttcactctacgaccgatcgagctacgacctagacgtccgtagaacgtacttagggtactttacgtacgtcgtactcgacgngtcgtcgtagttcgtcggtcctcgtctacgtacgtttcggacggtacggtacgagggtagtacgtactaccgaacgactacgggtcggctacgacacgtactcgtagtcttgcttccg

SEQ ID NO: 248136 - DNA, 558 bp, Homo sapiens
  misc_feature: GYAE6OF01EXG3J.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaaacgacgggccactggcatcccagacaggttcagtggcaggtgggtctgggacagacttcactctcaccatcagcagcctagacgcctagaagtacgtttaggtactttattactgtcagcagcgtgtacgttcgtcggtcccttccgcttccgtacgtttccgggcggtacgggaccgaggggtggacgtacgtaccgaaaacggtacgtggtacggtctacggaccacctagttcgttagttccttctacgttcccg

SEQ ID NO: 248137 - DNA, 677 bp, Homo sapiens
  misc_feature: GYAE6OF01BCWUU.47.64.F09.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagaatattcactcctacttagcctggtaccaanagaaacctggtacaggcctcccaggcctcctcatctatgatgacataccaacgagggccaagtcggcactccccagactggttcaggtggcaggtgggtctggggacaggtacttcgactctaccactatcagctagcctaagacgtcctaggaaacgtacgttttggtaactttttaattaacgttgttacgaaggtccgtaaggtaccggtttggtaacggttttcccgttcgggtcccccgtttaccccggtccgtttccgttaacccggttttccgggggaccggggttaaccgggggtacccgtaaggggggttaggacggttaacgttaaccgaaaaaccgggtaccgttggggtacggtcccttacgggaccctaacccgtagttcccttaggtttccctttccgtactttcccccg

SEQ ID NO: 248138 - DNA, 524 bp, Homo sapiens
  misc_feature: GYAE6OF01AE212.47.64.F09.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (430)..(430): a, c, t, g, unknown or other
  misc_feature (430)..(430): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggcctcccaggctcctcatctatgatgcatccaacncgggccacgtggcatcccagacaggttcagtggcaggtgggtctgggacagtacttcactctcaccatcagcagcctagacgcctagaacgtactttggactttatactgtcagcagcgtgagttcncggcctcgctcgtacgttcgggcggagggaccgtaggggtgagactacgaaacgtacgtggtggctcgcacgtatctagttccttctcttcccg

SEQ ID NO: 248139 - DNA, 626 bp, Homo sapiens
  misc_feature: GYAE6OF01D9AD8.47.64.F09.1.454.CMB.1.raw
  modified_base (306)..(306): a, c, t, g, unknown or other
  misc_feature (306)..(306): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaaggggaaagagcccaccctctcctgcagggccagtcagaatattcactcctactagcctggtaccaacagaaacctggtcaggctcccaggctcctcatctatgatgcatccaaacgngggcccacgtggacactccccagactaggttcaggtggcagtgggtctgggacagacttcactctcacctatcagacacgcctaagacgacctaggaaacgttacgttttagggtaacttttaagtttaccgttgttacgagtcgaggtccggttgtacgtttcgtcggtcccttccgtccttcctaaccggttttccggggacgggtacggggacccgtagggggtacggaaggtataaccgaaaacggtaaccgttagggtacgggtcttcgggaccaacccgtagttccgttacgttccgtttcctcgtttaccccg

SEQ ID NO: 248140 - DNA, 577 bp, Homo sapiens
  misc_feature: GYAE6OF01BLAMO.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccaggggaaangccaccctctcctgcagggccagtcagaatattcactcctacttagcctggtaccaacagaacctggtcaggctcccaggctcctcatctatgatgcatccaacgagggcccacgtggccatccccaaggaccagggttcaggtggccaggtggggtctaggggacaggtacttcacttctacacctatcaagcacgcctagacgctaggaagtactttggtactttattacttgtcagcagtcgtgtacgttcgtggtcctccgtctcgtaccgtttcgggaccgggtacggggaccgtaggggtggacgtacgtaaccgaaacggtacgttagggtcggcgtcgaccaccgtactcgttagttccctttcgtcttccccg

SEQ ID NO: 248141 - DNA, 628 bp, Homo sapiens
  misc_feature: GYAE6OF01AQDHV.47.64.F09.1.454.CMB.1.raw
  modified_base (194)..(194): a, c, t, g, unknown or other
  misc_feature (194)..(194): n is a, c, g, or t
  modified_base (279)..(279): a, c, t, g, unknown or other
  misc_feature (279)..(279): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtcttgtctcgaggggaangccaccctctcctgcagggccagtcagatattcactcctacttagcctggtaccaacagaaacctggtcaggcctccaggctccncatctatgatgcatccaacgcggccacgtggccactccccgaagactaggttcaggtcggctaggtcgggtcgtggggaactaggtactttcgacttccgtaccacccgtatccgaaggtccacggacctagacgtcccgtaggtaaacgtacttttacgggtaactttaagttaccgtgtcgagtctaggtcgtagtacgttcgtcggtcccgtccgtctcgtaccggtttcgggacgggtacgggaccgtaggggtcggacggtactaaccgtaaacggtacgttagggtacggtccgtacggtaccctaccgtacgttcgttacgttcctttacgtcgtttccccg

SEQ ID NO: 248142 - DNA, 670 bp, Homo sapiens
  misc_feature: GYAE6OF01EIGWF.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaccaacagaaacctggtcaggctcccaggctctcatctatgatgcatccaacgcgggccacgtggccactccccgagacgtacggttcaggtggacgtaggtcgggtcgtaggggacacggtaccttcgaactctaccaacctataccgacgacacgtacctaaggacgtacccgtaggaaacgttacgttttacgggttaactttttaagtttaccgttaggttaccgaacgtaccgtaggtccgttaggttacgtttcgtcggtccccttaccggtccttaccgttaccgggttttccggggacgggtaacggggtacccggtagggggtacggaacgtacgtaaccgtaaacggtacgttgggtacggtcgtacggtacccaccgtacgttcgttacgttctttccgcgtttcccccg

SEQ ID NO: 248143 - DNA, 585 bp, Homo sapiens
  misc_feature: GYAE6OF01BKRMU.47.64.F09.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaanagaaacctggtcaggctcccaggctcctcatctatgatgcatccaacgacgggccacgtggcactccccaagactaggttcaggtggctaggtgggtctggggacagacttcactctcaccatcagcagcctagacgcctagaagtctttaggtactttattactgtcagctagcgtgtagttcgcggcctccgcttcgtaccggtttccgggacgggtacgggaccgtagggggtcggaagtacgtaacgaaaccggtacgttgggtacgggccttacggaccctaacccgtagtttcccgttagttcccgtttacgtacgtttccccg

SEQ ID NO: 248144 - DNA, 516 bp, Homo sapiens
  misc_feature: GYAE6OF01CI4Y3.47.64.F09.1.454.CMB.1.raw
  modified_base (196)..(196): a, c, t, g, unknown or other
  misc_feature (196)..(196): n is a, c, g, or t
  modified_base (510)..(510): a, c, t, g, unknown or other
  misc_feature (510)..(510): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggaccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaacgtactttggactttattactgtcagcagcgtgagttctggcctcgctctacgtttcggcggagggaccaggggtggagataccgaaacggtacgtggtaggctcgcacctatctgttcttctnttcccg

SEQ ID NO: 248145 - DNA, 537 bp, Homo sapiens
  misc_feature: GYAE6OF01DJ18Q.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (529)..(529): a, c, t, g, unknown or other
  misc_feature (529)..(529): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaanagaaacctggtcaggctcccaggctcctcatctatgatgcatccaacagggccactggcatcccagacaggtcagtggcagtggtctggggacagacttcgactctcaccatcagcagcctagacgcctgaagtactttggaacttttatactgtcagcagtcgtgattctggcctccgctcgtacgtttcgggcggaggggacccaggggtcggaagacgttaccaaaacgggtactggtcggcttggacccactactacttggttccttccgntttccccg

SEQ ID NO: 248146 - DNA, 533 bp, Homo sapiens
  misc_feature: GYAE6OF01B68TM.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggctcccagagaccactggagaaatagtgatgacgcagtctccagccaccctgtctgtctctccaggggaaangccaccatctcctgtagggccgtcagagtattagcatcaacttgcctggtaccagcagagacctgggcaggctcccaggctcctcatctatgatgcgtccacagggccactggttcccagtccaggttcagtggcagtgcgtctgggacagagttcactctcaccatcaacacgcctgcagtctagtaagtattttgactagtttattactgtcagtactagtatcaataactcggccgtctcctaccgttcggaccgaacgggaccaacggacgtaggaagtaacgttaaacgaacgttggtacggtctacgacctaccgtattctgttcttaccg

SEQ ID NO: 248147 - DNA, 508 bp, Homo sapiens
  misc_feature: GYAE6OF01EWDA6.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagagtgttggcagctacttagcctggtaccaacagaaacctggccaggctcccaggctcctcatttatgatgcatccaacagggccactggcatcccagccaggttcagtggcagtgagtctgggacagacttcactctcacatcagcagcctagagcctgaagtatttgctactttattactgtcagcagcgtagctaactggcctctctacgtttcgggcggtagggaccgaggggtcggagagtacgaggtaacgaacgtggtggctcgcaccatctgtcttc

SEQ ID NO: 248148 - DNA, 541 bp, Homo sapiens
  misc_feature: GYAE6OF01AJF3I.47.64.F09.1.454.CMB.1.raw
  modified_base (195)..(195): a, c, t, g, unknown or other
  misc_feature (195)..(195): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaangccaccctctcctgcagggccagtcagaatattcactcctacttagcctggtaccaacagaacctggtcaggctccaggctcctcatctatgatgcatccaacgacggccacgtggcactcccagacaggttcagtggctaggtcggtctgggacagacttcactcncacntcagcagcctagacgctagagtactttggtactttatactgtcagtcagtcgtgtagttctcggtcctcgcgtctacgttcgggacggtacgggaccgtagggtcgacgacgtacgaaacgtacgtcggtaggtcctacgacctacgtacgttcttaggtccttcgtcttccccg

SEQ ID NO: 248149 - DNA, 531 bp, Homo sapiens
  misc_feature: GYAE6OF01A4WB5.47.64.F09.1.454.CMB.1.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (523)..(523): a, c, t, g, unknown or other
  misc_feature (523)..(523): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaangccaccctctcctgcagggccagtcagaatattcactcctacttagcctggtaccaacagaacctggtcaggctcccaggctcctnatctatgatgcatccaacncgggccacgtggccatccccagaccaggttcagtggcaggtgggtctggggacaggacttcactctcaccatcagcagcctagacgtcctagaacgtacgtttaggtaacttttagttacttgtacagcgagtcgtgtagttctggcctcgctcgtacgtttcggcggaggaccgagggtggagtatacgaaacgtacgtggtggctgctactactctgtctncgttcccg

SEQ ID NO: 248150 - DNA, 564 bp, Homo sapiens
  misc_feature: GYAE6OF01E09IT.47.64.F09.1.454.CMB.1.raw
  modified_base (196)..(196): a, c, t, g, unknown or other
  misc_feature (196)..(196): n is a, c, g, or t
  modified_base (310)..(310): a, c, t, g, unknown or other
  misc_feature (310)..(310): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacgacgggccnctggcatccccagccaggttcagtcggcaggtgggtctggggacaggtacttcactctacaccatcagcagcctagacgcctagaagtattttgctagtttattacttgtacagtactaacgttaaatacgtcggtccctccgtctacgtaccgtttccgggacgggtacgggtaccgagggtcggacgtagtacgaaacgtaacgtggtaggctcgaccacctactcttgttaccttctacttcccgttcccg

SEQ ID NO: 248151 - DNA, 551 bp, Homo sapiens
  misc_feature: GYAE6OF01A0R80.47.64.F09.1.454.CMB.1.raw
  modified_base (197)..(197): a, c, t, g, unknown or other
  misc_feature (197)..(197): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgctccaggggaaagngccaccctctcctgcagggccagtcagaatattcactcctacttagcctggtaccaacagaaacctggtcaggctcccaggctcctcatctgggatgcatccaacgnggggccnctggcatcccagccaggttcaggtggcaggtggtctgggacagacttcactctcactatcagcagcctagacgctagaagtatttgctagtttatacgtgtacacgtactaaacgtaatacgtcgacctccgcttcgtaccgtttcgggaccgggtacgggtaccgagggtacggaacagtacgaaacggtacgtcggtggtcgtgccgactagttctcgtcttacacttccgtcccgac

SEQ ID NO: 248152 - DNA, 521 bp, Homo sapiens
  misc_feature: GYAE6OF01CBZNF.47.64.F09.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
  modified_base (490)..(490): a, c, t, g, unknown or other
  misc_feature (490)..(490): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaanagaaacctggtcaggctcccaggctcctcatctatgatgcatccaaacngggccactggcatcccagacaggttcagtggcaggtgggtctggggacagacttcactcncacatcagcagcctagagcctagaagtattttgacttaactttattactgtcagcagtcgtagcaacgtggcctctctacgtttcggacggagggaccgagggtgagagtacgaaacgtacgtggnggctcgcaccgtatctagtcttctcgttccc

SEQ ID NO: 248153 - DNA, 674 bp, Homo sapiens
  misc_feature: GYAE6OF01EFUUT.47.64.F09.1.454.CMB.1.raw
  modified_base (278)..(278): a, c, t, g, unknown or other
  misc_feature (278)..(278): n is a, c, g, or t
tcagagctcacgtacacgaccggtgctcgatttagcgcgtatacaagggggtcgttttcgtgagtagtcatggatctcatgtgcaagaaaatgaagcactgttggttcttcttcctgctggtggcgctccagatgggtcctagtcccagctaggcaacgtgacaggagtcggccagggactggtgaacgtcctttcggagtaccccttgtcccctcaccttcgctatttggtcttcgtgggtggccttccattccaccgtagtttttaatagttgggngggctggatccgccagccccgagggaagggctggaatggattgggagtattatttagtaatggtacacttctttacaaccatccctacaagagtcgagtttccatactccgcagacgacgtccgagaactctacttcctccctagaaactgacgtctcgtgtcgacccgccgactagaccgacgggtctttacgttttattacgttgtttcgaaggtacctagtcgacccggtaaccgaggacgtactatttaacgccgggtacgtaggtttaccgggttttgaagttttacgggttttaccggggacccgtaaagggggtaccgtaaacgggggttcccaaccccgggtttaactccccgggaacgtaccgtccccgttacccgaaaccccgggg

SEQ ID NO: 248154 - DNA, 547 bp, Homo sapiens
  misc_feature: GYAE6OF01E14LW.47.64.F09.1.454.CMB.1.raw
  modified_base (197)..(197): a, c, t, g, unknown or other
  misc_feature (197)..(197): n is a, c, g, or t
  modified_base (427)..(427): a, c, t, g, unknown or other
  misc_feature (427)..(427): n is a, c, g, or t
  modified_base (534)..(534): a, c, t, g, unknown or other
  misc_feature (534)..(534): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagcccaccctctcctgcagggccagtcagaatattcactcctacttagcctggtaccaacagaaacctggtcaggctcccaggctcctcatctatgatgcactccaacgacgggccacgtggcactcccagacaggttcagtggcaggtggtcgtgggacagacttcactctccaccatcagcagcctagacgcctagaagtacgtttaggtactttatactgtcagtcngtcgtgtacgttcgtcggtcctccgcttcgtacgtttcgggcggtacgggaccgtaggggtcgagtacgtacgaaacggtacgtgtcggctcgccaccgtatacgtntcttcgcttcccg

SEQ ID NO: 248155 - DNA, 772 bp, Homo sapiens
  misc_feature: GYAE6OF01AB98S.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccacctgtctttgtcctaccgagggggaaancgcccaccctctccgtgcgagggccagtcaagatattcactcctacttagcctggtaccaacagaacctggtaccaggcctcccgaggtcctcctacacttctatgtatcggaccacgtacccaacggacgggcccacgtcggcctaacgtccccgaaggtaccgtacggtttccgagggtcggacgtagggttcggggtacgtaggggaaccacggttacccttacgaaccttcctacccaacctaacgtccgaacggtacgaaccggtacccgttaagggaccggttacccgttaaggtaaacggtttaccgtttttaggggttaacctttttaacgttaccgttacgggttaccgaaggtacccgtagggtccggttaggttaacggtttccgtacccgggtcccgttccccggtacgttacccggttacccgggtttcgggggacccgggtacggggtaccggtaagggggtacgacggtaacgtaaaccggaaacggttacgttcgggtacggtccgtacgtacctacccgttacttcgtaccgttacctttcgtacccttccccgg

SEQ ID NO: 248156 - DNA, 537 bp, Homo sapiens
  misc_feature: GYAE6OF01ER3SE.47.64.F09.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactctacttagcctggtaccaacagaaacctggtcaggctccaggcctcctnatctatggtgcatccaccagggccagtggtactcccagtccaggttcagtggcaggtgggtctgggacagtacttcactctcacatcagcagcctagactcctagaagtactttggtactttatactgtacagtctagtcgtgtacgttctggcctcgctctacgttcgggcggtagggaccaggggtacgacggtataccgaaacgtacgtggtcgagtcgaccacgtattctcgtacttcacttctcccgtac

SEQ ID NO: 248157 - DNA, 644 bp, Homo sapiens
  misc_feature: GYAE6OF01CAG09.47.64.F09.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaactattcactcctacttagcctggtaccaanagaaacctggtcaggctcccaggctcctcatctatgatgcatccaacngggccactggcatcccagactggttcagtggctaggtggtctggggacaggtacttcacgtctcaccatcagcagactagacgccgtagaagttatttaggacttagttttacttacgtgttacgaagtacgtaaacgttaaactacgttacgggtaccctacccggtaccttaccgttaaccgttttccggggaccggtacggggtaacccggtaggggtacggaacgtaggtaaccggtaaaacggtaaccgtacgggttagggtaccgttcggaacccgtaaccgtaacgttcccgttacgttaccctttacctacggtttcccgtttaacccccgg

SEQ ID NO: 248158 - DNA, 522 bp, Homo sapiens
  misc_feature: GYAE6OF01AP48R.47.64.F09.1.454.CMB.1.raw
  modified_base (196)..(196): a, c, t, g, unknown or other
  misc_feature (196)..(196): n is a, c, g, or t
  modified_base (515)..(515): a, c, t, g, unknown or other
  misc_feature (515)..(515): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagacttcactctcacatcagcagcctagacgcctgaagtactttggtactttattactgtcagcagcgtgagttctcggcctccgctcgtacgtttcggcggtacgggaccgagggtggagacgtacgaaacggtactggacggctgacaccgtatctgtccttcncgttccc

SEQ ID NO: 248159 - DNA, 718 bp, Homo sapiens
  misc_feature: GYAE6OF01CPGR1.47.64.F09.1.454.CMB.1.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtcttgctcgaggggaaangccacatctctggtagggccgtnagatatagcatcaacttgcctggtaccagcagcgacctgggcaggctcccgaggcctcctnatctagtcgatcgccgtaccaccgagggccctaacgttcgggtttaccccaaggtcccctaaggggtttccaagggttcgggacctaggttcggccggttacgtcgggggaacctaggtacgtttccaacgttcctaccaaccctaatcccaaaacgtcgtcccgttgacctagtccgttaggaaacgttagttttacgactttaaggttttactttaacgttcggtacgtaacgtacgtaagttaactacgtaaacgttaacgttccggacccgtccttacccgtaacccgtttccgggaacccgtaaacggggacccgaaccggtaaccgtagggaaacgttaaacgttaaaacccggtaacgttgggtacggtaccgtacggtaaccctaacccgttacttacccgttagtttacctttaccgtacgtttacccccg

SEQ ID NO: 248160 - DNA, 563 bp, Homo sapiens
  misc_feature: GYAE6OF01DO9GG.47.64.F09.1.454.CMB.1.raw
  modified_base (197)..(197): a, c, t, g, unknown or other
  misc_feature (197)..(197): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (427)..(427): a, c, t, g, unknown or other
  misc_feature (427)..(427): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccagggggaaanagccaccctctcctgcagggccagtcagaatattcactcctacttagcctggtaccaacagaaacctggtcaggctcccaggctcctcatctatgatgcatccaacgagggccactggcatcccagacaggttcagtgcaggtggtctgggacagacttcactcncacatcagcagctagngcctgaagtactttgtactttatactgtcagcagtcgtgtacgtttcgnggtccctccgcttcgtacgtttcgggacgggtacgggaccgaggggtcggaagtacgtaccgaaaacggtaacgttgggtacggtcgtacggacctaacccgtacttaccgttagttacctttccgtacttccccg

SEQ ID NO: 248161 - DNA, 580 bp, Homo sapiens
  misc_feature: GYAE6OF01DPCB4.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcgggagaagttgtgttgacacagtctccagccaccctgtctttgtctccaggggaaanagcccaccctctcctgcagggccagtcagaatattcactcctacttagcctggtaccaacagaaacctggtcaggctcccaggctcctcatctatgatgcatccaacgagggccactggcatcccagacaggttcagtggcaggtgggtctgggacagacttcactctcaccatcagcagcctagacgcctagaagtactttggactttatacgtgtacacgcagtcgtgtagttcgtcggccctcgcttcgtacgtttcgggacgggtacgggaccgtaggggtacggacgtacgtaccgaaaaccggtaacgtgggttcgggcctacgggtacccaacccgtacttccgttcggtttacccttcgtaaccgtttcccccgg

SEQ ID NO: 248162 - DNA, 544 bp, Homo sapiens
  misc_feature: GYAE6OF01EZIKO.47.64.F09.1.454.CMB.1.raw
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (521)..(521): a, c, t, g, unknown or other
  misc_feature (521)..(521): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacgngggccctacgtggccatcccagacaggttcaggtgcaggtgggtcnggggacagacttcactctcacatcagcagcctagacgcctagaacgtactttggtactttattactgtcagtcagcgtagacgttcgtcgccctccgctctacgttcgggacggacggaccgaggggtcgagtagtaccgaaacgtaacgtgggtacggcgtgaccacctnttacgtgttcttcacgttccccg

SEQ ID NO: 248163 - DNA, 652 bp, Homo sapiens
  misc_feature: GYAE6OF01C1INP.47.64.F09.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagccaccgtctcctgcagggccagtcagagtgttggcagcaactcttagcctggtaccagcagagacctgggcaggctcccaggctcctnatctatgatgcgtccacgagggccactggtttcccagccaggttcagtggcagtgcgtcgtggggacaggtacgttcgacttctcaccatcaacacgcctgctagtctgtaagtattttgacttaggttttacttaacgtgtactaggtactaaggttacttactaagttaaccgttcgggtaccccgtaccttacccgtacccggttttaccggggaccccgttaaaacggggaaccctaaccgggtaaccggttacgggaaacggttaaacgtttaaaacccggaaacggtttcggttaaccgggtaccgttaccgggtaacccttaacccgacgtttccgttaccgtttccgtttaaccccg

SEQ ID NO: 248164 - DNA, 574 bp, Homo sapiens
  misc_feature: GYAE6OF01DKXCO.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggcctccaggctcctcatctatgatgcactccaacgacgggccacgtggcactcccagacaggttcaggtggcaggtgggtctgggacagtacttcactctaccacatcagcagccctagacgcctagaacgttacgtttaggtaacttttatactgtacagtccgtagtcgtaggtagttccgtcggtccctccgtcttccgtacgtttcggggacgtaacgggccgtaggggtacgagacgtaacgaaacggtacgtggtacggtctacgaccacctacgttactgttccttccgattcccccg

SEQ ID NO: 248165 - DNA, 509 bp, Homo sapiens
  misc_feature: GYAE6OF01D4F7N.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagagtgttggcagctacttagcctggtaccaanagaaacctggccaggctcccaggctcctcatctatgatgcatccaacagggccactggcatcccagccaggttcagtggcagtgagtctgggacagacttcactctcaccatcagcagcctagagcctgaagtatttgactactttattactgtcagcagcgtagcaactggcctctctacgtttcggcggtagggaccgtaggggtcgaggtagtcgaagacggtaactggtggctgacacctatcgtgttccg

SEQ ID NO: 248166 - DNA, 805 bp, Homo sapiens
  misc_feature: GYAE6OF01DHBI9.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagacggaaccatggaagccccagcgcagcttctcttcctcctgctactctggctcccagagaccactggagaaatagtgatgacgcagtctccagccaccctgtctgtctctccgagggaangccacatctctgcgaggccagtcagagttatagcagacaacttagcctggtaccagcaagaaccgtgggacacggcctcccgaggcctcctcacttccgtagtcgggtcgaccacgttcccaaccggtacgggccctaacgttcgggttacctccccgaaggtccccgtaagggtttccgaaggttcgggaccgtagggttcggggttacgtaggggaaccgtaggtaccgtttcctaacccgttcgtacccaaccgtacgttaccgaacggcccgtaacgttccccgtaggaccgtaaacggtttccgtaagggtaaacgttttagtttttaccgaactttaaaacgtttttacgttaccgttacggttaaccgtaacgtaccggtttaaagtttaaccgttaaaacgttaaccgggttccgggtaaccccgtttccgggtaacccgggttttaacccgggaacccgttaaaacgggggtaaccccgtaacccgggttaaacggtacggggtaaaaaccgtttaaacgttaaaaccgggtaccgtttcgggtacccgggtactacccggtacctaaccgtaccggttcgttacgtttcccgttaacccg

SEQ ID NO: 248167 - DNA, 538 bp, Homo sapiens
  misc_feature: GYAE6OF01BWB45.47.64.F09.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (431)..(431): a, c, t, g, unknown or other
  misc_feature (431)..(431): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccaggggaaangccaccctctcctgcagggccagtcagaatattcactcctattagcctggtaccaanagaaacctggtcaggctccaggcctcctcatctatgatgcatccaacgaggccacgtggcactcccaagaccaggttcaggtggcaggtgggtctggggacagcttcactctacaccatcagcagcctagcgcctgaagtactttgaacttttatacgtgtcagcagcgtgagttcngccctccgctcgtacgttcgggcggagggaccgagggtcgaagtacgtacgaaacgtacgtggtcggtctacggccacctagttcctgtacctttcgtacgttcccg

SEQ ID NO: 248168 - DNA, 552 bp, Homo sapiens
  misc_feature: GYAE6OF01E0L8E.47.64.F09.1.454.CMB.1.raw
  modified_base (197)..(197): a, c, t, g, unknown or other
  misc_feature (197)..(197): n is a, c, g, or t
  modified_base (375)..(375): a, c, t, g, unknown or other
  misc_feature (375)..(375): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanacgccaccctctcctgcagggccagtcagaatattcactcctacttagcctggtaccaacagaaacctggtcaggcctcccaggcctcctcatctatgatgcatcccaagcgggccacgtggcactcccagactaggttcaggtggcaggtgggtctgggacagcttcactctcaccntcagcagcctagacgcctaggaacgtactttaggtaacttttattactgtctagctagtcgtgtacgttcgtcggtccctccgcttcgtaccgttcggcgggtacggaccgagggtggagtacgacgaaacgtacgtggacggtctacgacacctattctagttccttcgcttcccg

SEQ ID NO: 248169 - DNA, 643 bp, Homo sapiens
  misc_feature: GYAE6OF01DIUQC.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggccaggctcccaggctcctcatctatgatgcataccaacgagggcccacgtggcactcccagccgaggtcagtcggcagtgagtctgggacagactcactctacaccatcagcacgcctagacgtccgtagtaagttatttacgtacttaactttttacttaacgttcgttacgacgtacgtaggtaccgttaacgcctaaaccggtcgggttacccttaccgttaccgtaaccggttttccgggggaaccggggtacggggtaacccggtaagggggttacgggaacggtacggtacggaaacggtaaccggtaacggtcgggttacgggtacgtacggtacccgtaaccgtagttccgttcggtttccgtttacccg

SEQ ID NO: 248170 - DNA, 580 bp, Homo sapiens
  misc_feature: GYAE6OF01EFT51.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctgtctctccgaggggaaangccacatctcctgcagggccagtcagaatatcactcctattagcctgtaccaacagaaacctggtacaggcctcccgagctcctcatctatgatgcactccgaacgcgggccacgtggacactcccagactaggttcaggtggctagggtggtcgtgggacagtactcgactctacacctatcgagcagtcctagacgtcgtagaacgtacgtttggtactttattacgttgtacgagcgtagtcgtgtacgttcgtcggtcccgtccgtcgttccgtacggtttccgggacgggtacgggtaccgtaggggtcggaagtacgtaaccgaaacggtacgttgggtacggtactacggtacctactagtccgttgttcttaccg

SEQ ID NO: 248171 - DNA, 604 bp, Homo sapiens
  misc_feature: GYAE6OF01A7FS5.47.64.F09.1.454.CMB.1.raw
  modified_base (194)..(194): a, c, t, g, unknown or other
  misc_feature (194)..(194): n is a, c, g, or t
  modified_base (253)..(253): a, c, t, g, unknown or other
  misc_feature (253)..(253): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaancgccaccctctcctgccagggccagtcagatattcactcctacttagcctggtaccaanagaaacctggtcaggcctcccaggcctcctcatctatgatgcagtaccaacgagggcccacgtcggcactccccgagacgtaggttcaggtcggcaggtgggtctgggacagtacttcgaactctacaccatcgagccagcctagacgtcctaggaacgtactttacggtactttacgttactgtactagctaggtcgtgtagtttcgtcggtccttccggtcttccgtaccgttttcgggaccgggtaggggaccgtagggtacggtagtacgtaacgtaaacggacgttggacgggtcttcggacctacccgtacgttaccgttggttaccttccgtcgtttacccccg

SEQ ID NO: 248172 - DNA, 596 bp, Homo sapiens
  misc_feature: GYAE6OF01EB8R1.47.64.F09.1.454.CMB.1.raw
  modified_base (198)..(198): a, c, t, g, unknown or other
  misc_feature (198)..(198): n is a, c, g, or t
  modified_base (378)..(378): a, c, t, g, unknown or other
  misc_feature (378)..(378): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangcccaccctctcctgcagggccagtcagaatattcactcctacttagcctaggtaccaacagaaacctggtcaggctcccaggctcctcatctatgatgcactaccaacgacggggcccacgtggcactcccagacaggttcaggtggcagtgggtctgggacagtacttcactctcacntcagcagcctagacgcctagaaacgttactttaggtacttttatacgtgtcagcagtcgtagtaggttcgtacggcccttccgtcctcgttaccgtttcgggcgggtaacgggaccgtagggggtggaacgtacgtaaccgtaaaacggtacgtagggttcggcctaggaccctaacccgttagttccttaggtttacccttccgtacgtttcccccg

SEQ ID NO: 248173 - DNA, 577 bp, Homo sapiens
  misc_feature: GYAE6OF01AZI7Y.47.64.F09.1.454.CMB.1.raw
  modified_base (194)..(194): a, c, t, g, unknown or other
  misc_feature (194)..(194): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccaggggaaangccaccctctcctgcagggccagtcagaatattcactcctacttagcctggtaccaacagaaacctggtcaggctcccaggctcctcatctatgatgcatccaacgagggccacgtggcatcccagacaggttcagtgcaggtcgggtctggggaccaggtacttcactccgtacaccatcagcagcctagagcctagaacgtactttaggacttttaattacgtgttacagtctaggtcgttggtacgtttccgtgggcccttaccggccttaccgtaccggttttcgggaccgggtagggacccgtaaggggtcggaagacgttacgaaaacgtcgtaggtaggcctagaccacgtagttactgttccttcgtattccccg

SEQ ID NO: 248174 - DNA, 556 bp, Homo sapiens
  misc_feature: GYAE6OF01CU01B.47.64.F09.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagaatattcactcctattagcctggtaccaanagaaactggtcaggctccagctccncatctatgatgcatccaacngggccacgtggcactcccagccaggtcagtggcagtgagtcgtggacagactcactctcaccatcagcacgccgtagacgcctagtaagtattttggacttagtttattactgtacagtactaacgttaaatacgtcggtaccctccggtctaccgtaccgtttccgggacgggtacgggtaccgagggttacggacgtacgtacggaaacgtacgtgtacggctcgactacctacttacgtgttcttctcgttccccg

SEQ ID NO: 248175 - DNA, 586 bp, Homo sapiens
  misc_feature: GYAE6OF01BAAEP.47.64.F09.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (362)..(362): a, c, t, g, unknown or other
  misc_feature (362)..(362): n is a, c, g, or t
  modified_base (399)..(399): a, c, t, g, unknown or other
  misc_feature (399)..(399): n is a, c, g, or t
  modified_base (549)..(549): a, c, t, g, unknown or other
  misc_feature (549)..(549): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcgagggccagtcagtaatattcactcctacttagcctggtaccaanagaacctggtcaggcctccaggctcctcatctatgatcgccgtccaccgagggcccagtggtactcccgagccaggttcaggtggcgaggtgggtctggggaacnggtacttcaccgtctacaccatcagccagacctagcnctagaattgtttcgacttaagtttatacgtgtactagaactaaacgttaatcgtcggtcctccgtctcgtacgttcgggacggtacggggtaccaggggtacgactaagtacggtaaacgtacgttggtacggcttacggacctaccgtnttccgtacgttcttaccacgtttccctcccgcttacg

SEQ ID NO: 248176 - DNA, 549 bp, Homo sapiens
  misc_feature: GYAE6OF01BV96Y.47.64.F09.1.454.CMB.1.raw
  modified_base (197)..(197): a, c, t, g, unknown or other
  misc_feature (197)..(197): n is a, c, g, or t
  modified_base (490)..(490): a, c, t, g, unknown or other
  misc_feature (490)..(490): n is a, c, g, or t
  modified_base (530)..(530): a, c, t, g, unknown or other
  misc_feature (530)..(530): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaggggaaanagcccaccctctcctgcagggccagtcagaatattcactcctacttagcctggtaccaacagaaacctggtcaggctcccgaggcctcctcatctatgatgcactccaacgagggccacgtggcactcccagactacggttcaggtggcaggtgggtctggggacaggtacttcactctcaccatcgagcacgtccgtagacgtcctaggtaacgtacgtttggtactttagttactgtcagcgagtcgtgtacgttcgtcgcctccgtctcgtacgttcggcggagggacgngggtggagacgtacgaaacgtacgtggtggctacgcactntcttgttcttcgcttcccg

SEQ ID NO: 248177 - DNA, 626 bp, Homo sapiens
  misc_feature: GYAE6OF01BWZGS.47.64.F09.1.454.CMB.1.raw
  modified_base (285)..(285): a, c, t, g, unknown or other
  misc_feature (285)..(285): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggctcccagataccatcggagaagttgtgttgacacagtctccagccaccctgtctttgtctccaggggaaagagccaccctctcctgcagggtcagtcagagtgttgacagctacttagtctggtaccaagagaaacctggccaggcctccgaggctcctnatcgtgggatgcactaccaacgacgggccgcgtggcactcccagcccgtaggttcaggtggccaggtgggtctggggacaggtacttcactctacacctatcagcacgtcctagacgacctaggaacgttattttcgacttaagttttactactggttacaagtacctaaacgttaaataccgtcgtaccctccggtaccttaccgtaccgtttccggggacgggtaaccgggtacggtaggggtacgaacgtacgttaacggaaaaccgttacggttagggtcgtacgtcgacctacccgtagttccgtcgttacctttcgtacgttcccgttacccccg

SEQ ID NO: 248178 - DNA, 540 bp, Homo sapiens
  misc_feature: GYAE6OF01B0OS6.47.64.F09.1.454.CMB.1.raw
  modified_base (196)..(196): a, c, t, g, unknown or other
  misc_feature (196)..(196): n is a, c, g, or t
  modified_base (523)..(523): a, c, t, g, unknown or other
  misc_feature (523)..(523): n is a, c, g, or t
  modified_base (533)..(533): a, c, t, g, unknown or other
  misc_feature (533)..(533): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggcctcctcatctatgatgcatccaacgacgggcccacgtggcactccccagacaggttcagtggcaggtgggtctgggacagacttcactctcaccatcagcagcctagacgcctagaacgtacgtttaggtactttattacttgtcagcagcgtgtagttcgtggccctccgtctccgtacgtttcgggcggacgggaccgtaggggtggagagtaccgaaacggtacgtggtaggctgccacgtntctgtcttcncgttccc

SEQ ID NO: 248179 - DNA, 691 bp, Homo sapiens
  misc_feature: GYAE6OF01C2RR4.47.64.F09.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctcccagataccatcggagaagtttgtgttgacacagtctccagccaccctgtctttgctccaggggaaangccacccctntcngcgcgcancaagtattctacacctctatcgctacgaaccanaactaacgtgtacgacgtcctaccggacgtccttaccactattactagtacgtagtcgactacctaaccgaacgggtaccggaccacggtcgactacctacggacgacgtacgtacgnggtnacgtgggttgtcggaggactacgtcttaccgcttccaccgtaactcgtacgacgacgcgtaactacggcgtacgtaaggtaacgttagttacgtttaactttaaactcgttacgtacgacgtagacggtgttacggttacctttcggtcccgggttaccctccggtaccgttaccgtttaccgggtccggggtaacggggtaaccgggtacgggttaggggaacgtaacgtaaccggtaaaccgaaacgggttacgttgggtccggtccgaccggacctaaccgttcttaccggtttctacctagttcccgttacccccg

SEQ ID NO: 248180 - DNA, 612 bp, Homo sapiens
  misc_feature: GYAE6OF01CR0Y8.47.64.F09.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagagctcacgtacacgaccggtgctcgatttagcgcgtatacaagggggaggaactgctcagttaggacccagacggaaccatggaagccccagcgcagcttctcttcctcctgctactctggctcccagagaccactggaagaaatagtgatgacgcagtctccagccaccctgtctgtctctccgagggggaaanagccaccatctcctggtacgggccgtnagagtaatgcatcaattagcctggtaccagcagagacctgggcaggctccgaggctccnatctatnatgcgtccacgaggcctacgtcggttcccagtcctaggttcaggtgcaggtcgcgtcgtagggacaggtagttcactctaccaacctagtaccaacacgccgtagacgtagtcgtaggtaagtttagtttacgcgtttaagttttacttactgtacgtacgtactagtaactacgtaatacgtcgggtccgtacgttaccgtaccgtttaccggaccggtaaacgggaccgtaaccgacgtaacgggaagttaaacgttaaacgtaacggttcggtacggtaccgtacgacctaaccgtagtttcctcgttccgttaccg

SEQ ID NO: 248181 - DNA, 530 bp, Homo sapiens
  misc_feature: GYAE6OF01DM17V.47.64.F09.1.454.CMB.1.raw
  modified_base (197)..(197): a, c, t, g, unknown or other
  misc_feature (197)..(197): n is a, c, g, or t
  modified_base (375)..(375): a, c, t, g, unknown or other
  misc_feature (375)..(375): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatatcactcctacttagcctggaccaacagaaacctggtcaggcctccaggcctcctcatctatgatgcatccaacgagggcccacgtggcactcccagacaggttcagtggcaggtgggtctgggacagtacttcactctcacatcancagctagcgcctagaacgtactttggtaacttttattacgtgtctagcagtcgtgtagttcgtcggccctcgcttcgtacgtttcgggcggtagggaccgagggtgagacgtacgaaacgtacgtggtggctcgcactatctgttctctgtcccg

SEQ ID NO: 248182 - DNA, 575 bp, Homo sapiens
  misc_feature: GYAE6OF01B7I1N.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagccaccctctcctgcagggccagtcagaatattcactcctacttagcctggtaccaacagaaacctggtcaggctcccaggctcctcatctatgatgcactaccaacgacgggcccacgtggccactcccagactaggttcaggtggcaggtgggtctgggacagacttcactcacacatcagcacgcctagacgtccgtagtaagttatttgacttagtttacttactgtacaagtacctaaacgttaaactacgtcggcctccgtccttacgtaccgtttcgggcgggtacgggaccgtagggtggactagtacgaaacgtacgtggtaggctcgccacgtcttcgttcgttacttcctacgttcccgtaccccg

SEQ ID NO: 248183 - DNA, 586 bp, Homo sapiens
  misc_feature: GYAE6OF01EU8EL.47.64.F09.1.454.CMB.1.raw
  modified_base (300)..(300): a, c, t, g, unknown or other
  misc_feature (300)..(300): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtcccctcacttgcattgtctctggtgctccatcaccagttttaatatggtgggctggatccgccagccccagggaaggggctggatggatgggagtatatttanaatggggacactctttacaaccatcctcaagagtcgagtttccatatccgcagacacgtcgagaatcacttctccctagaaactgacgtctctgtcgacccgccgcagaccacgggtcttgtttacttacttgttcgagacatcgacccgaccgagagctaagttacgtccgggactaggttaccggtttttgaagtttaggttttcgggggacctaaagggggtaccaaacgggggtcccaacccggttcgtaccccggacaccggtcccctcccgaaacccggg

SEQ ID NO: 248184 - DNA, 599 bp, Homo sapiens
  misc_feature: GYAE6OF01B434S.47.64.F09.1.454.CMB.1.raw
  modified_base (202)..(202): a, c, t, g, unknown or other
  misc_feature (202)..(202): n is a, c, g, or t
  modified_base (351)..(351): a, c, t, g, unknown or other
  misc_feature (351)..(351): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctnacttgctattgtctctggtgctcatcactagttttaatgttggtgggctggatccgccacgcccccgaggggaacggggctaggaagtggagttgggagttattattttagtaagtggggactacgttcttaaccaaccctatccctanaagtacgtcgtagtttccatactccgacagacacgtcgagaactcacttcctacctagaaactgagtctctcgtcgacccgccgacacgacgacggtcttagtttattactgttcgagtacatcgaccgtacgagtagctagttacgcggtactaaggtttcggtttagtagttagtttcgggaacgaacggggtaccgtaagggtcccaccgttccgtacccgacgtacgtcccgtaccgaacccgg

SEQ ID NO: 248185 - DNA, 514 bp, Homo sapiens
  misc_feature: GYAE6OF01DLT0T.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggcctcctcatctatgatgcatccaacgagggcccaacgtggacactcccagactaggttcagtggcaggtgggtctggggacagacttcactctcacatcagcacgcctagacgacctgaagtatttgacttaagtttattactgtcagctagcgtagcaacgtgcctctctcgttcggcggaggaccgtagggtgagacgtcgagacgtagtggtcgcgtgctacatctgtctctac

SEQ ID NO: 248186 - DNA, 513 bp, Homo sapiens
  misc_feature: GYAE6OF01A7O5R.47.64.F09.1.454.CMB.1.raw
  modified_base (196)..(196): a, c, t, g, unknown or other
  misc_feature (196)..(196): n is a, c, g, or t
  modified_base (507)..(508): a, c, t, g, unknown or other
  misc_feature (507)..(508): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtgcagtggtctgggacagacttcactctcacatcagcagcctagacgccgtagaagtacgtttggtactttattactgtcagcagtcgtagtacgttcgtcggcctccgtctcgtacgtttcggcggacggcgagggtgagagtacgaacgtactgcggctgcactatctagtcttnntcccg

SEQ ID NO: 248187 - DNA, 584 bp, Homo sapiens
  misc_feature: GYAE6OF01BWQOY.47.64.F09.1.454.CMB.1.raw
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagagctcacgtacacgaccggtgctcgatttagcgcgtatacaagggggaggaactgctcagttaggacccagagggaaccatggaagccccagctcagcttctcttcctctgctactctggctcccagataccatcggagaagttgtgttgacacagtctccagccaccctgtcttgctccagggaacngccacctntcctgcaggccagtcagatnttcactcctactagcctggtaccanagaacctggtcaggctccaggctcctnatcatgatgcatccaagnggccacgtggccatcccagactggttcagtcgcagtggtctagggacagtcttcgactcncaccgntcgagcacgtcctagacgcctgaacgtactttaggactttatacgtgtacacgtcagtcgtagtagttccgtggccctccgcctacgtaccgtttcgggacggacggtacccgtagggtacgggtaacgtacgtaaccgtaaaaccggtacttcgggtacgggtccctaacggtacccgtaacccgttacgttaccgttaggtaccctttacccgacgtttacccccg

SEQ ID NO: 248188 - DNA, 623 bp, Homo sapiens
  misc_feature: GYAE6OF01ANN27.47.64.F09.1.454.CMB.1.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaancgcccaccctctcctgcagggccagtcagaatntcactcctatgcctgtaccaanagaaacctggtacaggctccaggctcctcatctatgatcgcactaccaacgacgggcccagtcggccactccccgagaccgtaggttccaggtggccgtaggtcggggtacgtagggacgacgtaccttcacgtcctaccacctatccagccacgtccgtaaggacgtccgtaggaacgttacgttttacggtaacttttacgttaaccgtgttaccgaggactacgggtccgttaggtacgtttccgtcgggtccctaccggtcttaccgttaccggtttccgggacggtacgggaccgagggttcgagtacgtaacgaacggtagtgggcggtctcggacctacgtcttccgtagttcttcgcgttcccg

SEQ ID NO: 248189 - DNA, 569 bp, Homo sapiens
  misc_feature: GYAE6OF01EUSL0.47.64.F09.1.454.CMB.1.raw
  modified_base (195)..(195): a, c, t, g, unknown or other
  misc_feature (195)..(195): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (339)..(339): a, c, t, g, unknown or other
  misc_feature (339)..(339): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaangccaccctctcctgcagggccagtcagatattcactcctacttgcctgtaccaanagaacctggcaggctccagctccnatctatgatgcatccaacacgggccacgtggcactcccagactaggttcagtcgctaggtggtcngggacagacttcgactctacaccatcgagcacggtctagacgcctagaacgtacgtttaggtactttatacgtgtacagcgtagtcgtagtacgttcgtcggccctccgctacgtacgtttcgggacggtacgggaccgtaggggtcggtaagtacgtaaccgtaaaacggtacgttgggacggtctacggacaccgtacgttcgttaccgttcttcctcgtttaccccg

SEQ ID NO: 248190 - DNA, 560 bp, Homo sapiens
  misc_feature: GYAE6OF01DQC0A.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaaccaacagaaacctggtcaggcctccaggctcctcatctatgatgcactccaagcgggcccagtggcaactccccaggactaggttcaggtggacaggttcggggtctaggggacaggtacttcgactcgcaccatcagcacgcctagagcctagaacgtacgtttggacttttatacgtgtcagtcaggtcgtagtcgttcgtcggtccctccgcctacgttcgtttcgggcgggtacgggaccggaggggtgagtacgtaacgaaacgtcgtggtggctcggcactacttcgtatcttcgcttcccg

SEQ ID NO: 248191 - DNA, 704 bp, Homo sapiens
  misc_feature: GYAE6OF01EQ1ET.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtcctttgcctccgaagggggaaangcccaccctctcctgcgagggccagtcagaatattcactcctacttagcctggtaaccaacagaaacctgtcaggctcccaggcctcctcatctatgatcgcactccaaacgcgggccacgtggaccactccccagactaggttaccgaggtcggacaggttcgggtctaggggactacggtactttaccaacttctaccaacctagtccaacggtcacggtaccctaaggaccgtaccttaggaaacggttacgttttaggtaacttttaagtttactacgtcacggtacctaggtacggttgtacgtttccgtacgggtccccttacggtccctttacggttaccggtttacccggggacgggtaaccggggtaccggtaagggggttcggaacggttaccgttaaaccggaaaaccggtacggttaggggtcgggtaactcgggtaacccaacccgttagttccgttaccggttttccttaacccgtacgttttcccccgg

SEQ ID NO: 248192 - DNA, 690 bp, Homo sapiens
  misc_feature: GYAE6OF01BYGIM.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtcctcgaggggaancgcccaccctctcctgcagggccagtcagaatatcactcctatagcctaggtaccaanagaaacctggtacaggctcccaggcctcctnactctangatgctactccaacgacgggccacgtggacactccccagacgtaggttcaaggtcggcgtagggtcgggtcgtagggacaggtacctttcgaactctaccaactagtacagaccacgtcctaacggacgtccttaggtaacgttacccgttttagggtaacctttttaagttacccttggtaccgtaagccgtaacggtcggttagttaccggttcctacgggtccccttaccggtaccttacccggttaccggtttccggggaccgggtaaccggggaccggtagggggtaccggtaacggagttaaacccgaaaccgggtaacgttcgggtaccggtccgtacgtacccgaaccgttcgttacgtttccgtaccgtttacgtccgtttacccccgg

SEQ ID NO: 248193 - DNA, 545 bp, Homo sapiens
  misc_feature: GYAE6OF01DJWD6.47.64.F09.1.454.CMB.1.raw
  modified_base (196)..(196): a, c, t, g, unknown or other
  misc_feature (196)..(196): n is a, c, g, or t
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggcctccaggctcctcatctatgatgcatcaacagggccatggcatcccagacagttcaggtgcagtgggctagggacagacttcactctcacatcagcagcctagacgcctagaagtcttttaggaacttttataccttgactagntagtcgtgacgtttcgnggcccttaccggcttaccgtacggtttcgggacgggtaacgggtaccgaggggtcgagacgttacgaaacggtacgtggtacgcgtgaccactatactgtacttcagttcccg

SEQ ID NO: 248194 - DNA, 690 bp, Homo sapiens
  misc_feature: GYAE6OF01CDJIS.47.64.F09.1.454.CMB.1.raw
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (516)..(516): a, c, t, g, unknown or other
  misc_feature (516)..(516): n is a, c, g, or t
tcagagctcacgtacacgaccggtgctcgatttagcgcgtatacaagggggaggaactgctcagttaggacccagagggaaccagtggaagccccagctcagcttctcttcctcctgctactctggctcccagataccatcggagtaagttgngttgacacagtctccagccacctgtctttgctcgaggggaacncgccaccctctccngcgacggccagtcagaatctcacttctacttagcctaggaccaanagaacctggtcagctccagctccnatctangatcgactactccaacgacgggtcccaacgtcggaccaactccccgaaggtacgtaacgggttccaaggttcggacctaagggttcggggtactgggggaactacggtaccctttcgaaccttcgtacccaacctagtcccgaaaggtcctaacggtaccgtacggacgtccgtaacggtaacgttaccgttttacgggtaacttttaacttaacgttgtacgacggtacncggtacgttacgtacgttccgtacggtcccgttccgtcctaccgttacgtttaccgggacgggtaacggggaccgtaagggggtacggaacgtaaccgtacgaaaaccggtcgtacgggtacggtcgtaccggaactaccgtacgttcgtacgtttccttccgtacgttccccg

SEQ ID NO: 248195 - DNA, 723 bp, Homo sapiens
  misc_feature: GYAE6OF01B8SCP.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctcgaggggaaangccaccctctcctgcgagggccagtcagtaatatcactcctacttagcctggtaccaacacgaaacctcggtacacggcctcccaggcctcctcatctatgatgactacgtccaacgagggcccacgtcggccactcccaagacgtaggttcaggtcggacaggttgggtacgtaggggactaggtaccttcgacttaccgtaccaccgtataccgaacggccaacggtccctaaggaccgtaccgttaacggtaaacgttaccgttttagggttaacccttttaagttacgtacggttactacggtacgacggtcggttacggtacgtttccggtccgggtcccgttacccggtccgttaccggttaacccggttttccggggaccggggttaacggggacccggtaggggggttaccgggaacgtaaaccggttaaccggtaaaaccggtacggttacgggtacggtccgtacggacccgtaacccgtagttcccggtttactccgttccgtccgtttacccccgg

SEQ ID NO: 248196 - DNA, 551 bp, Homo sapiens
  misc_feature: GYAE6OF01AIFQQ.47.64.F09.1.454.CMB.1.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
  modified_base (394)..(394): a, c, t, g, unknown or other
  misc_feature (394)..(394): n is a, c, g, or t
tcagagctcacgtacacgaccggtgctcgatttagcgcgtatacaagggggaggaactgctcagttagggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagatattcactcctacttagcctggtaccaacagaaacctggtcaggctcccaggctcctcatctatgatgcatccaacngggccacgtggcatcccagacaggttcaggtggcaggtgggtctggggacagacttcacttcacaccatcagcagcctgcagtctagaagtntttgctagtttattactgtcagtcagtatcaataactggaccgtctccacccgttcggaccgaagggtaccacggtacgtaggaagtaacgttaaaacggacgttggtacgggtaccttacggacctaacctagttccgttcgttccttcgtaaccg

SEQ ID NO: 248197 - DNA, 295 bp, Homo sapiens
  misc_feature: GYAE6OF01C7EZZ.47.64.F09.1.454.CMB.1.raw
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaaggggaaangccaccctctcctgcagggccagtcagaatattcactcctattagctgaccaanagaaacctggtcaggctccaggctctcatctatgatgcatcga

SEQ ID NO: 248198 - DNA, 784 bp, Homo sapiens
  misc_feature: GYAE6OF01D0IYN.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccgagggaaancgcccaccctctcctgcgagggccagtcagaatattcactcctacttagcctggtaaccaacacgaaacctggtacacggcctcccgaggtcctcctacattctatgatcgacactaccaacgcgggcccacgtcggacactcccgaagtaccgtaggttcaaggtcggacgtagggttcgggtacgtacggggaactaacggttaccttacctaaccgttccgtaaccctaaacccgtacgttacccgaacggtacccgtaaccggtaccccgttaagggaacccggtacccgttaagggtaaaccggttttaccggttttacgggtttaaaccttttttaacgtaaccggttcgttaaccgaacgggtaccgtacgggttaccggtttacggttaacggttttcccggtaccgggttcccccgttacccggtccgtttacccggttaccgggtttacccgggggacgggtaaccggggtaccggtagggggttacggaacgtaacctaaaccggtaaacggtacggtgggtacggtccgacgaccctaacgttcgttcgttacgtttccttaccgtcgtttcccccg

SEQ ID NO: 248199 - DNA, 565 bp, Homo sapiens
  misc_feature: GYAE6OF01CR2J4.47.64.F09.1.454.CMB.1.raw
  modified_base (197)..(197): a, c, t, g, unknown or other
  misc_feature (197)..(197): n is a, c, g, or t
  modified_base (345)..(345): a, c, t, g, unknown or other
  misc_feature (345)..(345): n is a, c, g, or t
tcagagctcacgtacacgaccggtgctcgatttagcgcgtatacaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccaccatctcctggtacgggccgtcagagtattagcatcaacttgcctggtaccagcagagacctgggcaggcctccaggctcctcatctatcgatgcgtccaccagggccacgtcggtttcccagccaggttcagtgcagtgcgtntgggacagagttcacgtctcaccatcaacacgcctgcagtcgtagtaacgtattttacgcttagtttacttacttgtcacggtcaagtcgtagtacaacgtcggtacccttcttaccgtacgtttccggggcgggaacggggtacccgaggggtcggagtacgtacgaggacggtaaacgtcggtacggtcgtacggtaccacgtacttcgtcgttaccg

SEQ ID NO: 248200 - DNA, 596 bp, Homo sapiens
  misc_feature: GYAE6OF01CHICL.47.64.F09.1.454.CMB.1.raw
  modified_base (195)..(195): a, c, t, g, unknown or other
  misc_feature (195)..(195): n is a, c, g, or t
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccgaggggaaangccaccctctcctgcagggccagtcagaatatcactctattagcctgaccanagaactggtcagctccagctcnatctatgatgcactccaacgacggccacgtggacactcccgagacctggttcaggtggactaggtgggtctaggggaactagtaccttcacgttctaccacatcgagcagtcctagacgcctaggaacgtacgtttaggtaactttatacgtgtacgtacgctagtcgtagtacgttcgtcggtcccttccggcttaccgtacgtttcgggacgggtacggaccgtaggggtaggacgtacgttaaccgaaaacggtacgttcggtacgggtccttacgaccctaaccgtacttaccgttacggtttacccttcgtacgttcccccg

SEQ ID NO: 248201 - DNA, 541 bp, Homo sapiens
  misc_feature: GYAE6OF01EQXF3.47.64.F09.1.454.CMB.1.raw
  modified_base (195)..(195): a, c, t, g, unknown or other
  misc_feature (195)..(195): n is a, c, g, or t
  modified_base (348)..(348): a, c, t, g, unknown or other
  misc_feature (348)..(348): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacngacttcactctcacatcagcagcctagacgcctgaacgtactttaggtaacttttattacttgtcagtcagcgtgtagttctggcctccgctcgtaacgtttcgggcggacgggaccgtaggggtggagacgtacgaaacgtacgttggtacggcgttcgactaccgattccgttgttccttcgtattccccg

SEQ ID NO: 248202 - DNA, 579 bp, Homo sapiens
  misc_feature: GYAE6OF01DIC9J.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccaggggaaanagccacctctcctgcagggtcagtcagagtgttgacagctacttagcctggtaccaacagaacctggaccaggctccgaggcctcctcatctatgatgacatccaacgacgggccacgtcggactactccccgaagccctagggtttccaggttggactaggtgagtcgtaggggacaggtacttccacgtctacacctatcagcacgctagacgctagaagttatttgacttactttattactgtcagcgtagtcgtagctaacgtcgtcctcgtcgtacgttcgggacggtacgggaccggtagggtagaggacgtacgaaggaccgtaacgttggtcggtcgtcgaccctacgtacttaccgtcgttccttcgttacccg

SEQ ID NO: 248203 - DNA, 574 bp, Homo sapiens
  misc_feature: GYAE6OF01D8Y8V.47.64.F09.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatnttcactcctacttagcctggtaccaacagaaacctggtcaggctcccgaggctcctcatctatgatgctactccaacgacgggccacgtggccactcccgagactaggttcaggtcggctaggtggtctggggacagtcttcactctacactatcagcagctagacgcctagaacgttacgtttagtacttttattactgtacagtctagtcgtgtacgttcgtcggtcctccgtcctcgtacgtttcggcgggtacgggaccgtaggggtcggacgtacgtacgtaaacggtacgttaggtacggtccgtgacctaccgtcgttcgtcgttcttcgtacttccccg

SEQ ID NO: 248204 - DNA, 580 bp, Homo sapiens
  misc_feature: GYAE6OF01BR909.47.64.F09.1.454.CMB.1.raw
  modified_base (333)..(333): a, c, t, g, unknown or other
  misc_feature (333)..(333): n is a, c, g, or t
  modified_base (561)..(561): a, c, t, g, unknown or other
  misc_feature (561)..(561): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtcccctcacttgcattgtctctggtgctccatcactagttttaatattggtgggctggatccgccagccccgagggaagggctggatggattgggatatatttataagtgggactactcttaacaacccatccctanaagagtcgacgtttccatactccgcagacacgtccgagaactcacttcctaccctagaaactgactctctggtcgacccgcgacagaccacgggtcttagtttacttactggttcgagactagtcgaccgaccgagacgactagttacgtcggactaggtttacggtttgaagtttaggtttcgggggacctaaggggactaacggggtccaaccggtcctccggacncgtcccctccgaaacccgg

SEQ ID NO: 248205 - DNA, 551 bp, Homo sapiens
  misc_feature: GYAE6OF01A5RZ6.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacagtctccagccaccctgtctttgtctccgaggggaaangcccaccctctcctgcagggccagtcagaatattcactcctacttagcctggtaccaacagaacctggtcaggctcccaggctcctcatctatgatgcatccaacgagggccacgtggcatcccagacaggttcagtcggcaggtgggtctgggacagtacttcactctacaccatcagccagcctagacgtcgtagaacgtactttggtactttattactgtcagcagcgtgtacgttctggtcctccgcttccgtacgtttccgggcgggacgggaccgaggggtcgagtacgtaccgaaacgtacgtggtacggtctcgaccaccgtattcgtagttcttcacgttcccg

SEQ ID NO: 248206 - DNA, 570 bp, Homo sapiens
  misc_feature: GYAE6OF01EPCID.47.64.F09.1.454.CMB.1.raw
  modified_base (195)..(195): a, c, t, g, unknown or other
  misc_feature (195)..(195): n is a, c, g, or t
  modified_base (369)..(369): a, c, t, g, unknown or other
  misc_feature (369)..(369): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaanagccaccctctcctgcagggccagtcagaatattcactcctacttagcctggtaccaacagaaacctggtcaggcctcccaggctcctcatctatgatcgcatccaacgacgggccacgtggcactcccagacaggttcaggtggcaggtggtcgtgggacagtacttcactcncacatcagcagcctagacgctagaagtactttggtactttagttactgtcagcgagtcgtgtacgttcgtcggccttccgctccgtacgtttcgggacgggtacgggtaccgtaggggtggacggtaacgtaccgaaacggtacgttggtacgggtctacgaccaaccgtagttacgttagttacctttcgactttccccg

SEQ ID NO: 248207 - DNA, 785 bp, Homo sapiens
  misc_feature: GYAE6OF01DKTBU.47.64.F09.1.454.CMB.1.raw
  modified_base (260)..(260): a, c, t, g, unknown or other
  misc_feature (260)..(260): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccacctgtctttgtctccgaaggggaaagacgcccaccctctcctgcagggccagtcaagaatattcactcctactagcctggtacccaanagaaaacctggtacaggcctccaggcctcctcattactatgatcgacactacccgaaacgacgggacccacgtcggaccacgtaccccgaagtaccgtacggttacgaagggttggaccgtaaggttcggggtaccgttagggggaacctaacggtaccttttaccgaccgttaccttaacccgaaaccctaagttacccgaacggtacccgaacggtacccggttaaacggacccggttaacccggttaagggtaaaaccgttaaccggttttttaacgggttaaacccttttaagttttaacccggtacgttacgtaacggtccggtaacgggtccgggtttaggtaaccgggtttccgtacgggtcccctacccgttccttaccggttacccggtttccggggaacggggtacgggaacccggtgggggtacggaagtaccgtaacgaaaaccggtacgttgggacggtcctaccggacaaccccgtagtttcccgtagtttccttcgtaacccggttcccc

SEQ ID NO: 248208 - DNA, 552 bp, Homo sapiens
  misc_feature: GYAE6OF01BTS74.47.64.F09.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (459)..(459): a, c, t, g, unknown or other
  misc_feature (459)..(459): n is a, c, g, or t
  modified_base (540)..(540): a, c, t, g, unknown or other
  misc_feature (540)..(540): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaangccaccctntcctgcagggccagtcagagtgttggcagtctacttagcctggaccaagagaaacctggccaggcctcccaggctctcatctatgatgctactccaacgacgggcccaacgtggcctactccccagccgtaggttcaggtcggcaggtgagtcgtgggacagtacttcactctacaccatcagcacgctagacncctagaagtatttgacttatttacttactgtcagctagacgtagacctaacgtcgtaccttntaccgtacgttcgggacggacgggtacgtagggtagaggtacgtacgaaggaccgtagtcggtaggtacgtcgacaccgtntccgtgttcccg

SEQ ID NO: 248209 - DNA, 689 bp, Homo sapiens
  misc_feature: GYAE6OF01DRCWH.47.64.F09.1.454.CMB.1.raw
  modified_base (196)..(196): a, c, t, g, unknown or other
  misc_feature (196)..(196): n is a, c, g, or t
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtcttgtctccgaaggggaangcccaccctctcctagcacgggccagtcagtaatattcactcctattacgcctggtaacccaanagaaacctggtcaggcctcccgagtcctctcatctangntgcataccaactacgggcccaacgtcggcactccccaagaccaaggttcacggtggacaggttcgggtctacggggacaggtaccttcactcctacccaactataccgaggacacgtccgtaacgacgtactacggaagttacgttttacggtaacttttaactcgttacggtactacggtactacggtcggttcggtaacgtttcgtacggtcccgttcccggtacctttcgtccggttttccggggacgggtaaccggggaccgttagggggtacgaacgggttaacgaacccgtaaacgggtaacggttgggtcggtaccgtacccggttacgaaacccttcgtttaacccgttcggtttacccttaccgttaccgtttacccccgg

SEQ ID NO: 248210 - DNA, 598 bp, Homo sapiens
  misc_feature: GYAE6OF01B22HY.47.64.F09.1.454.CMB.1.raw
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagcccacctgtctttgtctccgaggggaaancgcccaccctctccngcagggccagtcagatntcactctatagctgaccaanagaacctgtcagctccagctccncatctatgatgacactaccaacgacgggcccaacgtcgggacactaccccgagacgtacggttcagttcggctaggtcgggtcgtgggacagtacttcactcgtccacctatcagcacgcctagacgcctaggaacgtacgtttacggtacttttagttaccttgtacgagtcgacggtcgtagtacgttcgtcggtcccgtaccgtcgttccgtaccgttttccgggacgggtacgggaccggtaggggtggaacggacgttacgaaacgtacgtaggtacggtcgtcggaccacctacgtcttagttccttactcgttccccg

SEQ ID NO: 248211 - DNA, 619 bp, Homo sapiens
  misc_feature: GYAE6OF01CEJS7.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangcccaccctctcctgcagggccagtcaagaatattcactcctacttagcctggtaaccaacagaaacctggtcaggcctcccgaggcctcctcatctatgatcgcatcccaacgagggcccacgtggaccacgtccccaagactaggttcaaggtggccgaggttgggtctaggggacaggtacctttcaacttctcaaccatcgagcagacctagacgccgtagtaacgtactttggtaacttttatactgtacagtctaggcgttagtacgttccgtcggcccttccgtcctccgtacggttccgggacggtaacggggtccagggggtacgaaggtacgtaaccgaaacggtacgttgggacggtccgtacggtacccaccgtacgttccgttaggttacccttcctacgtttcccccg

SEQ ID NO: 248212 - DNA, 594 bp, Homo sapiens
  misc_feature: GYAE6OF01CVNLY.47.64.F09.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctntcctgcaggccagtcagaatattcactcctacttagcctggtaccaacagaaacctggtcaaggctcccaggcctcctcatctatggtgcatccacgacggccactggtactcccagccaggttcagtggcagtgggtctgggacagcgttcactctcaccatcagcagcctgactagtctagaacgtattttgactaactttattacttgtacagtccaggtacgtagctaacgttggcccttacgtccgtacgtttcggggcgggtaacggggtaccgaggggttcggaacgtacgtaccgaaaacggtaacgttcggtacgggtccttacggacccgtaaaccctcgttccgttacggttcctttaacacgtttccccttaccccgg

SEQ ID NO: 248213 - DNA, 522 bp, Homo sapiens
  misc_feature: GYAE6OF01EDHY1.47.64.F09.1.454.CMB.1.raw
  modified_base (196)..(196): a, c, t, g, unknown or other
  misc_feature (196)..(196): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctggggacagacttcactctcaccatcagcagcctagacgcctgaagactttggaactttattactgtcagcagcgtgagttctggcctccgcttctacgtttcggcgggtagggaccgtaggggtggagatacgaaacggaactggtggcgtagcaccgtntctgtcttcngttcccg

SEQ ID NO: 248214 - DNA, 615 bp, Homo sapiens
  misc_feature: GYAE6OF01C975F.47.64.F09.1.454.CMB.1.raw
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtcttgtctccaggggaagagccaccctctcctgcagggccagtcagatatcactcctattagcctggtaccaanagaaacctggtcaggctcccaggctcctnatctatgatgcactaccaacgacgggcccactcggcactaccccagacaggttcaggtggctaggtgggtcgtgggactagtacttcgactctcacctatcagcagcctaagacgtccgtagaacgttacgtttcggtaacttttagttaccgtgttacgacgtacgtaggtcgttaacgacgtaaccgtcggtccctacgttccgtaccggtttccgggacgggacgggtaccggtaggggtgggtaacgtagtaccggtaggaaccggtacgttgggtacgggccttacggaccgtacgtacgttaccgttgttaccttcgtcgttacccccg

SEQ ID NO: 248215 - DNA, 632 bp, Homo sapiens
  misc_feature: GYAE6OF01AQ0NF.47.64.F09.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagagctcacgtacacgaccggtgctcgatttagcgcgtatacaagggggaggaactgctcagttaggacccagagggaaccatgggaagccccagcgcagcttctcttcctcctgctactctggctcccagattccaccggagacattgttttgacacagtctccagccacctgtctttgtctccaggggaaanagccacctctcctgcagggccagtcagagtgttggcagctacttagcctggtaccaacagaaacctggaccaggctcccaggctcctcatctatgatgcatccaacncggccactggcatccccagactaggttcagtcggcaggtgggtctggggaccaggtacctttccgaacttccgtaccaaccattccaacggcacgtcctagacgtcctaggaacgttacgtttacggtacttttattacgtggttaccagtccgtaggtcgttaggtacgtttccgtcgggtccctccgtacctcgtaccggtttcggaccggggtcgggtacccgtagggggtacggaagtacgtaaccgtaaaacggtacgttagggtacggtccgtacggacctaaccgtagttcccgttagtttcctttaccgacgtttcccccg

SEQ ID NO: 248216 - DNA, 590 bp, Homo sapiens
  misc_feature: GYAE6OF01A0N6Z.47.64.F09.1.454.CMB.1.raw
  modified_base (196)..(196): a, c, t, g, unknown or other
  misc_feature (196)..(196): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggcctcctcatctatgatgcatcccaacgacgggcccgctggccactccccgagcccgaggttcagtggcgtaggtgggtctgggacagcttcactcncaccntcagcagctagcnctagagtntttgactagtttatactgtacagactaagtaactcgtcgtcctccgtacctctaccgttcgggaccggtagggacccgaggggtacggacgtaacgtaaccgaaaacggtacgtacggtgggtcgttaccggacctaacccgtacgttcccgttacggtttacccttacgtaccgtttcccgtacccccgg

SEQ ID NO: 248217 - DNA, 582 bp, Homo sapiens
  misc_feature: GYAE6OF01B4S3K.47.64.F09.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaccaanagaaacctggtcaggcctcccaggcctcctcatctatgatgcatccaacgacgggcccacgtggcactccccgaagacaggttcaggtggctaggtgggtctggggacagtacttcactctacaccatcagcacgcctagacgcctagaacgtactttaggtactttatactgtacagcagtcgtgtagttcgtcggccctcgtctcgtacgtttcgggacggtagggaccgaggggtcggaagtacgtaacgaaaaccggtacgttggtacgggtcctacggaccctaacccgtagttccgtagtttccctttcgacgtttccccg

SEQ ID NO: 248218 - DNA, 641 bp, Homo sapiens
  misc_feature: GYAE6OF01B7YAH.47.64.F09.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgttctttgtctccgaggggaaancgcccaccctctcctgcagggccagtcagaatatcactcctacttagcctggtaccaanagaacctggtcaggcctcccaggcctcctnatctatgatgcatccaacgcggccacgtggcactcccagacgtaggttcaggtcggacaggttcgggtctggggaacagtaccttcacctctacacctagtcagccacgtcctagacgtccgtagaacgttacgttttacggtaacttttaacgttacgtacgtacaacgtacgtaggtcggttacggttacgtttccgtaccgggtcccttacccggtccgttaccgttaaccgggttttccggggaccggggtaacggggtacccggtaagggggttacggaacgtacgtaaccgaaaccggtcgttggtacggtctcgaccaccgtatcgtagttccttctcgttccccg

SEQ ID NO: 248219 - DNA, 608 bp, Homo sapiens
  misc_feature: GYAE6OF01ER5ER.47.64.F09.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (319)..(319): a, c, t, g, unknown or other
  misc_feature (319)..(319): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctnacttgctattgtctctggtgctccatcactagtttatntggnggntgatcgcagcccgaggaggctggatggattggagtatatttataagtgggacactcttacaaccatccctanaagtagtcgtagttcatactccgcagactacgtccgaagaactctacttcctcctagtaactgacgtctcgtgtcgtaccgccgacgacgaccgacggtcctttagttttacttacgttgttacgagacgtagtcggacccgaaccggagtaacgacgtaacgtttacgaccgggtactaacgggtttacggttttagtaagtttacgggtttcggggaccgtaaggggtaaccgaaggggtccaacccggttactacccggactaccgccccgtacccgaaacccggg

SEQ ID NO: 248220 - DNA, 912 bp, Homo sapiens
  misc_feature: GYAE6OF01AEVW6.47.64.F09.1.454.CMB.1.raw
  modified_base (203)..(203): a, c, t, g, unknown or other
  misc_feature (203)..(203): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtcctccagcccacccttgtctttgtcctccgaagggggaaancgcccaccctctcctgcgacgggccagtcagtaattattccaccttcctacttacgcccttaggtaacccaaacgtacgaaacccgttgggtacccaacgggtcccttaccccggaaggtccctttacccctactaacttccgtaacgttgaacttcggacctaaccgtaccccgaaaccggaccggggtacccacggttcgggaccctaacgtcccccgaaggaaccgtagggtttccgagggtcgggacgtagggttcggggttaccgtagggggaacctaaggtacccttttacgacccttccgttacccaaacccgtacgttacccgaaccggtaccctaaccgggtacccgttaaggtaacccggtacccggtttaagggtaaaacccggtttttaccggttttttaaccgggttaacctttttttaacggtttaacccggttaccggttaacgtaacgggtacccgtaacgggtccgggttttaacggttaccgggttttcccggttacccggggttaccccttaccccgggttccgtttacccgggttaaccggggtttcccgggggaacggggtaaccggggtacccgggtaggggttacgggaacgttaaccgtaacccggtaaacggtaccggtgggtaccggtccgttacgacctaaccgttcttaccgttggttaccccttcgtacccgtttccccg

SEQ ID NO: 248221 - DNA, 639 bp, Homo sapiens
  misc_feature: GYAE6OF01DLL1S.47.64.F09.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
  modified_base (338)..(338): a, c, t, g, unknown or other
  misc_feature (338)..(338): n is a, c, g, or t
tcagagctcacgtacacgaccggtgctcgatttagcgcgtatacaaggggggaggaactgctcagttaggacccagagggaaccatggaagccccagctcagcttctcttcctcctgcttactctggctcccagataccatcggagtaagttgtgttgacacagtctccagccaccttgttctttcgctcgaggggaaancgccaccttcncctgcacgggccagtcagtaatatcactcctattagcctgaccaanagaactgcagctccagctcncatctatgtatcgactacaccgaacacgggccacgtacgacactcccaagactacggttanacggtgaccgtggttgggtacggttacggactaacggtccttactacctactaccacgaattcgagaccacgacgtacgacgccgtagacgtttacttcgttaatttacgttcgtagtacagtcaaggttcgtgttacgtcgtcggtccgtaccgtcttacccgttcgttacggggccgttaacgggccggttaaggggacgttacggaccgtttaacgtaaaacggttcccggtaggtacggttccgacgtaccctaacccgtgtttaccgtcgtttaaccgttcgtacccgtttccccg

SEQ ID NO: 248222 - DNA, 771 bp, Homo sapiens
  misc_feature: GYAE6OF01ETVFN.47.64.F09.1.454.CMB.1.raw
tcagagctcacgtacacgaccggtgctcgatttagcgcgtatacaaggggggaggaactgctcagttaggacccagagggaaccatggaacgccccagctcagcttctcttcctcctgctactctggcctcccagactaccatcggagtaagttgtgttgacacagtcctccacgcccacccttgttctttcgtcctaccggaagggggaaacgcgccctaccctctccgtggcgacgggccagtcaagtaattacttccaccttccttaacgttacgccttacggtaaccaaacgaacgtaaaccgtgggtaccaacgggtccctaccccgagggtcccttccctactaacttccttatggtaacttcggacctaacctaccccgaaaacggccggggtaccctacggtcgggacctaacctaccccgaagtaccgttaggttaccgagggtcgggaccgtagggttcggggttacgtacggggaactaacggtacctttccgaaccttccgtacccaacccgtactaccgacggacccgacggtacctaacggacgtaccgtaaggtaaacgtttacgtttgtaacgtttaagttttaactttacgttcggtaacaacgtaactaaacgttaaacttcggtccgtccctaccggtccttacggtaccgggtttcggacggggtacggacggagggtacgaacgtagtacgaaacgtcggtcggtaggctcgacctactgttccgtcgttacctcgtcctcccgtacccg

SEQ ID NO: 248223 - DNA, 584 bp, Homo sapiens
  misc_feature: GYAE6OF01BH8ZO.47.64.F09.1.454.CMB.1.raw
  modified_base (393)..(393): a, c, t, g, unknown or other
  misc_feature (393)..(393): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtgctccatcacctagttttaatagttggtgggctggatccgccacgccccagggagggctggatggattgggagtatatttataagtggggacactctttacaacccatccctacaagagtcgtagtttccatactccgcagacacgtccgagactctactctcctgaactganctctgtcgaccgcgacagacacgtcttagtttacttactggttacgacgactagtcgtaccgacgagacgactagttacacggacttaggtttaccggttttagagtttaggtttcggggaccgtaaagggggacgtaacggggtcccaccggttccgtacccggaccacggtccctaacccgaacccggg

SEQ ID NO: 248224 - DNA, 688 bp, Homo sapiens
  misc_feature: GYAE6OF01DVTYQ.47.64.F09.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaaggggaaangcccaccctctcctgcagggccagtcagaatattcactcctacttagcctggtaccaanagaaacctggtcaggctccaggcctcctcatctatgatgcactccaacgagggccacgtggccactccccagactaggttcaggtggctaggtggggtctaggggacaggtacctttacgacttcctccgaacctatcgaacggtccacgtccgtaaggacgtcccgttagaaacgttacttttacggtaactttttaagttaccttgtacgtagtaccgtaggtccggttagtacgtttcgtcggtcccttcccgtcgttaccgtaccggttttccgggacggggtacggggtacccggtagggggtacgggtaacgtaacgttaaccgaaaaccgggttaaacggttcgggttaacgggtccgttaccggtaccctaacccgttacgttaccgttacggtttaccctttacccgttacgtttccccccg

SEQ ID NO: 248225 - DNA, 817 bp, Homo sapiens
  misc_feature: GYAE6OF01E5SP6.47.64.F09.1.454.CMB.1.raw
  modified_base (235)..(235): a, c, t, g, unknown or other
  misc_feature (235)..(235): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacgcagtctccagccaccctgtctgtctctccgaggggaagcgccaccatcctccgtggtacgggccggtacagtaatnttccactcctacttagcctggtaccaacagaacctgcacggcctcccgagtcctcctacatctatgatcgacactacccaacgacgggccacgtcggacactaccccgaagaccgtacggttcaggtcggaccgtagggtcggggtaccgtacgggggaaccaggtaaccctttccgaacctttccgtacccaacccgtattccgaacggtaccaacggtacccgtaacggaccggtaccccgtaagggtaaacggtttaccgtttttacgggttaacctttttaacgtttaaccgttacgttaccgacggtcccgtaagggttccggttacggttaccgggttttccgtaccggggttcccctttacccgggtacccgtttacccgtttacccgggtttaccgggggacccggggttaaccgggggtaacccgggtaggggggtttaacgggaacggttaaaccggtaaacccggtaaaaaccgggttaccgttaggggtacccgggtcgttaccgggtaccctaacccgttacgtttaccgttaccggttttccgtttaacccgtcccgttttacccccg

SEQ ID NO: 248226 - DNA, 491 bp, Homo sapiens
  misc_feature: GYAE6OF01DB1JB.47.64.F09.1.454.CMB.1.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (362)..(362): a, c, t, g, unknown or other
  misc_feature (362)..(362): n is a, c, g, or t
  modified_base (477)..(491): a, c, t, g, unknown or other
  misc_feature (477)..(491): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctcccagataccatcggagtaagttgtgttgacacagtctccagcccacctgttctttgtctccgaaggggaancgcccaccctctcctggcacgggcagtcagaattnttcactacctattacgcctaggtaaccaacgagaaaccctggtaccgaagggtccctcccgaaggtccgaagttggggaacgttaaattaaaaccggacgttggtcgggaccttacggccctaaacctnttccgttgttacctttccaactttcccgtttaccccgatacttaccgaggaaacgtccgaaccgtctcgtacgggacggccgggtagtacgggacaagggccgtaacagtagcannnnnnnnnnnnnnn

SEQ ID NO: 248227 - DNA, 654 bp, Homo sapiens
  misc_feature: GYAE6OF01AVKA6.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagagttgtgttgacacagtctccagccaccctgtcttgtctccgaggggaancgcccaccctctcctgcgagggccagtcagaatattcactcctacttagcctaggtaccaacacgaacctggtacaggcctcccgaggctcctcatctatgatgacactacccgaacgacggccacgtcggacactccccgaggacctaggttcaggtcggacgtagggtcggggtactcggggaacacgtaccgttaccaccttccgaccctaccgattacccggagtacccgaacggtacctacggacgtccgtaaggtaacgttaacgttttacggttacttttaacttaccgttcgtaccgtagaccgtagggtccgtaggtacgttccgtcggtccctcgtccgttccgtacggtttcgggacgggacggtacggagggtacggaagtacgtaacgaacgtacggtggtacgggctacgaccaccgttactcgttacgtcttcgtcttccccgg

SEQ ID NO: 248228 - DNA, 636 bp, Homo sapiens
  misc_feature: GYAE6OF01DW6BF.47.64.F09.1.454.CMB.1.raw
  modified_base (196)..(196): a, c, t, g, unknown or other
  misc_feature (196)..(196): n is a, c, g, or t
  modified_base (351)..(351): a, c, t, g, unknown or other
  misc_feature (351)..(351): n is a, c, g, or t
  modified_base (414)..(414): a, c, t, g, unknown or other
  misc_feature (414)..(414): n is a, c, g, or t
tcagagctcacgtacacgaccggtgctcgatttagcgcgtatacaagggggaggaactgctcagttaggacccagacggaaccatggaagccccagcgcagcttctcttcctcctgctactctggctcccagagaccactgggagaaatgtgatgacgcagtctccagccacctgtctgtctctccgaggggaaangccacatctcctgtacgggccgtcagagtattagcatcaacttagccttaggaccagcagagaccgtgggcaggctccaggctctcattctatgatcggccgtccaccgagggcctacgtcggtttcccagtcccaggttcagtggcagtgcgtntggggacaggtactcgacttcctcacctataccaacacgtccctgacagttcgtagtaagttntttagacttagttttattaccgtgtcacggtctaagttactcaacgttaacgtcggacccgtattccgttaacccgttccgggaaccgaacgggaaccgtaacggtaccgttaggggtaaaccttaaacggtttaaaaacccggtaccggtttaaggtaccgggtaccgttacgggtacccaacccgttaagtttacccgtttggttaccctttaaacccgg

SEQ ID NO: 248229 - DNA, 551 bp, Homo sapiens
  misc_feature: GYAE6OF01BHA73.47.64.F09.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
  modified_base (427)..(427): a, c, t, g, unknown or other
  misc_feature (427)..(427): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctcgaggggaaangccacctntcctgcagggccagtcagaatnttcactcctattagcctggaccaanagaaactggtcaggctcccaggctcctcatctatgatgcatccaacgngggccacgtggcactcccagactaggttcagtgcaggtggtctgggacagacttcactctacaccatcagcagcctagacgcctagaagtctttaggactttatactgtacagctagcgtagtcgttcgnggtccctacgtcctcgtacggtttcgggacggtacgggaccgtaggggtgaagtacgtaaaccgaaacggtacgttggcggcgttcgacctaacctagttccgtagttccttcgacgttccccg

SEQ ID NO: 248230 - DNA, 550 bp, Homo sapiens
  misc_feature: GYAE6OF01A6RD5.47.64.F09.1.454.CMB.1.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtacccaanagaaacctggtcacggctcccaggctcctcatctgggatgcatccaacgngggccgctggcactcccagcctaggttcagtggcaggtggtctgggacagtcttcactctcacntcagcagcctagacgctagaagtatttgctagtttacttacgtgtcagactaaacgtaatacgtcgcctccgctctacgttcggacggtacggaccgagggtcgacgacgtaggaaaccgtaacgtggtcggctggccacgtacttcgtacgttccgttacacttccgttcccgtacccg

SEQ ID NO: 248231 - DNA, 557 bp, Homo sapiens
  misc_feature: GYAE6OF01BCCJB.47.64.F09.1.454.CMB.1.raw
  modified_base (196)..(196): a, c, t, g, unknown or other
  misc_feature (196)..(196): n is a, c, g, or t
  modified_base (394)..(394): a, c, t, g, unknown or other
  misc_feature (394)..(394): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaacctggtcaggctcccaggctcctcatctatgatgcatcccaaacgacgggccacgtggctactccccagacaggttcaggtgctaggtgggtctggggacaggtaccttcactctacaccatccagcagcctagcncctagagtactttgactttatactgtcagcagcgtgagttctggccctccgtctcgtacggtttccggacgggacgggtaccgaggggtcggaagtacgtaccgaaaacgtcgtaggtcggccttcgccacccgtagttcccgtagttccttcgtacttcccg

SEQ ID NO: 248232 - DNA, 597 bp, Homo sapiens
  misc_feature: GYAE6OF01AUS3B.47.64.F09.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaanagaaacctggtcaggctcccaggctcctcatctatgatgcatcccaacgagggcccacgtggaccatccccagactaggttcaaggtggcaggtgggtctggggacaggtacttcactctcacatcagcagcctagacgctgaagtcgtttgactttatactgtcagcagtcgtagtacgttcgtcggtccctccgtcgttaccgtaccggttttcggggaccgggtacggggacccgtagggggttacggaggtaacgtaccgaaaaccggtacgttagggtcgggtcctacggaccctaacccgtagttccgtacgttccctttccgactttcccccgg

SEQ ID NO: 248233 - DNA, 600 bp, Homo sapiens
  misc_feature: GYAE6OF01EVB7C.47.64.F09.1.454.CMB.1.raw
  modified_base (197)..(197): a, c, t, g, unknown or other
  misc_feature (197)..(197): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagacatttgttttgacacagtctccagccaccctgtctttgtctccaggggaaangccacctctcctgcagggccagtcagagtgttggcagctacttagcctggtaaccaacgagtaaaccgtggacccagggcctcccgaggcctcctcattctatgatcgcataccaagcgggccacgtggacactccccgagccgtaggttcaggtcggctagtgaacgtcgtaggactagtccttcaacttctcaacatcanccagctagcgtccgtagaagttntttcgacttaacgtttattaccgttgttacgacgctaacgcgttacggactaacgtcggcctttccgtacttaccggtttcggggacggtacggaccggtaggggtcgtagtacgttacggaagaccggtaacgttgggaccggtgaccgtaccacctaagttccgttgtcgttaccg

SEQ ID NO: 248234 - DNA, 675 bp, Homo sapiens
  misc_feature: GYAE6OF01B9ITB.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagatatcgccggagaaattgtgttgacgcagtctccaggcaccctgtctttgtctccaggggaaangccaccctctcctgcagggccagtcagaatattcactcctacttagcctggtaccaacagaaacctggtcaggctcccaggcctcctcatctatgatgcatacccaacgagggcccacgtggccaactccccaaggacctaggttcaggttcggacgtaggtggggtctaggggacaggtacctttcactctaccaaccatcagacacgtacctaggacgtccgtaggtaaacgttacgttttaggtaactttttaacgttaccgttgttacagtacgtaggtcgttaggtacgtttccgtcggtccccgttccgtccgttaccgttaccggttttccggggaccggggtaacggggtacccggtaagggggttacggaacggtaacgttaaccggaaaaccggtaccgttagggtacggtccgttacggaccctaccgtacgttcccgttaggtttcccttacgtaccgtttccccgg

SEQ ID NO: 248235 - DNA, 612 bp, Homo sapiens
  misc_feature: GYAE6OF01B5OAE.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacagtctccagccaccctgtctttgtctccgaggggaaangcccaccctctcctgcagggccagtcagaatattcactcctacttagcctggtaccaacagaaacctggtcaggcctcccaggcctcctcatctatgatgcatacccaacgacgggcccacgtggaccactccccgaagacgtaggttcaaggtcggactaggtggggtcgtaggggacaggtacttcgactcctacaccatcacgtcagtccctaggacgcctagaacgtacgttttacggtacttttaagttacgtgttacagcgtaggtcgttagtacgtttcgtcggtccctccgcgttcctacggttcgggcggtacggggacgaggggtacgaggagtaccgaaacggtacgtggtacggtctacggacccacgtacgttcgttacgtttccttcgtcgtttaccccg

SEQ ID NO: 248236 - DNA, 580 bp, Homo sapiens
  misc_feature: GYAE6OF01D2IDN.47.64.F09.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagacattgttttgacacagtctccagccaccctgtctttgtctccgaggggaaagngccaccctctcctgcagggccagtcagagtgttggcagctacttagcctggtaccaacagaaacctggccaggcctccaggcctccncatctatgatgcactccaacgacgggccacgtggcactccccagccgtaggttccaggtcggacaggtcgagtcgtagggactagtacttcactctacacatcagcacgcctagacgcctagaagttatttacgacttactttatactgtcagcgagtcgtagctaacgtcgccttctcgtacgtttcgggacgggtacgggaccgtaggggtacggacgtacgtaccggaacggtacggtaacgttgggacggtccgtacggtacctaacctagttccgttcgttccgttaccg

SEQ ID NO: 248237 - DNA, 549 bp, Homo sapiens
  misc_feature: GYAE6OF01DPLCA.47.64.F09.1.454.CMB.1.raw
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcgggagaccctgtccctcacttgctattgtctctggtgctccatcactagtttatntggnggctggatccgcacgccccgagggagggctggaatggattgggagtatatttataagtgggacacgtcttacaacctatccctcaagacgtcgtacgtttcatactccgcagacncgtccgagactcacttctcctagaactganctctgtcgaccgtccgacagacacggtcttgtttatactgttacgagacatcgccgacgagagctattacgcggtctacggttaggtttgagttacggtttcggggacaaggggtaacgtaacgggtcaccgtcgtaccgctaccgcctccgaacccgg

SEQ ID NO: 248238 - DNA, 784 bp, Homo sapiens
  misc_feature: GYAE6OF01BE53Q.47.64.F09.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagctttctcttcctcctgctactctggctccagataccatcggagaagttgtgttgacacagtctccagccaccctgtctttgtctccgaggggaaangcccaccctctcctgcagggccagtcagaatatcactctacttagcctggtaccaanagaacctggccggctcccgaggcctcctcatcgtgggactgcactccgaaacgcgggccgctggccactccccgagccctaggttcaggtcggctagggtgggtacctggggaacacggtaccttcgaccttctccaacctagtcacgcccaacggtcccttaaggacgtacccgttaggtaaacggtttacgtttttaccggtaactttaaacgggtttttaacttttaaccgttacgggtttaacccgttaaacgggtaaccgttaaaaaccgtttaaaaccgttaacccggtttacccgggtacccccttaccccggtaacctttccccgtttaacccgggttttcccggggaacccgggggttaaccggggtaaccggtacgggggttaaccgggaacgtacggtaaaccggaaaaccggtaaccgttacgggtacggtccgttacggaccctaacccgttacgtttcccgttacggtttacccctttacccgtaaccccgtttccccggacccttacgttcccgg

SEQ ID NO: 248239 - DNA, 681 bp, Homo sapiens
  misc_feature: GYAE6OF01CXK4O.47.64.F09.1.454.CMB.1.raw
  modified_base (198)..(198): a, c, t, g, unknown or other
  misc_feature (198)..(198): n is a, c, g, or t
  modified_base (250)..(250): a, c, t, g, unknown or other
  misc_feature (250)..(250): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagatacccatcggagaagttgtgttgacacagtctcagccaccctgtctttgtctccgaaggggaaancgcccaccctctcctgcaggccagtcagatattcactctactgcctgaccanagaactgtcaggctccaggctcctcatctatgatgcctactccaacgcgggcccaacgtggccactcccaagactcggttacaggtggacctagggttacggggtcttagggggaacctacggtacctttcgaaccttcgtacccaacctacgttaccacggaccgacgtacccgtaaggaccggtacccttaagtaaacgggtttaccgttttacggggtaacttttttaacgttaccgtttacgtaccgtacggtacgtacgggtacgtttacggtacggtttccgtacgggtccccttccggtccttaccgtacggtttccgggacgggtacgggaccgtagggggtacgacggtaactaccggaaaacgtaccgggtgtacgggtccacggacacccgtagttccttgttacctcgttcttaccccg

SEQ ID NO: 248240 - DNA, 566 bp, Homo sapiens
  misc_feature: GYAE6OF01BQOIX.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagatattcactcctacttagcctggtaccaacagaaacctggtcaggcctcccaggctcctcatctatgatgcatccaacgacgggccactggcactcccagacaggttccaggtcggctaggtcggggtcgtggggacaggtaccttcactcctcaccatcagcacgcctagacgcctagaacgtactttaggtactttattacctgtacctagcgtaggcgttgtacgtttcgcggtccctccgctccgtacgtttcgggcgggacggaccgtagggtgacgtacgtacgaaacggtacgtggtcggctacgaccactgttcgttagtcttctcgttccccg

SEQ ID NO: 248241 - DNA, 577 bp, Homo sapiens
  misc_feature: GYAE6OF01AYH4C.47.64.F09.1.454.CMB.1.raw
  modified_base (284)..(284): a, c, t, g, unknown or other
  misc_feature (284)..(284): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccaggctcctnatctatgatgcatccaacgagggccactggcatcccagccaggttcagtgcagtgagtctgggacagacttcactctcaccatcagcagactggagccgtagaagtagtttgctagtatacttacgtgtacagactagttagtggttagggacacgtacgtacgggtacggtttaccgggaccgtaacgggaccgtaggggtaggtaaacgtacgaaacggacggtaaacgtggttacgggccgtacggaccgtaacccgtattaccgttagttacctttcctacgttccccg

SEQ ID NO: 248242 - DNA, 643 bp, Homo sapiens
  misc_feature: GYAE6OF01BTP8M.47.64.F09.1.454.CMB.1.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagcccaccctgtctttgtctccgaggggaaagngcccaccctctcctgcagggccagtcagaatattcactcctacttagcctggtaccaanagaaacctggtcaggcctcccaggcctcctcatctatgatgcatcccgaagcgggccacgtcggacactcccaagacgtaggttcaggtcggacgtaggtgggtctaggggactaggtacttcactctacacctatacgagcagtacctagacgtaccgtaggaacgttacgttttacggtaacttttagtacttgtacagcgtaggtcgtgtacgttcgtcggtcctccgtcttacgtacggtttcgggacgggtacgggtaccgagggggtacggaacgtacgtaaccggtaaaaccggtacgttgggtacgggtcccgttaggacccctaacgttacgttacccgtttacggttacccttttacgcccgttttaccccccg

SEQ ID NO: 248243 - DNA, 654 bp, Homo sapiens
  misc_feature: GYAE6OF01CR6I2.47.64.F09.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangcccaccctctcctgcagggccagtcagaatattcactcctattagcctaggtaccaacagaaacctggtcaggcctcccgaggctcctnatctatgatgcatccaacgaggccacgtggcactcccagactaggttcaggtggctaggtgggtctgggacagtacttcactcncacntcagcagctagcgctagaagtacgtttggtactttatctgtcagcgagtcggttagtacggtttccgtacgggtccccttaccggtccttaccggttaccggttttcccggggaccggggttaacggggtacccggtaaggggggttacggtaaccggtaacgttaaccggtaaaaacggtaacggtttcggggttacgggtcccgtttacggaacccgttaacccgttagtttacccggtttagtttacccctttccgttaacccgttttaccccccg

SEQ ID NO: 248244 - DNA, 555 bp, Homo sapiens
  misc_feature: GYAE6OF01AUPXL.47.64.F09.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (253)..(253): a, c, t, g, unknown or other
  misc_feature (253)..(253): n is a, c, g, or t
  modified_base (352)..(352): a, c, t, g, unknown or other
  misc_feature (352)..(352): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctccngcagggccagtcagaatattcactcctacttagcctggtaccaanagaaacctggtacaggctccaggctcctcatctatgatgcatccaacaggggcccacgtggcactcccagacaggttcagtggcagtgggtctgggacngtacttcactctcaccatccagcagcctagagcctagaagtactttaggtactttattactcgtcagcagtcgtgacgttcgtcggcctcgccttcgtacgtttccgggcggtacgggacccgagggtcggagacgtaccgaaacggtacgtggtcggccgtcggaccaacctacgttactcgttaccttcgtacgttccccg

SEQ ID NO: 248245 - DNA, 626 bp, Homo sapiens
  misc_feature: GYAE6OF01BT16U.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctactagcctggtaccaacagaacctggtcaggcctcccgaggtcctcctcatctagtgatgacactacccaagacgggccctacgtcggacctacgtccccaaggaccgtagggtttacagggttcggacgtaggttcggggtactaggggactacggtaccttcacgttctaccacctagtccagctacgtaccgtagacgtccgttagtaacgtacgttttacggtaacttttacgtacgttaggtactaggtcagttcgtgtacgttccgtcggcccttccgcgttccgtacgttcgggcggagggaccgtggggtagacgtacgtaacgaaacggtctggacggtcacggtctaccgttagtaccgttgttccttcgtcgttccc

SEQ ID NO: 248246 - DNA, 536 bp, Homo sapiens
  misc_feature: GYAE6OF01ELEH8.47.64.F09.1.454.CMB.1.raw
  modified_base (195)..(195): a, c, t, g, unknown or other
  misc_feature (195)..(195): n is a, c, g, or t
  modified_base (355)..(355): a, c, t, g, unknown or other
  misc_feature (355)..(355): n is a, c, g, or t
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (500)..(500): a, c, t, g, unknown or other
  misc_feature (500)..(500): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaanagccaccctctcctgcagggccagtcagaatattcactcctacttagcctggtaccaacagaaacctggtcaggctccagctcctcatctatgatgcatccaacagggccacgtgcatcccgaagacgtaggttcaggtcggctaggtgggtctgggacngtactcactctcacatccaaactagcctgctagtctagtaatatttagactagtttattacgtntcagtcagtatacataacngtaccnctcgtaccttcggaccgtacggacacgagtacggagtaactaaacgtacgttaggngtcgtacgacaccgtatacttgtcttcgcttacccg

SEQ ID NO: 248247 - DNA, 843 bp, Homo sapiens
  misc_feature: GYAE6OF01CZJVL.47.64.F09.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (256)..(256): a, c, t, g, unknown or other
  misc_feature (256)..(256): n is a, c, g, or t
tcagagctcacgtacacgaccggtgctcgatttagcgcgtatacaagggggaggaacgtgctcagttaggacccaggagggaaccatggaagccccagctcgacgcttctcttcctcctggctactctggctcccagatacccatcggagaagttgtgttgacacagtctccagccacctgtctttgtctccagggtaangccacccgtntcctgcaggccagtcagatagtcactcctacttgcctggtaccacngaacctggtcaggctccaggcctcctcatctatgatcgcactccgaacgtagggcccaacgttcgggacacgtaccccgaggaacctagggtttccaagggttcgggaccgtacggggtttcgggggtcccttacggggggaaccctaacgggtaaccccttttaccgaaccgtttccccgttaccgaaaccccgtacgtttcccgaacggtaccgtaacggtaccccgtttaagggaaccgttaccccgtttaagggtaaaccggttaccgtttttacgggtaaaccttttttaacgttaaccgtttacggttaccgtaaaggtacccgtacgggtcccgttttacggtaccggttttcccggtaccgggtccccggttaacccggtccggtttacccgttaaccgggttttacccggggaacccggggtaaaccgggggtacccggtaaggggggtttccgggaacgggtaaccgtttaaccggaaaaccgggttaaccgttcgggttaaccggggtcccttacgggtacccgtaaccccgtacgtttacccgttggtttaaccctttccgtacgtttacccccg

SEQ ID NO: 248248 - DNA, 570 bp, Homo sapiens
  misc_feature: GYAE6OF01EVHAL.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagtctggtaccaacagaaacctggtcaggctcccaggctcctcatctatgatgcatcccaacgcggggccacgtggcatcccagacaggttcagtggcaggtggtctgggacagacttcactctcacatcgagcagcctagacgcctagaacgtactttaggaacttttatactgtcagcagcgtgagttcgtggcctccgctcgtaccgtttcgggacggtagggaccgtaggggtaggagtacgtaaccgtaaacggtacgttagggtacggtccgtaggaccctaccgtacgttccttaggttcctttaccgtacgttcccccgg

SEQ ID NO: 248249 - DNA, 633 bp, Homo sapiens
  misc_feature: GYAE6OF01ARYWZ.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaangccaccctctcctgcagggccagtcagagtgttggcagctacttagcctggtaccaacagaaccgtggccaggcctccgaggcctcctcatctatcgatcgacactaccaacgacggcccacgtcggacactcccgagccgtaggttcaggtcggactaggtcgagtcgtagggactagtaccttcacctcgtaccacctatcgacgaccgtagtacccgtaagaccgtacccgttaggtaaacgtttcgttttacggacctttaacgttttacgtttaacctgtttacacggtactacggtacgtacgcctaacgttccggtacccttacgttaccgttacggttccggggacgggtacggggtaccgtaggggtacggacgtacgtaccgaaggaccgtacgtggtacgcgtacgacctaacgtctcgttcgttcg

SEQ ID NO: 248250 - DNA, 592 bp, Homo sapiens
  misc_feature: GYAE6OF01D4CQ1.47.64.F09.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaaggggaaanagccaccctctcctgcagggccagtcagaatattcactcctacttagcctggtaccaanagaaacctggtcaggctcccaggcctcctcatctatgatgcactccaacacgggccactggccatccccagactggttcaggtggcaggtgggtctgggacagacttcactctcaccatccagacacgtacctagacgccgtagaaacgtcttttggaacttttatacttgtacagcagtcgtagtagttccgtcggtcccttccgcttccgtacgtttccgggacgggtaacgggacccgaggggtcggaagtacgtaaccgaaacggtacgtagggtcggccgtaggaccctaaccgtagttccgttaggttccctttacgtcgtttcccccg

SEQ ID NO: 248251 - DNA, 1006 bp, Homo sapiens
  misc_feature: GYAE6OF01BUY4O.47.64.F09.1.454.CMB.1.raw
  modified_base (160)..(160): a, c, t, g, unknown or other
  misc_feature (160)..(160): n is a, c, g, or t
  modified_base (228)..(228): a, c, t, g, unknown or other
  misc_feature (228)..(228): n is a, c, g, or t
  modified_base (283)..(283): a, c, t, g, unknown or other
  misc_feature (283)..(283): n is a, c, g, or t
tcagagctcacgtacacgaccggtgctcgatttagcgcgtatacaaagggggaggaactgggctcgagttagggaacccagagggaaccatgggaaggccccagtctccagacttctcttccctcttgactactcttggctcccgagataccatcggganaaggttgtgttggactaccagtcttcccacgtccctaccctgtactttgtccgtcccacgggggaaancgtcccacccttcctccgtgggcctaggggtccaagttccaggtacgttggtttnactaggaccttaccgttaggtcgttaggttaacctaaggacgaaaaccttgggaccctaagggtccttccccgaagggtcccttccctccgtaagttccccggttacgggaccttggaccgtaaccgtcccccgaaaaccgtccgggggtaccccgtccgttccggggacctaaccgttaccccccgaaggtacccccgtaaggggttttaccgaaccgggtttccgggcccgttaaggggtttccgggggttaacttaacggggggtaaacctaacgggttaaccccgttttaacccaaaccgtttttacccgttaacccgtaaaacccgtttaacggttaccccgtaacgggaaccaaaccgggtaacccggtaaccgggaaccgggtaccccgttaacggtaaaccgtttaacgttttacggaccgtttaacggtttttaacctttacgttacgtttaccgtaacggtttaacccgtttaaaacggtttaaaacggtttacccggttaccccgggttaccccggtttacccccggttaccggtttaacccgttaacccggggtttttaccgggaccggggttaaccggggacccggttaaggggtacgggaaccgtaacggtaacgggtaaaccgtaacggtacggttacgggttacctacggaaccctaaaccgtacttaccgttacgttacgtttaccgtacgttcccggttaccccg

SEQ ID NO: 248252 - DNA, 563 bp, Homo sapiens
  misc_feature: GYAE6OF01B3D1U.47.64.F09.1.454.CMB.1.raw
  modified_base (196)..(196): a, c, t, g, unknown or other
  misc_feature (196)..(196): n is a, c, g, or t
  modified_base (313)..(313): a, c, t, g, unknown or other
  misc_feature (313)..(313): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggtcagtcagagtgttgacagctacttagtctggtaccaagagaaacctggccaggcctacccaggctcctcatcgtgggatgcactccaacgcgggccngtggccactccccagcccgtaggttcaggtggactaggtgggtctggggacagtaccttcactctcaccatccagcagcctagacgacctgaagttatttgcttaagttttacttacttgtcgtagtcgagtcgtagcctaacgtcggccttcgtctacgtttcgggacggtagggaccgtaggggtggaggatcgaacggtacgtaagtggtcggcgtgaccgtactacttacgtcgttcgtcgtaccg

SEQ ID NO: 248253 - DNA, 529 bp, Homo sapiens
  misc_feature: GYAE6OF01EPK1N.47.64.F09.1.454.CMB.1.raw
  modified_base (195)..(195): a, c, t, g, unknown or other
  misc_feature (195)..(195): n is a, c, g, or t
  modified_base (386)..(386): a, c, t, g, unknown or other
  misc_feature (386)..(386): n is a, c, g, or t
  modified_base (419)..(419): a, c, t, g, unknown or other
  misc_feature (419)..(419): n is a, c, g, or t
  modified_base (521)..(521): a, c, t, g, unknown or other
  misc_feature (521)..(521): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaangccaccctctcctgcagggccagtcagaatattcactcctacttagcctggtaccaacagaaacctggtcaggctcccaggctcctcatctatgatgcatccaacgaggggccacgtggcatccccagacaggttcagtggcaggtgggtctgggacagtacttcgactctcaccatcagcacgctagacnctagaagtactttggtactttattactgtcagnagcgtgacgttcgtcggcctccgtctcgtacgtttcgggcggagggaccgagggtgagactacgaaacgtacgtgtggcgtgacaccgtattctgttcttcncgttcccg

SEQ ID NO: 248254 - DNA, 621 bp, Homo sapiens
  misc_feature: GYAE6OF01EH2X1.47.64.F09.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (459)..(459): a, c, t, g, unknown or other
  misc_feature (459)..(459): n is a, c, g, or t
  modified_base (595)..(595): a, c, t, g, unknown or other
  misc_feature (595)..(595): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccatcggagaagttgtgttgacacagtctccagccaccctgtctttgtctccgaaggggaaagngccacctcncctgcgagggccagtcagagtatagcagcaacttagcctgggaccagcaagaaacctgggacaggcctcccaggctcctnatctagtgngccatccacgaggccagtcggtactccagcctaggtcaggtgcgaggtggtcaggggacaggtacgttcacgttctacgaacctaagtccgacgacgacgtccgtagtaccgtagtcgtagtaaacgttagtttacgacttaaattttactaattcgttanagtactaagttaagtaataacgtggtacctccggtacttaccgaaacgaaggtaaccgaacgacgtagggtaagtaaaaccgtttaaagaaccgtttcggaggtactcgaccgtaactaccgtactttaccggttntttacctaccgttcccgttaaccccg

SEQ ID NO: 248255 - DNA, 526 bp, Homo sapiens
  misc_feature: GYAE6OF01ASC6H.47.64.F09.1.454.CMB.1.raw
  modified_base (508)..(508): a, c, t, g, unknown or other
  misc_feature (508)..(508): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccactggagaaatagagatgacgcagtctccagccaccctgtctgtgtctccaggggaaagagccaccctctcctgccagggccagtcagagtattagcagcaacttagcctggtaccagcagaacctgggcaggctcccaggctcctcatctatggtgcatccaccgagggccacgtggtactcccagccaggttcagtggctaggtcgggtctggggacaggtacgttcacttccgtacaccagtccagcagccctgcagtctagtaagtattttgacttaattttacttactgtcagtctagttataagtaactggcctcgtctcgacgacggtacacgtactaggagtacgttaacgacgttgtgcgtnacctacatctctctctac

SEQ ID NO: 248256 - DNA, 550 bp, Homo sapiens
  misc_feature: GYAE6OF01AO98R.47.64.F09.1.454.CMB.1.raw
  modified_base (195)..(195): a, c, t, g, unknown or other
  misc_feature (195)..(195): n is a, c, g, or t
  modified_base (430)..(430): a, c, t, g, unknown or other
  misc_feature (430)..(430): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccaggggaaangccaccctctcctgcagggccagtcagaatattcactcctacttagcctggtaccaacagaaacctggtcaggctcccaggctcctcatctatgatgcatccaacgcgggccacgtggcactcccagactaggttcaggtggcaggtcgggtctggggacaggtacttcgactctcacatccagccagccctagacgccgtagaacgtactttggactttatacgtgtcagcagngtgtagttctcggcctccgctcgtacgtttcggacgggtacggaccgagggtggagtagtaccgaaacggtacgttggacggctacgacctacgtacgttctacgttcttcgtcttcccg

SEQ ID NO: 248257 - DNA, 666 bp, Homo sapiens
  misc_feature: GYAE6OF01AMWUW.47.64.F09.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccgaggggaaangcccaccctctcctgcagggccagtcagaatattcactcctattagcctggtaccaanagaaacctggtccaggcctcccgaggcctcctcatctatgatgcatccaacgcggccacgtggcactcccgagactaggttcagtggctaggtgggtctggggactaggaccttcacttctacacctatcagccagtcctaagcgtccgtagaacgttacgtttacggtaacttttacgttacgttcggttaccacggtacctacggtcggttagtacggtttccgtaccgggtcccgttacccggtccgttacgttaacccggttttccgggggacccgggtaacgggggtacccgtagggggttacgggaacgtacgttaaccggaaaaccggttacgtgggttacggcgttaccggaccctaacccgtacgtttacccgtgtttacccgtttcctacgtttcccccg

SEQ ID NO: 248258 - DNA, 618 bp, Homo sapiens
  misc_feature: GYAE6OF01COKQF.47.64.F09.1.454.CMB.1.raw
  modified_base (198)..(198): a, c, t, g, unknown or other
  misc_feature (198)..(198): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagccaccctgtctttgtctccgaggggaaancgcccaccctctcctgcagggccagtcaagaatattcacttcctacttacgcctaggtaaccaacacgaaacctggtacaggtcctcccaggcctcctcatctatgactgctactaccaacgacgggcccacgtcggacactaccccagacctaggttacaggtcggacgaggtgggtacgtggggacaggtccttcaccttcnccacctatccgancgacgtcctagacgtccgtagtacgtacgtttaggtacttttagttacgtgtacgcgctacgtcgtgtacgttccgtcggcctccgtctccgtacgttccgggacgggtacgggaccgtaggggtgacgtacgtacgaaacggtacgttggtacggtctcggacctacccgtattccgttagttcctcgttccgttcccccgg

SEQ ID NO: 248259 - DNA, 797 bp, Homo sapiens
  misc_feature: GYAE6OF01BI8KO.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgactcagttaggacccagagggaaccatggaagccccagcgcagcttctcttcctcctgctactctggcctcccagagaccactggagaaatagtgatgacgcagtctccaggcacctgtctttgctcgaggggaangccacgtctcctgcgaggccagtcagagtgtggcagctaactacttagcctggtaaccagacgaagaaatcgtaggccgaacgggcctacccgaacgggtcctccgtacctaagttttacgtaggttaactaagttaaccgaaacgtacggggaccctaacgtcgggtaccaacttaccccgaaaggaacctaacggaactttaccgaacggtaccgggacgtaaggttcggaacggttaccggttaacggggaacctaacggggtaacctttaccggtaaaccgttaccgttaaccaacccggtaacttacccgaagggacctaacgggtaacgttacgggaacgtacccgttaaggtaaacggttaaccgttttacgggtaaaccttttaacgttaaccgttacggtaccgtaacgtacgtaacgggtacggttacggtaacgtttcgtaccggttcccgttacccgtacgttacccgttaccgggtttaccgggacgggtaacggggtacccgtaagggggtacggtaacgtaagttaaccggaaaacggtacgtacggtacggtaccgtacgtaccgaaccgtgttcccgtttaccgg

SEQ ID NO: 248260 - DNA, 593 bp, Homo sapiens
  misc_feature: GYAE6OF01DYRTK.47.64.F09.1.454.CMB.1.raw
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtccgggcccaggactgggtagaacgcccttcggacgacccctgtcccctcacttgctattgtctctggtgctccatcactagttttaatgtgggtgggctggactccgccacgccccgagggaggctaggaagtggagttgggatattatttagagtggactactcttacacctactcctacaagacgtcgtacgtttccattactccgacacgacacggtacagaactctacttcctcctagaactgactctctgcgacccgcganacgacgacgtnttacgtttacttcgtagttcganactagtcgacccgtacgagactatactacgtcgacgttaggttacgttttgaagtttacggttcggggaacgtaagggcgtaaacggggtccacccggttcaccggtacaccgttccctaccggaaccccgg

SEQ ID NO: 248261 - DNA, 837 bp, Homo sapiens
  misc_feature: GYAE6OF01EWU0V.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagtaagttgtgttgacacagtctccagcccacctgtctttgtctccgaggggaancgcccaccctctcctgcgagggccagtcagaatattcactcctacttagcctaggtaccaacagaaacctggtccacggcctcccgaggcctcctcatctatgatgcctactacccaacggtcggccctacgtcggacctactcccgaagtaccgtacggttcacgggtcggacgtacgggttcggggtaccgtagggggaacctacggttaacctttccgaacccttcctacccgtaaaccctagttcccgaaacgggtcccaaaccgggtcccgttaaacggtaccggtacccgtttaaggtaaaccggttttacccggtttttaacgggttaaacctttttttaacggttaacccgtttcgggtaacccgtaaacggtccgttaacgggttcccgtttaaggtttacccgggttttcccgggttacccggttcccccggttacccgttccgtttaccccgggttaaccgggtttccgggggaaccgggtaaccggggtacccgggtagggggttaacggaaacggttaccgtaaaccgggtaaaccggtaacggttggggtaccggttaccgtaccggacccttaacccgttacgttccgttacccggtttaccttaccgtcccgtttacccccgg

SEQ ID NO: 248262 - DNA, 860 bp, Homo sapiens
  misc_feature: GYAE6OF01BOAPG.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaagngccaccctctcctgcagggccagtcagaatattcactcctacttagcctggtaccaacagaaacctggtcaggcctcccaggcctcctcattctatgatgcatacccaaacgacgggcccacgtcggacctaacgtaccccaaggaccgtaacgggtttcgaagggttcgggaccgtaagggttcgggggttacgttacggggggtaaccgaacggttaacccttttaccgaaccctttccgtaccctaaacccgtaacgttaccgaacggtaccctaacgggtaccccgttaagggaaccggtacccggttaaggtaaaacggtttaaccgtttttaacggggttaacctttttaacgtttaaccgttacgggtttaccaacggtaccgtaacgggttacggtttacggttacggttttacccggttccgggtaccccgttccccggttacccgtttacccgttaacccgggtttttaccgggggacccgggggttaaccgggggtaaccccgggttaagggggggtacgggtaaaacggtaaaccggttaaacccggtaaaaacggggtaccgtttacgggttacggggtaccgttacccgggaccctaaccgtaacgtttccgtttacggtttacctttccgttaccgtttaccccccg

SEQ ID NO: 248263 - DNA, 763 bp, Homo sapiens
  misc_feature: GYAE6OF01D3K27.47.64.F09.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (274)..(274): a, c, t, g, unknown or other
  misc_feature (274)..(274): n is a, c, g, or t
tcagagctcacgtacacgaccggtgctcgatttagcgcgtatacaaggggggaggaactgctcagttaggaccagagggaaccatggaagccccagctcagcttctcttcctcctgctactctggctcccagataccatcggagaagttgtgttgaccacaggtctccagccaccctgtctttgctccgaagggggaaanacgcccaccctntccgtagcgacgggccaaggtcaagtaatacttcactacctacttagccgtggtaaccaaanacgtaaaaccgtggtacgacggcctacccgaggtccctcctacactacttatgaacttcgacacctaaccgaacggaccgggtaccacgtacggactacgtacccgaagtccggtaaggttccgaggtcggaacggtagggtcggttcgggacggaaccgaggttacctacgtaacctcctaccacctagtaccgacgtaccgaacggttacccgtaagtacccggtaacgttaacgggttaaacgttacggttttaacggttaaccttttacggtaacctttacgggaacttacggacgtacggtaggttacggtaccgtttcggtacccgcccgtttaccggctttaaccgggttccgttaccggggacgggtaaccggggtacggtagggggtaacgtacgtaacttaacccggaaacggtcgtacgggacgtccgtataaccccgcggttaactcgtttaccgttccttccgacctttcccccgg

SEQ ID NO: 248264 - DNA, 570 bp, Homo sapiens
  misc_feature: GYAE6OF01CHO6P.47.64.F09.1.454.CMB.1.raw
  modified_base (197)..(197): a, c, t, g, unknown or other
  misc_feature (197)..(197): n is a, c, g, or t
  modified_base (392)..(392): a, c, t, g, unknown or other
  misc_feature (392)..(392): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagcccaccctctcctgcagggccagtcagaatattcactcctacttagcctggtaaccaacagaaacctggtcaggctcccaggcctcctcatctatgatgcatccaacgagggccacgtggcactccccgaagactaggttcaggtggcgtaggtgggtctggggacaggtaccttcactctcaccatcagcanccgtagacgcctagaacgtactttggtaacttttatactgtacgagcgagtcgtagtacgttccgtcggcctccgcttcgtcgtttcgggcggtagggaccgtagggtggaacgtactaaccgaaacggtacgtggtacggctacgacctacgtattcgtagttccttcgacttcccg

SEQ ID NO: 248265 - DNA, 740 bp, Homo sapiens
  misc_feature: GYAE6OF01C7IEI.47.64.F09.1.454.CMB.1.raw
  modified_base (318)..(318): a, c, t, g, unknown or other
  misc_feature (318)..(318): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaaggggaaagacgcccaccctctccctgaccgacggggcccaggtccaaggaaattactttcaccttccctacttagcccttaggtaacccaacacgaaaacctggtcaacgggcctcccgaggcctcctnatctatgatcgacactaccgaacgacggggacccaaccgtggacctaacgtacccccgaaggtaaccgtacgggttaccgaagggttcggaccgtaggttcgggggtcctagggggaaccctacggtacctttccaacgttcccttaccgaaccctattaccgagtaccagtaccccgtaagaccggtaccctaaggtaaacgttacgttttacgggtaactttttaacgttacgtgtaccgtaacgtacgaggtccggtagtaccggtttcgtccggcctccgtccttcgtaccggtttccgggacgggtaacggggtccgaaggggttcggaacgtaacgtaccgaaaacggttaacgtacggttcgggccgtaggtaccacccgttagttccttgttaccttaccgtctttacccccgg

SEQ ID NO: 248266 - DNA, 663 bp, Homo sapiens
  misc_feature: GYAE6OF01CAC77.47.64.F09.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccgaggggaaangccaccctctcctgcagggccagtcagaatnttcactcctacttagcctggtaaccaacagaaacctggtacgacggctccgaggcctccgtcatctatgatgcatccaanggccagtgcagtcccagacgagtcagnggcaggtcgggtctgggacagtacttcacgtctaccacatcagcctagccgtagagtccgtagaacgttacgtttaggttaactttaagttacgtcgtaccagtaccgtaggtcgtacggtacgtttccgtcgggtcccttaccgggtcttacccgttaccggtttaccgggggacggggtaaccggggtaacccggtaagggggtagggtaaaccggaaacggttaacccgaaaaaaccgggttcggtacgggttaccggtcggttaccggtacccgtaaacccgttagttacccgttagtttcccgttcccgtaacgttttcccccgg

SEQ ID NO: 248267 - DNA, 803 bp, Homo sapiens
  misc_feature: GYAE6OF01CH8I7.47.64.F09.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatatcactcctacttagcctggtaccaanagaaacctggtcaggcctccaggcctcctcatctatgatcgacactaccaacgacgggcccacgtcggacactccccgaagtaccgtagggttccaggtcggccgtagggttcggggtcgtagggggaacctagggtacctttccgaacctttccgtacccaaaccgtagttacccgaacggtacccgtaacgggtacccgttaacgggaccgtaccccgttaaggttaaacggtttacgtttttacggtacctttaaacgtttttaacgtttaaccgttacggttaccgtaacggtaccgtaacggtaccggtaacgtacccgtaaccggttcccggtaccctttaccgttacccgttaaccggttttaccgggggacccggggtaacgggggtacccggtaaggggggttacggtaacggtaaaccgttacggtaaacgggtaaccgggttaaaccggtttcggggtaccgggtacccgttacgggtaaccctaacccggttacgtttacccggtttacccggtttaccgtttacccgttaaccccg

SEQ ID NO: 248268 - DNA, 700 bp, Homo sapiens
  misc_feature: GYAE6OF01A8TSS.47.64.F09.1.454.CMB.1.raw
  modified_base (199)..(199): a, c, t, g, unknown or other
  misc_feature (199)..(199): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagattccaccggagacatttgttttgacacagtctccagcccaccctgtctgtctctccgaggggaanagccaccatctccgtggtacgggccggtcagagtattagcatcaacttagcctggtaccagcagacgaccgtgggccaggcctacccgaggcctcctcattactatgtatcggtccgtacccaccggagggccctacgttcggtttaccccagtcctaggttcaggtcggctaggtcgtcgtcgtagggactaggtacgttccacgttcctaccacccgttaatacccgaaacgtccgtacccgtcggtaccgtaacggttacgttaggtaaacggttttagttttacgacgtttaagttttaacttacgttacgttacgagtacctaagttactactaaacgttaacgtcggaccctaccttccgtaacccgtttccgggaaccgtaacgggacctaaccggaacgtacggaaacgtaaacgttaaacggaccgttaggtaccggtacgtaccgtaccgtaacgtacttcgttacctttaccttccgttcccttaccccg

SEQ ID NO: 248269 - DNA, 776 bp, Homo sapiens
  misc_feature: GYAE6OF01BZ5MG.47.64.F09.1.454.CMB.1.raw
  modified_base (193)..(193): a, c, t, g, unknown or other
  misc_feature (193)..(193): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccagggaanagccaccctctcctgcagggccagtcagaatatcactcctacttagcctggtaccaacagaaacctggtcaggctcccgaggctcctcatctatgatgacatccaacgacggccacgtcggccactccccgaagaccgtaggttccaaggttcgggacctaggttcggggtcgtacggggaacacgtaccttactaaccgtcctaccgaaccctagtaccgacggtaccaacggtaccctaacgggaccgtaccgtaacggaaacggttacccgttttagggttaacctttttaacgtttacgtcggttaccaacggtccgtaacgggtcggttaggttacggtttcccgtagggtcccccgtttccgaccgtttacccgttaacccggttttccggggggacccggggtaaacggggtacccgggtaacgggggttacgggtaaccggtaaaccggttaaacccgtaaaaaccgggtaaccgggttcggttaacgggacccgttaccggtaaccccgtaaaccccgttacggtttcccctttacgggtttacccctttaccgttaacccgttttccccccgg

SEQ ID NO: 248270 - DNA, 696 bp, Homo sapiens
  misc_feature: GYAE6OF01AQ2S7.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangcccacctctcctgcagggccagtcagaatattcactcctacttagcctaggtacccaacgagaaacctggtacacggcctcccagcctcctacattctatgatcgacataccaacgcgggtaccacgtggaccactacccgaagaccgtaggttacacggtcggacgtaggttcgggtacgtaggggacctagtaccttaccgtacttcgtaccacctagtaccgaaggtccaacgtacccgtaaggaccgtaccgtaaggtaacgttacgtttagttaactttaacgttacgtcgtacgagtccgtaggtccgttaggtacgtttccgtaccggtcccttccggttaccttaccgggttacccggtttcggggacccgggtaacggggtacccgtacggggtaggaacgtaaccgtaaccgaaacggttacggtacggtcggtactaccggacccttaccgtacttacgttacgttaccttccgtacgtttccccgg

SEQ ID NO: 248271 - DNA, 608 bp, Homo sapiens
  misc_feature: GYAE6OF01D1PGR.47.64.F09.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccgaaggggaaangcccaccctctcctgcagggccagtcagaatnttcactcctacttagcctaggtaccaanagaaacctggtcaggcctccaggctcctcatctatgatgcactaccaacgacgggcccacgtcggcactcccagacgtaggttcaggtggctaggtgggtctggggacaggtacttcgacttctaccacatcgagcagtcctaagacgtacctagaacgttacgtttacggtaactttagttactgtactagcgtagtcgtgtacgttcgtcggtccgtccgtctacgtccgtttcgggacgggtacgggaccggtaggggtacggagtacgtaaccggaaacggtacgttggtacggtccgtacgacctacccgtacgttacgttagtttcccttcgtcgttcccccg

SEQ ID NO: 248272 - DNA, 572 bp, Homo sapiens
  misc_feature: GYAE6OF01ENEJI.47.64.F09.1.454.CMB.1.raw
  modified_base (194)..(194): a, c, t, g, unknown or other
  misc_feature (194)..(194): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggagaaatagtgatgacgcagtctccagccaccctgtctgtctctcaggggaangccacatctcctgtagggccgtcagagtattagcatcaacttagcctggtaccagcagagacctgggcaggctccaggctcctcatctatgatcgccgtccaccgagggccctacgttcggtttccccagcccgtaggttcaggtggcaggtcgcgtcgtggggacaggtagttcactctcaccatacaacacgcctgcagttctagtaagtattttgacttagtttattacgtgtacagtctagtatactaattaaccgtcggtcccgtcttccgtacccgttccggacccgtaagggacctacggtacgtaggtaacgtaacgttaaacggacgttggtacggtctacggtacctacctattcttgttccttaccg

SEQ ID NO: 248273 - DNA, 589 bp, Homo sapiens
  misc_feature: GYAE6OF01EODRG.47.64.F09.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
  modified_base (438)..(438): a, c, t, g, unknown or other
  misc_feature (438)..(438): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaancgccaccctctcctgcagggccagtcagatntcactcctactagctgaccaacagaacctgtcagctccgagctcctnactctatgatgacactaccaaacgcgggccctacgtcggccaacgtccccagaccgaggttccaggtcggcgtaggtcggtcgtgggacagtcttcgactcgtacactatcgagcagtctagacgccgtagaagtacgtttagtaactttattacgtgtactagngtacgtcgtgtacgttcgtcgccttacgcctcgtaccggtttcggacgggtacggacggtagggacggaacgtagtaaccgaaacgtacgtacgggtacgtccggacgaccgtaaccgtacttccgttattaccgttccgtacgttccccg

SEQ ID NO: 248274 - DNA, 554 bp, Homo sapiens
  misc_feature: GYAE6OF01E4VDW.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagaatattcactcctacttagcctggtaccaacagaaacctggtcaggctcccaggctcctcatctatgatgcatccaacgagggccacgtggccatccccagacaggttcaggtggctaggtgggtctggggacagtacttcactctcacatcagcagcctagacgccgtagaacgtactttaggtactttattactgtcagtcagtcgtgtgttcgtcggtccctccgctcgtaccgtttcgggacgggtacgggaccggaggggtggacgagtaccgaaaacggtacgtggtggctggacctaccgtacttcgttgttcttcgcgttcccg

SEQ ID NO: 248275 - DNA, 622 bp, Homo sapiens
  misc_feature: GYAE6OF01BJCWO.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtcctccgaggggaaangcccaccctctcctgcgagggccagtcagaattattcactcctacttgcctggtaaccaacagaaacctggtcaggcctcccgaggcctcctcattctatgatgcactaccaacgcggccacgtggccactcccgagaccgtaggttcaggtcggcgtaggtcgggtcgtaggggacaggtaccttcactctaccactatcagccagccgtagacgtccgtaggaacgttacgtttacggtacttttacttacgttgtcgtagtacgtaggccgttgtacgttcgtcggtcccttccgtctccgttacgtttcgggacgggtacgggacggtagggtacggagtactaaccgtaaacggtacgttgggtacggtccgtacgaccctacgtacttccgttacgttccttccgttaccgttccccg

SEQ ID NO: 248276 - DNA, 632 bp, Homo sapiens
  misc_feature: GYAE6OF01DKOTR.47.64.F09.1.454.CMB.1.raw
  modified_base (194)..(194): a, c, t, g, unknown or other
  misc_feature (194)..(194): n is a, c, g, or t
tcagagctcacgtacacgaccggtgctcgatttagcgcgtatacaagggggaggaactgctcagttaggacccagagggaaccatggaagcccagctcagcttctctcctcctgctactctggctcccagataccatcggagaagttgtgttgacacagtctccagccacctgtctttgtctccgaggggaaancgcccaccctctcctgacacgggccagtcaagtaatacttcacttcctacttagcctaggtaaccaacacgaaacctggtacacggcctccgacggtcctcctctatctagtgtatgacactaccaacgacggggccctaacgtcggacctaccgtaccccgaagtaaccgtagggtttaccaaggtcgggccgtaggttcggggtcgtacggggactacggtaccttcgactcaccactatcaggacacgactacgacgactagaagttatttcgacttatttacttacgtgttacagtactaagttaactaactaacgtcgacctcgtcgttccggacgaaggactacgtacgtacggaacgtaagttaaaccgagtcggtacgtactacgaccgactagtcgttacgttaccttacgtaccttccgttcccgtac

SEQ ID NO: 248277 - DNA, 631 bp, Homo sapiens
  misc_feature: GYAE6OF01COZWQ.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcgggagaagttgtgttgacacagtctccagccaccctgtctttgtctccgaggggaaagacgcccaccctctcctgcagggccagtcagaatattcactcctacttagcctggtaaccaactagaaacctggtccaggcctcccaggctcctcatctatgatgcatccaacgacgggcccacgtggaccacgtccccaagtacctacggttcaggtggactagggtcggggtcgtaggggaacctagtacttccgacttcctacacctatccgtaagcctaacgaccgtaagaccgtaccgtaggtaaacggtacgttttacggtaacttttattacgtgtacgtagcgtagtcgtgtcgttccgtcggtccctcgtccttaccgtacggtttccgggacgggtacggggtacccgaagggtggaacgtacgtaccgaaacgtacggtggtaggtcctacgaccgactcgtccttgttcctgtacttccccg

SEQ ID NO: 248278 - DNA, 600 bp, Homo sapiens
  misc_feature: GYAE6OF01BR17U.47.64.F09.1.454.CMB.1.raw
  modified_base (411)..(411): a, c, t, g, unknown or other
  misc_feature (411)..(411): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccaggctcctcatctgggatgcatccaacgacggggcccgctgggccactccccgagcccgagggttccaggtggcaggtcggggtctggggacaggaccttcactctcaccatcagcagcctagacgcctagaagtnttttggactttatactgtcagtcagcgtgtagttctggcctccgctccgtacgtttcgggacgggtacgggaccgtaggggtacggacgtacgtacgaaaaccggtaacgttgggtacggtccttacggccctaacccgtagttccgttacggttaccctttacgacctttccccgttccccggtaccc

SEQ ID NO: 248279 - DNA, 816 bp, Homo sapiens
  misc_feature: GYAE6OF01B6611.47.64.F09.1.454.CMB.1.raw
tcagagctcacgtacacgaccggtgctcgatttagcgcgtatacaagggggaggaactgctcagttaggacccagagggaaccatggaagcccccagctcagcttctcttcctctgctactcgtggcctcccagactaccagtcggagtagttgtgttgacacagtcctccacgccctacccgttgttctttcgtcctaccggaagggggaaacgccgacccctacccttcctccgtgaccggacgggcctagtacaagtaacttacttaccaccttacccttaacgtttacgcccgttacggtaaacccaaagtaaccgtaaaccgtggtaccacgggtccctaccccgaggtcccttaccctactacttactagtgtactcgacctaaccgtaacccgaacggaccgggccctaacggtcggacctaaccgtaccccgaaggtaccgttacggttcgaaggttcggacgtagggttcgggtcgtacgggactacgtacccttcaccttcctaccactataccgacgctacgtaccgtacgacgtcgtaagtaacgtttgtttacgactttagtttactacgtacgtactaacgtaaccgtaaacgtaacgtccgtaccgtcccgtccgttaccttacggttaccggttacggggaccgggtaaccgggtaccggtaggggttaaccggaacgttaacggtaaacccgggtaaacgttaccgggttcgggttaccgggacccgtcggacccgttaacccgttacgtttccgtttacgttaccctttaccgttacccgtttcccccggtaaccccg

SEQ ID NO: 248280 - DNA, 569 bp, Homo sapiens
  misc_feature: GYAE6OF01AFE6H.47.64.F09.1.454.CMB.1.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccgggagacatttgttttgacacagtctccagcccaccctgtctttgtctccgaggggaaagngcccaccctctcctgcagggccagtcagagtgttggcagctacgttagccgtaggtaccaacgagaaaccgtggacccagggcctccccgaggcctcctcatctatgatgacactccaagcggccactgacactcccagcctaggttcagtggcaggtgagtcgnggacngtactcactcncaccntcagcacgctaggcgctagaagtatttcgacttactttattacgtagtccagtacaggtcgtaacgcgtaacgtcgtcctacgtaccgttacggttacggacgggacgggtaccgagggtggacgtagacggtacgagtacggttggcgtacgtcgacctacgtacttcgtgttccttaccg

SEQ ID NO: 248281 - DNA, 568 bp, Homo sapiens
  misc_feature: GYAE6OF01DA7NH.47.64.F09.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcgganaagttgtgttgacacagtctccagccaccctgtctttgctccgaaggggaancgccaccctncctgcaggccagtcagatatcactccattgcctaggaccaangaaacctgcaggcctccagctcnatctangatgcactcaacnggccagtcggcactcccagaacnggtcaggtgacnggtgggtcagggactagtacttcactcncgacntcagctagcctagacgcctagtaagtctttaggtacttttaatcgtgtacagctagtcgttgtacgtttctccgggaccttcccgtacttccggttacgtttccggggacggtaacgggcgtacggggtagaacgtacgtacccgtaaaagtcggtggtacggccgtacgacccgaacctcgtactttctacccgttgcctttaccccgg

SEQ ID NO: 248282 - DNA, 595 bp, Homo sapiens
  misc_feature: GYAE6OF01A3K5N.47.64.F09.1.454.CMB.1.raw
  modified_base (196)..(196): a, c, t, g, unknown or other
  misc_feature (196)..(196): n is a, c, g, or t
  modified_base (425)..(425): a, c, t, g, unknown or other
  misc_feature (425)..(425): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggctcctcatctatgatgcatccaacagggccagtggcatcccagacaggttcagtggcagtgggtctgggacaggaccttcacgtctcaccatcagcagcctagagcctaggaacgtactttggtacttttaattacgtgtacacgtnagcgtgtagttctgggtccctccggctaccgtacgtttacggggaccgggtacgggaccgtagggggtggaacgtaacgttaaccgaaaaccgggtaaccttggtacggggtccttacggacccgtaaccctaattcccgttacgttccgtttccgtaacgtttcccccg

SEQ ID NO: 248283 - DNA, 789 bp, Homo sapiens
  misc_feature: GYAE6OF01ED1QG.47.64.F09.1.454.CMB.1.raw
  modified_base (563)..(563): a, c, t, g, unknown or other
  misc_feature (563)..(563): n is a, c, g, or t
tcagagctcacgtacacgaccggtgctcgatttagcgcgtatacaagggggctttctgagagtcatggatctcatgtgacaaagaaaatgaagcacctgtggttcttcctcctgcgtggtggcggcctcccgagtagtcgggtcctcgtcccagctgacaactgcgagggacggtccgggcccaggacgtgggtaggaacgtccgttacgggacgtaccccgttcgttcccctcgtacgttcgactattcgtcttcggtggtcgcctaccagtcctaacgttagtttttaagtgttggggtgggtctggacctccgaccgaccggcccggaaggggacgggcgtaggtagtgggtaagttgggtattaagtttagtttaagtaacggtcggtaaccttacctttaccttaaccgaaaccctacgtaccctacgaaggtacgttccgttaacgttaccacgttacgacccgacacgaaccgtaccgtacgaagtacttaccctacgttcctaccgtaacggtaactcggacgttctaccgtcggtaccggtaccccgccggtanacggtaccgtacggtttctttaacgtttacgtacttcggtacgacgtactacgtaccggaccgaacgaggtactacgttaacgttacgtacggtaacgtttacgggtttacgggtttacgtaaggttttacgggtaacgggaacccgtaacggggtacgtaaaccgggttcccaacccggtttcgacccccgaagtccccggtaaccctaccccgggtaaacccgg

SEQ ID NO: 248284 - DNA, 811 bp, Homo sapiens
  misc_feature: GYAE6OF01DKT3S.47.64.F09.1.454.CMB.1.raw
  modified_base (201)..(201): a, c, t, g, unknown or other
  misc_feature (201)..(201): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggataagttgtgttgacacagtctccacgccacccttgttctttgtctccgaaggggaaancgcccaccctctcctgccgagggccagtcaagtaattacttacaccttccttacgttacgcccgttacggtaaacccaaacgtaacgtaaaacccgttgggtacccgaacgggtccccttaccccgaacggggtccctttacccgtactaactttcctaagttcggaaacgttcggacctaaccttaacccggaaacgggaccggggtaccctaacggttcgggacctaaccgttaccccggaaaggtaccgttacggggtttaccaagggttcggacgtacgggttcggggtaccgtacggggaactacggttaacccttccgaaccgttcctacccaacctagtaccgagaccgtaacgtaccgtaagacggtaccgtagtaaccggtttacgttttggtaacttttacgtacgtcgtacgacgtacgtggttaccgttagtacgtttccggaccggtccgttcccgccgtttaccgttacgggttccgggacgggtaacggaccggtaggggtacgtaacgtacgtaaccgaaacggttacggtggtacggtcgtaccgacctaaccgttcttacgttacgtttccttccgtaaccgtttcccccgg

SEQ ID NO: 248285 - DNA, 657 bp, Homo sapiens
  misc_feature: GYAE6OF01ALHNQ.47.64.F09.1.454.CMB.1.raw
  modified_base (106)..(106): a, c, t, g, unknown or other
  misc_feature (106)..(106): n is a, c, g, or t
  modified_base (170)..(170): a, c, t, g, unknown or other
  misc_feature (170)..(170): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
tcagagctcacgtacacgaccggtgctcgatttagcgcgtatacaagggggaggaactgctcagttaggacccagagggaaccatggaagccccagctcagcttcncttcctcctgcctactctggcctccagataccatccggaagtaagttgtgttgaccacagttcnccgagcccacctgtctttgctccgaaggggaancgccaccctctccgngccgagggccagtcaagtaatnttcaccttcctacttaggcctaggtaaccaactagaaaccgtggtacgaggcctccgaggtcctcctcactctatgatcgctactacccgaacgacgggccctacgtcggcctactccccgagaccgtaggttccaggtcgcgtaggttcgggacgtacgggactacgtaccgtcaccttacctccaacgtactccgaggtacccgacgtccgtaagcggtacctaggaaccggttacgtttacggttaactttattaccgtcgtaccgtagccgtaggttccgtagttccgtcgtcgtcctcgtacgttcctacggttcgggacgggtacggaccgggtgggtacggacgtacgtaaaccgaaggtaccgtgggtcgtcacggacctacgtagtcttagtccttcgtccgttcccg

SEQ ID NO: 248286 - DNA, 728 bp, Homo sapiens
  misc_feature: GYAE6OF01BWM4A.47.64.F09.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangcccaccctctcctgcagggccagtcagaatatcactcctatgcctgaccanagaacctggcagctcccgagcctcctcatctatgatgccactacccaacgacgggccacgtcggaccactccccgaagaccgtaggttccaagggtcggacgtagggttcggggtacctagggggaacctacggtaaccctttccggaaccttccgtaccctaacccgtattacccgaaaggtcccaacgtacccgtaacggtaccgtacccgttaggtaaacggttaaccggttttacgggttaacctttttaacgtttaccgttacgttaccgtacgtcgtacggtccggttaggtacggtttaccgtccgggtcccgttcccggcccttaccgtacccggttttccggggaccggggtaccggggtacccggtacggggtagggtacggtaacggtaaccgaaaccggtacggttacggtacgggtcgtacgacccgtaccgtacgttcgtaccgtttccttaccgtcgttcccccg

SEQ ID NO: 248287 - DNA, 610 bp, Homo sapiens
  misc_feature: GYAE6OF01DZOY2.47.64.F09.1.454.CMB.1.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (316)..(316): a, c, t, g, unknown or other
  misc_feature (316)..(316): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgttctttgtctccgaaggggaanacgcccaccctctcctgcagggccagtcagtaatnttcactcctacttagcctggtaaccaacagtaaacctggtacaggcctcccgaggcctcctcatctatgatgctactcaacgnggccacgtgacactcccagactagttcaggtgacgtaggtggtacgtagggactagtacttcacttcacaccatacacgacacgtcctagacgtactaagtaacgttacttttacggtaactttttaacgtactcgttacgaacgtcgtaggcgttgtacgttccgtggccccttcgtccttacgtaccggtttcgggacgggaacgggtaccgtaggggtagaacgtacgtaaaccgaaaggtacgtggtcggtctaccgactaccgtattcttcgttacttctccgttcccg

SEQ ID NO: 248288 - DNA, 736 bp, Homo sapiens
  misc_feature: GYAE6OF01DR6XB.47.64.F09.1.454.CMB.1.raw
  modified_base (698)..(698): a, c, t, g, unknown or other
  misc_feature (698)..(698): n is a, c, g, or t
  modified_base (719)..(719): a, c, t, g, unknown or other
  misc_feature (719)..(719): n is a, c, g, or t
  modified_base (730)..(730): a, c, t, g, unknown or other
  misc_feature (730)..(730): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctccagataccatcggagtaagttgtgttgacacagtcctccagccctacccttgttcctttgtcctaccgaagggggaaacgcgcccaccctctccgtgccgacgggccagtacaagtaatcttccaaccttcctacttacgaccgtacggtaaccaaactaacggtaaaccttggtaccgacggccctacccagggtccttcctactacttactacgtacggtactcgacctacttacccgaaacggtaccgggaccctaacggtcggaacctaaccgtaccccgaaggtaccgttacgggttaccaagggtcggtacgtaacgggtcggggtacggtacgggaacctaaggttacccttaccacgttaccctaccgaacccttagtaccggaactccgaaaccgtccgtaaggaccctaccggtaagttaaaccggtttacgttttaacgggtaccttttaacttccgtacggtacgacgtacgtacggtaccgttacgactacggtccgtctaacgttcgtacggtccgggaggtacggacggtaggacgagtacgacgacggtagtnttacggcggctcgataccgtnttctgtcttcnccgttc

SEQ ID NO: 248289 - DNA, 870 bp, Homo sapiens
  misc_feature: GYAE6OF01AZ1LI.47.64.F09.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctaggtaccaacagtaaacctggtcaggcctccgaggtctcctanatctatgatgcatcccaacgacgggcccacgtcggaccacttaccccgagtaaccgtagggtttaccgacgggttacgggacgtaacgggttcgggggttaccgtacggggggaacctacggtaacccgttttacctaaccgtttcccgtaacccgtaacccgttacgttacccgaaacggtacccgtaaccgggtacccgtttaacgggaaccggtaccccggttaagggttaaacgtttaaacccggtttttacgggttaacctttttaagttttaaccgttacgggtttaccgaacgggttacccgtaacgggtaccgggttttaacggttaccgggttttacccgggttacggggttccccccgtttcccgggttaccctttcccgggttaacccgggttttccgggggtaacccgggggtaacgggggttaccccgggtaagggggttacggaacgggttaaccgtaaaccggtaaacccgggttaacggttgggttacccgggtcttaccgggtaccctaacccggttacgttccggtttacggttccccttttcgtaacccgttttccccccgg

SEQ ID NO: 248290 - DNA, 649 bp, Homo sapiens
  misc_feature: GYAE6OF01DVBWE.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtcctccagccaccctgttctttgtctccgaaggggaaanacgcccaccctctcctgcgagggccagtcagaatattcactcctacttagcctaggtaccaacagaaacctggtcaggcctcccgaggcctcctcatctatgatgacactacccgaacgacgggccacgtcggactactcccaagacgtagggtttcaggtcggacgtagggtgggtcgtagggactacgtacttcgactcgtccaacatcgagccagtacccgtaagcctaccgtaggtaacgttacgtttaggtaacttttaacgttaccttgtacgtacgtctaggtcggttagtacggtttccgtccggtacccttccggtctttaccgtaccgggtttccgggacgggtacgggaccggtggggtacggacgtacgtaaccgaaacggtacgtgggtacgtactcggacctacgtagttccttagtttccttcgtacttccccg

SEQ ID NO: 248291 - DNA, 839 bp, Homo sapiens
  misc_feature: GYAE6OF01DI869.47.64.F09.1.454.CMB.1.raw
  modified_base (202)..(202): a, c, t, g, unknown or other
  misc_feature (202)..(202): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccacccttgtctttgtcctaccgaaggggaaanacgcccaccctctcctgcagggcccagtcaagtaactattcacttcctacttagccctaggtaacccaacacgtaaaaccgttggtaccacgggtccctacccgaggtccttacctcacttcctatcgattcgacctaactacccgaaacgaccggggaccctaacggtcgggacctaaccgttaccccgaaaggtaaccgtacggtttaccgaggttcgggacgtagggttcggggtaccgtaggggaacctacgggttaccttccgacctaccgtaccaacccgtattaccgacgaccgtaacggacccgttaaggaccgtaccccgttaagggtaaaccgttttaccgtttttaacgggttaaacctttttaaggtttacccgttaggttaccgtacgggtacccgttaacgggttccggttttacggttaaccggttttcccggttacccgggtccccgtttaccccggttacccgtttacccggttacccgggttttacccgggggacggggtttaaaccgggggccccggtaaagggggttacggtaacggtacgttaaccggaaacgttacgggtggtacggtcgtaccgacctacctcgttacgtacgttacctttcgccgtttccccg

SEQ ID NO: 248292 - DNA, 742 bp, Homo sapiens
  misc_feature: GYAE6OF01BGDFV.47.64.F09.1.454.CMB.1.raw
  modified_base (287)..(287): a, c, t, g, unknown or other
  misc_feature (287)..(287): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccgaggggaagcgccaccctctcctgcagggccagtcagatatcactcctacttacgcctaggtaccaacacgtaacctggtacaggcctcccaggcctccgtnacgtctacgtgtatcgacacgtacccgaaacgacggggaccaacgtcggactaaccgtccccgaagaaccgtacgggttaccgaggttcgacggtaggtcggggtacgtacggggaacgtaacggtaccctttacggaccctttcctacccgtaacctacgtaccgacgacccgacggtacccgttaagggaccgttaccgtaaggtaaacgtttacgtttacgttacttaaacgtttttacgttaaccgtttcggttaccgtacggtaccgttacggtaccggttaggttaccgttcgggttcccgcccgttacccgtccgtttaccgttaaccggtttccgggacggggtacgggtaccggaaggggttacgacggtaaccgtaaccggtaaacggtacgttcgggtacgccgtacgaccgtacttacgtccgttcgttaccgtcgttacccg

SEQ ID NO: 248293 - DNA, 633 bp, Homo sapiens
  misc_feature: GYAE6OF01BX37K.47.64.F09.1.454.CMB.1.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccacctgtctttgctccgaggggaaancgccaccctctcctgcagggccagtcagaatatcactcctacttagcctaggtaaccaacagaaacctggtacaggcctcccgaggtcctcctnactctatgatgacactaccaacgacggccacgtggcctactcccaagtacgacggttcaggtcggacgagggttcggggtcgtaggggaactacggtaccttcgacctcgtaccacctatccgaagtcacgtacctaggaccgtaccgtagtaaccgttaacgtttacggttaacttttacgttacgttcgtacgtacggtcgtaacggtccgtaggtacgttcgtacggtccctcgtcctcgtaccgtttcgggacgggtacggtacggagggtacgagtacgtacgaaacggtacgtggtcgtcacgtaccgctaacgtcttggttcctcgtccttccccg

SEQ ID NO: 248294 - DNA, 691 bp, Homo sapiens
  misc_feature: GYAE6OF01CSTEF.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgctccgaaggggaanacgcccaccctctcctgcgacgggccagtcaagaatacttccacgtcctacttacgtcctaggtaacccaacgtacgtaaacccttgggtaccacggccctcccgaaggtcctcctacattactagtgatgaccactaccgaacgcgggtacccacgtcggaccacgttacccccgagtaacgtacgggttcgaggttcggaccgtaggtcgggtacgtaggggactaggtaccttcaacgtcctacacctagtacgaacggcctaacgaccgttaagacgtaccgttaggtaaacgttacgtttacggttaactttacgttacgtctacgtacgtcgagtcgtagtcgttacgtccggtaccgtccgtccttaccgtccggtttcgggaccggtacggggaccgaggggtacgacggtaacgtaaccgaaacggtaccgttgcgggtacctcggactccgtacgttcgttacgttcctcgttccttaccccgg

SEQ ID NO: 248295 - DNA, 764 bp, Homo sapiens
  misc_feature: GYAE6OF01DS1A6.47.64.F09.1.454.CMB.1.raw
  modified_base (203)..(203): a, c, t, g, unknown or other
  misc_feature (203)..(203): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacgagtcctccacgccaccctgttctttgtctccgaaggggaaanacgcccaccctctcctgcgacgggccagtcaagatacttcacttcctacttacgcctggtaaccaacacgaaacctggtacacggcctacccgaggccttcctctatctatcgatgacactaccgaacgaggccctacgtcggccaactaccccgaagtacgtacggttacaggtcggactaggttcggggtcgtacggggactaacggtaccttacgaccttacctaccgtaacctagtaccgaagtacccgaccgggtaaccctaacggacccggtaaccgtacggtaaacggtttaccggttttacgggttaaacctttttagtttaacccgtttagtacgaaccggtgtaacggtcggttacggttacgtttccgtcggtaccccgttccgtaccgtttaccgttaccggtttccggggacgggtaaccggggtaccggtacgggtacggaacgtacgtaaccggtaaacggtaccgtagggttaccggtccgtaccgtaccgtaaccgttcgttacgtttaccgttaaccgtttccgtacccgtttaccccccggg

SEQ ID NO: 248296 - DNA, 722 bp, Homo sapiens
  misc_feature: GYAE6OF01AEQZC.47.64.F09.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (675)..(675): a, c, t, g, unknown or other
  misc_feature (675)..(675): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccagtcggagaagttgtgttgacacagtcctccagcccacctgtctttgctccgaggggaaancgcctaccctntccngcgagggccagtcagtaatacttcacgtcctaattacgccttaggtaacccaaacgaacgaaacccgttggtacgacgggtaccctacccgaggtccttacccgtcaacttcctaagtcggattaccgacctaacgtacccgaaacgcgggaccctacggtacgaccgtaacctaccccgaaggtaccggttaggttaccaagggttcggacctacggggttcggtaccgtagggaactacggttaccttcaccttcgtaccaaccgtcgtacacgcaacgtaccgtagacgtaccgtaagtaacggttcgtttaaggtaaccttttagtacgttcgactacgtaccgaggtaccgtgtaccgttacgtccgacccttcgcgttaccgttaacggttccgggacgggtaacggtaccggaggtggaacgtaccttaaaggaaccggttagtgggtcgtaccncggtaacctacggttactcgttacgttcttaacgtccgtttaccccg

SEQ ID NO: 248297 - DNA, 558 bp, Homo sapiens
  misc_feature: GYAE6OF01CVQYQ.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (387)..(387): a, c, t, g, unknown or other
  misc_feature (387)..(387): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangccaccctctcctgcagggccagtcagaatattcactcctacttagcctggtaccaanagaaacctggtcaggcctcccaggcctcctcatctatggtgcactcccaccgagggccacgtggtactcccgagccgtaaggttcaggtcgggccgtaggttcggggtctggggacaggtacgtttcacttcnccaccatcagcacgcctgactagtctagaagtatttgacttaatttatactgtacagctaagttataatactcgtcttctcgttcggacaggacacgagtggaagtaacgttaaacgacgtggtcggctagacctactattctacgttccttacacttccctcccgctacg

SEQ ID NO: 248298 - DNA, 791 bp, Homo sapiens
  misc_feature: GYAE6OF01BEGDS.47.64.F09.1.454.CMB.1.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccgaggggaancgccaccctctcctgcacgggccagtcagaatattcactcctacttagcctggtaaccaacaagaaccgtggtcaggctcccaggcctccncatctatgatgacactccaaacgacgggcccaacgtcgggacctacgtaccccgaggaaccgtaggttaccagggtcgggtacgtacgggttcggggtcgtacgggggtaacctaacggtacctttaaccgcccgttttaccgacccgtaacccctaagtaccggaccgtaaccgtaccgggtaccccttaaacgggaccgtacccgttaacggtaaacgttttaccgttttttacggttaaaccttttttaacgtttaacccgttaacggttaccgaaggttacccgtaaggttccggttaggtttaacccggtttccgtacccgggttccccgttacccgttacccgttcgtttaaacccggggtttccggggaacggggtaccgggtaaccggagggggtcggaaacgttacggaaaccgtaaaccgggtaacgttgggtaccggtcttaccgaccctaaccgttacgttaccgttggtttcccttcgtacctttcccccgg

SEQ ID NO: 248299 - DNA, 672 bp, Homo sapiens
  misc_feature: GYAE6OF01EW87K.47.64.F09.1.454.CMB.1.raw
  modified_base (203)..(203): a, c, t, g, unknown or other
  misc_feature (203)..(203): n is a, c, g, or t
  modified_base (335)..(335): a, c, t, g, unknown or other
  misc_feature (335)..(335): n is a, c, g, or t
  modified_base (510)..(510): a, c, t, g, unknown or other
  misc_feature (510)..(510): n is a, c, g, or t
  modified_base (527)..(527): a, c, t, g, unknown or other
  misc_feature (527)..(527): n is a, c, g, or t
  modified_base (620)..(621): a, c, t, g, unknown or other
  misc_feature (620)..(621): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggcctcccagactaccagtcggagtaagttgtgttgacacagtctccacgcccacctgtctttgctaccgaggggaaancgcccacctctcctgcgaggccagtcagtatctcactcctattacgccgtggtaacccaacacgaaaccgtggacacggcctacccgacggcctcctacactactagagtatccactaccaaccgaactttnaacgtcggactacgcccagaccgaggttccacggttcggacgtaggtcgggtacgtagggggtacctagggaccttacgaacgttcctacgtaccctaatacccgaagtccaacggcccttaacggaccgtaccgtacggaaccggtaaccgtttaacgggaaaccgttttttanacgttaaccgttacgtnctacgtacgtacgtacgtcgtacgttccgttcggtaccgtccgtcgtaccgtaccgttaccggtccggtacgggtaccggtacgggtacgggnnacgtaggtacggaacggacgtacgtacggtacgtcgacgaccgtgtcgtcg

SEQ ID NO: 248300 - DNA, 688 bp, Homo sapiens
  misc_feature: GYAE6OF01DY8U5.47.64.F09.1.454.CMB.1.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagattccaccggagacatttgttttgacacagtcctccagccaccctgttctttgtctccgaggggaaangcccaccctctcctgcgagggccagtcagagtgttggcngctactagcctggaccaanagagaccgtggcaggctccagctcctnatctatgagtcgccgtccaccgacggggcctacgtcggtttaccagccgtaggtctagtggctaggtcgcgtcgtcgggacaggtacgttcacgtcctacaacgtactaccaaactacggccctagacctaggttctaggtaacgttagtttttacgactttaacggttttattaccgttgtaccgtacggacttaagttacttacgtaagttaccgtacggtcccgtactttaccctacccggtttcggaacccggtaacggggtaccctacgggtaaccgtagggtaaacgtaaacgtttaaaacgggtaacgttacgggtacggtacggttaccgacctaacccgttacgtttaccggttccggtttacctttacccgttagttcccccgtttaccccg

SEQ ID NO: 248301 - DNA, 967 bp, Homo sapiens
  misc_feature: GYAE6OF01AJ5GC.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctaccgaggggaancgccaccctctcctgcgacggccagtcaagtaacttacttccaccttacctacttacggcccttacgggtaacccaaacgtaacggtaaaccgtcgggttaccgaacgggtcccttaccccgacgggtcccttacccgtcctatttaccgtaagttacggtaccgttacggaccctaaaccggttaccccgaaaccggacccgggggtaaccctaaccggttccgggaaccctaaccgtttaacccccggaacgggtaacccgtacggggtttaccggaacgggttcgggtaccgggttaacggggttcggggttaccgggtaacggggggtaacccttaaacgggttacccgtttccctaaacccgtttcccgtaaccggtaaccctacgttacccgacggtacccgtaaccgggtaccgtaacggacccggttaccgttaacgggttaaaccgtttaaccgggttttaaggtttaaccttttaacggttacttacgggttacccgtaaggtacccggttacgggttaccgtttacggttacccggtttcccgggtccggttaccccgttaccggtcccggtttcccggttaccgggtttccgggggaacggggttaacccggggtacgggtaaccgggggtacgtaaccggttaaacgtaacccggggtaaaacggttcgggttaccgggtacgggttcctacccggacccttaccggtaccgttaccggtttacggtttacccctttcgtaccccggtttacccccgg

SEQ ID NO: 248302 - DNA, 764 bp, Homo sapiens
  misc_feature: GYAE6OF01A4IEQ.47.64.F09.1.454.CMB.1.raw
  modified_base (196)..(196): a, c, t, g, unknown or other
  misc_feature (196)..(196): n is a, c, g, or t
  modified_base (736)..(736): a, c, t, g, unknown or other
  misc_feature (736)..(736): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaanacgccaccctctcctgcgagggccagtcagaatattccactcctactacgtccgtacggtaaccaacaacgtaaaccgttcggtacgacggtcctacccgacggtaccttccctacacttacctagtaggacttcgacctaccgtacccgaaacggaccgggtcccacgtacggacctaccgtaccccgaagtaccggttacggttacgagggtcggtacggtagggttcggggttacggtaggggaaccttcggttacccttccgtaccgtccctaccgaaccctacgtaccgaccgaccgtaccgtaaccgtacgtaccggtcccgttaaggtaacgtttacgtttaacgggtttaacttttaacgtcggttccgaacgtacgtaccgtacgggttacgttaggttccggtttccgtacggtcccgttaccgttccttacgggtttaccgggtaccggggacgggtaacgggtacggttaggggacgtagtaaaccggtaaccgtaaaggtcgttgggtacgcgtaccgacctacgtnttccgttcttccgtactccggttacccc

SEQ ID NO: 248303 - DNA, 565 bp, Homo sapiens
  misc_feature: GYAE6OF01DY5VK.47.64.F09.1.454.CMB.1.raw
  modified_base (197)..(197): a, c, t, g, unknown or other
  misc_feature (197)..(197): n is a, c, g, or t
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanacgccaccctctcctgcagggccagtcagaatattcactcctacttancctgtaaccaanagaaacctggacaggcctcccaggcctcctcatctaatgatgcactcccaacgcgggacccagtggacactcccaagactaggttcagtcggcaggtggtctgggacngtacttcactcacacntcagcagctagcgcctagaagttcttaggtactttactacgtntacgagctagtcgtgtagttccngtcctcgtctacgtcgttcggacgggacgtacggagggtagacgtacacgtaaaccggagttcgggaggtcctacggaccctacgttacgtcgttagttaccgttcctcgttaccccg

SEQ ID NO: 248304 - DNA, 733 bp, Homo sapiens
  misc_feature: GYAE6OF01B4Y66.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgttctttgtctccgaaggggaaagagcccaccctctcctgcgacgggccagtcaagtaattacttcaccttccttacttacgcctacggtaaccaacaacgaaaccgtggtccacgggccttcccgacggcttccctcattctatgatgcactaccaacgacgggccctagtcggacacctccgaagtacgtacggttacaggtcggtacgtagggtcgggtacgtacggggactacgtaccttcaaccttcactaccatacgacgaccgtacgtccgtaggacgtacctaggtaacgttacgtttacggttaacgttttacttaaccgttcgtactacggtacgtacggtacggttagttacggttccgtaccggttcccgttaccgtccgttaccgttacccgggttacggggacggggtaccgggtaccgggtagggtacgggtaacgtaaccggtaaaccgaaaccgggttacgttcgggtacgggttcctacgggtacccgtaaccgttacgtttcgtttacccgtttaccgtttccctaaccgtttccccgg

SEQ ID NO: 248305 - DNA, 816 bp, Homo sapiens
  misc_feature: GYAE6OF01CG7ZP.47.64.F09.1.454.CMB.1.raw
  modified_base (194)..(194): a, c, t, g, unknown or other
  misc_feature (194)..(194): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtcttgtctccgaggggaanacgccaccctctcctgcgagggccagtcagagtgttggcagtctacttagcctaggtaaccaacagaaacctgggaccagggcctacccgaggtcctccgtacactcctagtcgaactcgaccacgtacccaagacgggccctagtcggacacgtcccgagtccgtaggttaccgagggtacggactaaggtggtaacggtcggtacggggaactagggttactttaccgaaccgttccgtaaccaacgtaactccggaacgtccgtaacgtcccgttagacccgaacggtcccgtttaaagggtaaacgtttaccgttttagaacccgttaaaggtttaacttaaacccgtttacgttaacggttaccgaacggttaaccgttaagggtttacggttacgggtttaaccggggaaacctaacggggtttaaccgggtttccggggtaaacccgggtttacccggggaaacccgggttaaaacgggggtacccggttaaacggggggtaaaccgtaaaaccggttccggtaaaaccgggaccggttaaacgggttccggggtaacgggtacccgtacgggtaaaccccgtaacctttaggtttcccgttcggttttaacccc

SEQ ID NO: 248306 - DNA, 658 bp, Homo sapiens
  misc_feature: GYAE6OF01BXUGJ.47.64.F09.1.454.CMB.1.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagacattgttttgacacagtctccagccaccctgtctttgtctccgaggggaaagngccaccctctcctgcagggccagtcagagtgttggcagctacttagcctggaccaacagaacctggccaggcctccgaggcctcctnatctatgatgctactacccgaaacgacgggcccaacgtcggaccacgtccccaaggtcccgtaagggtttccgaggtcgggaccgtaagggtcggtaacggttccgtagggggaacctacggtaccttcaccttccgtaccaacctactaccgacgcaacgaccgtaagcgtacctagaagttatttcgacttactttacttacgtgttaccagtacgaggtaccgtacgacctaacgtccggtacccttacgtaccgttaccggtttcgggacgggtaacggggtaccggtaggggtacggaacgtacgtaccggaacggtacggtacgttcggtcgggacgttcgaccctacgtacttcgtacgttcccg

SEQ ID NO: 248307 - DNA, 831 bp, Homo sapiens
  misc_feature: GYAE6OF01E4QX7.47.64.F09.1.454.CMB.1.raw
  modified_base (197)..(197): a, c, t, g, unknown or other
  misc_feature (197)..(197): n is a, c, g, or t
  modified_base (259)..(259): a, c, t, g, unknown or other
  misc_feature (259)..(259): n is a, c, g, or t
tcagagctcacgtacacgaccggtgctcgatttagcgcgtatacaagggggagaactgctcagttaggacccagagggaaccatggaagccccagctcagcttctcttcctcctgctactctggctcccagataccatcggagtaagttgtgttgacacagtctccagccaccctgtctttgtctccgaaggggaancgccaccctctcctgcgagggccagtcaagaatattcactcctacttagcctaggtaccaanacgtaaacctggaccaggcctacccgaggtcctcctcactctagtgatcgaccacgtacccaacgtacgggccctacgtcggacctactaccccgagtaccgtaggttaccgaggtcggacgtagggttcggggtacgtaggggaactacgtaccgtttaccgaccttaccctaccgaaccctataccgaacgacctaacggtacccgtaaggaccgtacccgtaaggtaaacggttacccgttttaagggtaaccctttttaagttaccgtacgttaccgacggtcgtaacggttcccggttaaggttaccggtttccggtaccgggtcccccgtttacccggtcccgtttacccggtttaacccgggtttaccggggggtaaccccgggggtaacggggtaacccggggtaacggggggtttaaccgggacggtttaaacccggttcgggaaaaccgggtaaaccccgggtaagggtttcgggggttccccgggaacgttacccgggaacccttaaaccccggttactttaccccgggttttcgttccccgttttaaccccgttaccccg

SEQ ID NO: 248308 - DNA, 1009 bp, Homo sapiens
  misc_feature: GYAE6OF01DC7XL.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagattccacgtaggacaattgtttgtacacagtactcctacgaccaccctcgttcgtttcgttcgtcctacggggaaaagggaacgcccacccctacccttcctcgtcgacgggaccgacgtacgacgtaagttagttcggtaccacgtaccttaaccttacggtcccgttacggtaacccaaacgaaccggtaaaaccgttcggggaccgaacgggtcccttaccccggaaccggggtcccttaccccgttacctaacgtttacccttaagttacggtaacggttcgtaacccggtaaccttaaccccggaaaacccggtaccgggggaccccctaaccgttccggggaacctaacccggttaaccccccgaaggttaaccccggtaaccggggttaccgtacgggttacgggtaaccgtacgggttagggtaccgggttacggggtacggaacgtaacgttaccgttacctacctcccgtaacacctatacgacaccgtacgtaacgtacggtacgtacgtaggtaacgttttagttaacgtttacgttacttttacgtacgtacgtacgtacgtaccggtagtaccggttacgtaaccggtcccgttaccggttaccccttacgtttaccgggttacccggggtttaaccgggggaaccgggggtaacccggggttaacggggttaaaccgggggtaacggtaaccggttaaacccggggttaaaacgtaaacccgggggtttaaacgggtttaacccgggtttaccgggggtaaccggttaccccggttaacccggttaaacccgtttaacccggttttaccggtttaaaccccccgggtttacccggtttttacccgttttaaaccccccccgg

SEQ ID NO: 248309 - DNA, 766 bp, Homo sapiens
  misc_feature: GYAE6OF01CXJPB.47.64.F09.1.454.CMB.1.raw
  modified_base (491)..(491): a, c, t, g, unknown or other
  misc_feature (491)..(491): n is a, c, g, or t
tcagagctcacgtacacgaccggtgctcgatttagcgcgtatacaagggggaggaactgctcagttaggacccagagggaaccatggaagccccagctcagcttctccttcctcctgctactctggctcccagataccatcggagtaagttgtgttgacacagtctccagccctacccttgttctttcgtcctaccggaaggggaaacgacgccctacccttctccgtgccgacgggccaggtacaagtaattacttaccaaccttccttaacgttacgtccgttacggaacccaaagaaacgtaaccgtggtaccgaacgggtccctacccgaacggtcctaccctctattcctatcgactcgacctactaaccgaaacggccgggtacccacggtcggacccaacgtcccggtaagaccggtacggtttcgaggtcggtaccggtagggttcggtacggtacgggacacgtacctcgactcgaccactntcccgagtcgacgtacgtcggacgtccgtaagtaacgtttacgggtttacttacgttttaacgtcgttacgtacgacgtacgtaggtacgtttcggtacggtttccgtaccggtcccgttaccggtcccgtttccgtaccgggttacccgggggacggttaaccgggaccgggtaggggtacgtaacgtaaacccgaacggtaaaccgggtagttcggaggtccgtccgtaaccacggttcttacggttaccttccgttccgtaccctttccccg

SEQ ID NO: 248310 - DNA, 843 bp, Homo sapiens
  misc_feature: GYAE6OF01A2FJD.47.64.F09.1.454.CMB.1.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (282)..(282): a, c, t, g, unknown or other
  misc_feature (282)..(282): n is a, c, g, or t
tcagagctcacgtacacgaccggtgctcgatttagcgcgtatacaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaanacgccacatctccnggtacggccgtcagagtattagctaactcaacttagcccgtaggtaacccagctaaggacgtaccgtggtnacggcctcccgaggccttccgtcattcctagtgacttggacctacgtaacccgaacgtccggggaccctaacggccggtactaacccgtacccccgaaggtaacccggttcggtttaccgaacgggttacggggccgtaaacggttcggggggtaaccgttaggggaaccctagggtttaccccttactaccgtttaccgaaacccgacttaacgttccgaaggtaccccgtaagttaccccgtaacggtaacccgttcccgttaaacggttaaaccgggttaccgtttttaaccgggttaaccgttttttaaccgttaaacccggttccggtttaacccgagggttaacccgtaaggggttcccggtttaaggttaacccggtttcccgtaaccggggttcccccttaccgggtacccgtttacccgtacggggtttacccggggaccgggtaaccggggtaccggtaacggggttaacgacggtaactaaccgggaaacgtacccgttaggtacccgttacggtaacccggaccttaacccgtcgtttcccgtaaccgg

SEQ ID NO: 248311 - DNA, 705 bp, Homo sapiens
  misc_feature: GYAE6OF01ESUMS.47.64.F09.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (262)..(262): a, c, t, g, unknown or other
  misc_feature (262)..(262): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtcctaccgaggggaaancgccaccctctcngcgagggccagtcaagatattcacctcctacttacgcctggtaaccaanagtaacctggtacacggtcctccgaggtcctcctcactctagtgactcgacactaccgaacgtacgggacctacgtggcctactccccgagacggtacgttcgacggtcggacgtacggtgggtacggtaggggtaactacggtaccgtttaccgtacttacccgtacctaaccgtacgttacgaacgtcctaacggaccgttaacggacccgtaccgtaaggtaaaccggtttcgtttaaccggttaacttttacgtaacgttgtaccgtaagacgtagtccgttagtacggttccgtcgtccgtccgtaccgttcggtacggtttccggggaccgtaaggggtaccgtaggggtacgtaacgtaacgaaccgtaaaccgggcttggggtaccgcttaccgactacccgttgtacccgttgttccctcgttaccgttccccg

SEQ ID NO: 248312 - DNA, 722 bp, Homo sapiens
  misc_feature: GYAE6OF01AI1S2.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctctgcagggccagtcagaatatcactcctattgcctggtaccaacagaacctggtcaggcctcccaggcctcctcatctatgatcgcactaccgaacgacgggcccacgtcgggaccacctaccccgaggaccgtacgggttcaagggttcgggcgtagggttcgggggttacggtacggggacgtacggttaacccttctaccgttccctacccgaaccctacgttaccgacgaccgaccggtcccttaagggaccgtaccgttaggaaaccggttaccgtttttaacgggttaactttttaacgttaccgtttaggtaccgtaggtccgtaacggtcggttacggttacgtttccgtcggtccccgttacccgtccttaccggttaccggtttccggggacggggtaaccgggtaccgggtacggggtacggtagtaaccgtaacgaaaccggtcgtacgggtcggtactcggaccaccgttattaccgttagtttcccttcgtccgttaccccg

SEQ ID NO: 248313 - DNA, 708 bp, Homo sapiens
  misc_feature: GYAE6OF01D2OT4.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctccagataccatcggagaagttgtgttgacacagtctccagccaccttgttctttgtctccgaaggggaancgcccaccctctcctgacagggccagtcaagaattacttcactcctacttacgccttaggtaaccaaacagaaaccgtggtcgaacggcctcccgaggccttcctacatctaatgatcgacactaccaacgacgggccaacgtcggactactcccgaaagaccgtaggttcgagtcgggactagggttcgggtacgtacggggaactaacggttacctttaccgaccgtttaccacccgaacctacttacgaacggtacctacggtaccgtaaggaccgtaccgttaggtaaacgttacgttttacggtaactttttaacgtttaccgttacgttacgtaccggtcgacggttcggttaggttaccgtttccgttcggtacccgttcgtaccttaccgtacggtttccgggacgggtacgggtaccggtaggggtacgagtacgtaaccgtaaacgtacgttggtacggcgtacgaccaacgtagttaccttagttacttcctacgttcccg

SEQ ID NO: 248314 - DNA, 856 bp, Homo sapiens
  misc_feature: GYAE6OF01BR14I.47.64.F09.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagagctcacgtacacgaccggtgctcgatttagcgcgtatacaaggggggaggaactgctcagttaggacccagagggaaccatggaagccccagcgcagcttctcttcctcctgctactctggctcccagagaccatggaagaaatgtgatgacgcagtctccagccaccctgtctgtctctccgaaggggaaancgccaccatcctcctggtacgggccgtnagagtatagcatcaacttgcctggtaccagcaggacgaccgtgggacacggcctacccgaggtcctcctacaattccgtaagtcggaactcggacctaacgttacccgaaacggtaccggggaccctacggttacgggaccctaaccgttacccccgaaggtccccgttaaggggtttccgaagggttaccggggacgtacgggtagggttaaccgggttccggttacggggggaaccctaacgggttaccccttttaccgaacccgtttaccctaccctaaccgtactaacccggaacggtacccgtaaccgggtacccgtaacgggtaaccgtaccggttaaggtaacgttttaacgttttcggtaaaccctttacgtttttaacgttaccgttaggttaacccgtaacggtccgtaaacggttaccgggttaaaccggtaaccggtttaacccggttccgggttaccccttaccggtttaccgttacccggggtttaccgggggaacccgggggtaaccggggtaacccgggggtaagggggttacgggaaacttacgggtaaaccggaacggtaaccggtaacggttcggggtaacccggtccgtacgtaccccgtaacgttaccg

SEQ ID NO: 248315 - DNA, 726 bp, Homo sapiens
  misc_feature: GYAE6OF01DN4XV.47.64.F09.1.454.CMB.1.raw
  modified_base (202)..(202): a, c, t, g, unknown or other
  misc_feature (202)..(202): n is a, c, g, or t
  modified_base (554)..(554): a, c, t, g, unknown or other
  misc_feature (554)..(554): n is a, c, g, or t
  modified_base (559)..(559): a, c, t, g, unknown or other
  misc_feature (559)..(559): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctccagataccatcggagtaagttgtgttgacacagtctccagccctacctgttcttttgcgtccgaaggggaaancgcccaccctctccgtgcgacgggacctagtcaagtaacttacttcctactaccttacgttacgaccgttacggtaaccaacgaacgtaaccgttggacgacgtcctacccgagtccctacactattctatagtacgttcatacccgtaaccgaaacgggtcccgggaacccttcgggacctaccttacccgaacgtacggtacggttacggttacggagggtcccgtagggtacggttcggtaacggtacggacgtactttcccgtacaccttacccgactactcgtacgaacgccgtaacgtcgaacggtccgtaagtcgtaaacgttcgtttaacgttatacggttacncgtanacgcgtggacgtagttctccggtaactccgtacgttccgacggttacgggaccgaggggtaccgtaacgggtggtacggaattccaaaacgggtaccgtgttcgggaaccgtcgtaaaccggtccttacttaccggtttacgtactttccgtccaccgtttaccccg

SEQ ID NO: 248316 - DNA, 656 bp, Homo sapiens
  misc_feature: GYAE6OF01C8QZG.47.64.F09.1.454.CMB.1.raw
  modified_base (144)..(144): a, c, t, g, unknown or other
  misc_feature (144)..(144): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcgganaagtttgtgttgacacagtcctccagccacctgttctttgctccgaaggggtaaancgccctaccctntcctgccgagggccagtcagaattcttcactcctattagcctggaaccactacgaacctggtcacggcctccagcctcctctatcgtatcgatcgacactacccgaacgtacgggacccacgtcggactactaccccaagactaggttcaggtggacgtaggtcgggtacgtagggaactacgtacttccgaccttaccgactaaccgtatccgacgacgacgtacccgtagacgtccgtaggaaacgtttacgttttaggtaactttttaagtccgttagtacacgtcgagtcggttagttcgttccgtacggtccctaccgttccgttaccgttcggtttccgggcgggtaacggtccgggtagggtacgaacgtacgtacgtaaacgtcgttaggccggtacgtcgaccacgtacttacgtatttccgtctccttccccgg

SEQ ID NO: 248317 - DNA, 646 bp, Homo sapiens
  misc_feature: GYAE6OF01BD1HQ.47.64.F09.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (424)..(424): a, c, t, g, unknown or other
  misc_feature (424)..(424): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctcccagcccaccctgttctttgtctccgagggaaangcccaccctctcctgcaggccagtcagtgtgttgcngctactagcctgtaccaactagaacctggccaggccctcccgaggccctcctctatcctagtcgactgacctactaccgaaaccgcgggtaccctaagtcggtaccacgttcccaacgtcccgtacggttcagggtcggactaggtcgtaggtcgtagggtaacagtacttcaccttcgtactacgtancccgtagcctacgtccgtgccacgtctaagtagttacgtttagtaactttagtttactagtaactaacggtacgttaccgtacgttccctactccggtaccgtcgggacggtaccggaaccgtaagggtacggtaacgaagtaaacgggtaagttacgtgggtaggtcccgtagcccgtaaacgtcttcgtacgtttcccagtccctttcccgtcccgtacg

SEQ ID NO: 248318 - DNA, 613 bp, Homo sapiens
  misc_feature: GYAE6OF01BRKLE.47.64.F09.1.454.CMB.1.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactgggtgaagccttcggagacccctgtcccctcacttgctattgtctcgtggtgctccatcactatttatntggnggctgactccgcacgcccgagggacggntggatggagtggagtattatttatagtgggactactcttacacctactcctacaagtagtacgtacgtttacatactccgacgacgaccgtacgtaccgaagtaactacctacttacccgtaccttacgaaactgaccgtctcgtacgtcggacccgccgtacacgtaccgtcggtactttgtttaacttacgtcgttacgagacgtacgtcgacccggacgagtacgtactaagttacgtacgacgtagggttacggtttagagtttagggtcgggtacgaaaggggacgtacgggtaccgtaccgtccgtacgacgacgtcccgtaccgaacccgg

SEQ ID NO: 248319 - DNA, 763 bp, Homo sapiens
  misc_feature: GYAE6OF01C98GM.47.64.F09.1.454.CMB.1.raw
  modified_base (201)..(201): a, c, t, g, unknown or other
  misc_feature (201)..(201): n is a, c, g, or t
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacagtcctccacgcccaccctgtctttgctccgaaggggaaancgcccaccctctcctgcgacgggccagtcaagtaatacttcactcctacttagccctaggtaacccaanacgaaacctggtcacggcctccaggcctccnctatcgtatgatgactactaccaacgacgggacccacgttcggaccacgtcccccaagtaactacgggttacctaggtcggacgtaggttcggggttacgtaggggaacctacgggtaacctttccaaccgttccctaccaaaccctacgttccgaacggtacccacggtacccgttaacggaccggtacccgttaacgggtaaacgttaacgtttttacgggttaaactttttaacgtttaccgttacgttaccgaacggtaccgtacggttcggttacggtaaccgttttccggttacgggtacccccttcccggtacctttacccggtaccggttttaccgggggaccggggtaacggggtaccggtagggggtacgaaggtaccttaacggaaaccggtacgtggtacggccgttcggacctaccgtacttacgttcgttacctcgtacgttccccgg

SEQ ID NO: 248320 - DNA, 661 bp, Homo sapiens
  misc_feature: GYAE6OF01DZXGF.47.64.F09.1.454.CMB.1.raw
tcagagctcacgtacacgaccggtgctcgatttagcgcgtatacaagggggctttctgagagtcatggatctcatgtgacaagaaaatgaagcacctgtggttcttcctcctgctggtggcggctcccagatgggtcctgtcccagctgcaactgcgaggaggtccgggcccagggactgggtagaacggtccgtttacggacgtaccctcgttcccctcacttgctagttcgtctcgtggtcgctaccatctacttagttttaattgtggtggctggactccgccacgcccgagggaggcgtaggagtggtgttggagttattagtttagtagtggactacttacttaaccacctactcctacgtaagtacgtacgtacttctactactcgactacgaccgtacgtaccgaagtaacgtctaccttcctaccgtagaaaccgtgtaacgtcttcgtcggtacgaccccgccgacgacgaaccgtacgtctttacgtttacttacgttagttacgactacgtatccgaccgaacggagtagtaccttagtacgtcgtacgttaggtttacgttacgtagtttacggttacggggaccgtaagggtacgtaacggttcccgacggttccctacggaccctacgtccctacccggaacccggg

SEQ ID NO: 248321 - DNA, 700 bp, Homo sapiens
  misc_feature: GYAE6OF01CP3DE.47.64.F09.1.454.CMB.1.raw
  modified_base (144)..(144): a, c, t, g, unknown or other
  misc_feature (144)..(144): n is a, c, g, or t
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
  modified_base (535)..(535): a, c, t, g, unknown or other
  misc_feature (535)..(535): n is a, c, g, or t
  modified_base (544)..(544): a, c, t, g, unknown or other
  misc_feature (544)..(544): n is a, c, g, or t
  modified_base (640)..(640): a, c, t, g, unknown or other
  misc_feature (640)..(640): n is a, c, g, or t
tcagagctcacgtacacgaccggtgctcgatttagcgcgtatacaaggggggaggaactgctcagttaggacccagagggaaccatggaagcccagctcagcttctccttcctcctgctactctggctccagataccatcgganaagttgtgtagacatagtctccagccaccctgttcttgtactccgaaggggaaatcgcccaccctctccgtgcgagggtccagcaagtaatnttacactccctagtacgcctacggaaccaaanacgtaaaccgtcggtacgaacggcctaccgaggtcctccctataacgtaccttagtgacttcgacctaactaccgaaacgcgggtaccacgttcggacacgtccccgaagtcgaacgttgacggtgacgtaaggttcgaacgtcggtacgggacaacggttacncctaactttcccgaanacctagttacggacgtacacgtaccgtagggacctacgtaacgtaaagtttctttcggaaacctacgttttaatcctagttaccganacgttacgngtaacgtacgtaactggtcctactcggttaccgttcgggaaccgggtaggaccggttaaggttagggaactaggtaccgaaacggtacttacgggnggttaccggacgttacccgggactaaaccccgtattttcccggtaacttccgttaacccg

SEQ ID NO: 248322 - DNA, 755 bp, Homo sapiens
  misc_feature: GYAE6OF01AH2Z0.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacagtctccagccaccctgtctttgtctccgaggggaaancgcccaccctctcctgcagggccagtcagatattcactcctacttagcctggtaccaagacgaaacctggtcaggcctcccgaggcctcctcatctatgatcgcactaccgaacgacgggcccacgtcggacctactccccgaaggtaacctaggttaccaaggtacgtaacgtaacgggttcggggtaccgtacggggggaaccaaggtaaccgtttccgaacctttccgttaacccgaaaccccgtaattccggaaacggtccctaaaccgggtcccgtttaaacgggaacggtaccccgttagggtaaaccggtttaaccgtttttacgggttaactttttacgtttaccggtacgggtttaccacggtaccgtaggtaccggttaggtaacgtttccgtacggtccccgttccggtccgttaccgttaccggtttccggggacggggtaccgggtaccggtaggggtacggacgtacgtaaccgtaaacggtacgtgggtcggtacttacggaccctacctacgttccgtaggttccttccgtacgttccccg

SEQ ID NO: 248323 - DNA, 819 bp, Homo sapiens
  misc_feature: GYAE6OF01AWQNY.47.64.F09.1.454.CMB.1.raw
tcagagctcacgtacacgaccggtgctcgatttagcgcgtatacaagggggtcgttttcgtggagtagtcatggactctcatgtgccaagaaaatgaagcactgttggttcttccttcctgctggtggcgctccagatgggtcctagtcccagctaggcaacgtgacaggacgtcggccaggactgggtcgaacgcctttcggagtaccccttgtccccttcaccgtttcgactactttggtccttcgttggggtcggccttcctaacgtccgaacccgttaggtttttttaacgtagtttacgggggtcgggggtaccgttggaaccgttcccgaccgaaccggcccccccggaagggggaaacgggggccgtagggtaaacgttggggtaatttgggggtaagtttaattaagtttttaagtaaacgttacggggtaacctactttccgttttaaaccaacccctagtaccccttacgaacgtagtaccggtattttaccattaacgtccgactacgtaccgacggtaccgaagtaaacttccgttaaacctttcccgttacccctaggtaaaccttacgaggtcccttcgttcggttacggaccccggtccgacgacggaacccgtacgggtccttttaggtttttacttaccgtttaggttccgtaagactacgtcgacccggaccgaagggtcacgttaattggtaccgtactcggttaacggttttgaagttttcgggttacgggacgtaacggggcgtaaaccgggtcctaccggttccgtacccgacgacccgtccgtacccgaacccggg

SEQ ID NO: 248324 - DNA, 771 bp, Homo sapiens
  misc_feature: GYAE6OF01A69VW.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanacgcccaccctctcctggcgagggccagtcaagtaatattcactcctaacttagccttggtaacccaacacgtaaaccgtggtaccgaggcctcccgaggtcctccctcacttctatgatcgctactacccaacgacgggccctacgtcggacctaccgtaccccgaagtaaccgtacgggtttccaagggtcggcgtaagggttcggggtaccgtacggggaacctaggtacccttcctaccgttaccctaccgaaccctagtaccagtccaacgtcctaaggacgtccgtaggtaaacgttaccgtttacgttaacttttaagttaccgtacgttacgaacggtcgtaacggtcggttacgtacggtttccggtacggtccccgtccggtaccctttaccggttaccggtttccgggggaaccgggtacccggggttaccggtaacgggggttacgggaacgtaacccgtaaaccggtaaaaccgggttacggttagggttccgggtccgtacccggacccttaaccgtaaccgttttccgttacgttcccgtttacctaccgtttcccccg

SEQ ID NO: 248325 - DNA, 715 bp, Homo sapiens
  misc_feature: GYAE6OF01DVHID.47.64.F09.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (292)..(292): a, c, t, g, unknown or other
  misc_feature (292)..(292): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaaggggaanagccaccctctcctgcagggtcagtcagagtgttanacagctacttagtctaggtaaccaaggacgaaacctggaccaggcctcccaggctcctnatcgtgggatgcactaccaacgagggccgcgtggcactcccagcccaggttcaggtggactaggttggggtctaggggactagtacctttacgacctttccgaccaaccgtataccgaacgtccgtaacgacccgttaaggacgtacccgttaaggtaaaacggtttattttttacggaacctttaaaggttttaactttaaccgttagttaccgtaagtaaccgttaaaacgttaaaacgttaccgtacggtacccttacccggtaccttaccgttaccggtttaccggggacggggtaacgggacccggtaggggtacgtaaaccgtaagttacggaaaacgtaaccgttacgggtaggtaccgttagacccgtacctaacgttccgttacgttacctttactaccgtttccctaccccgg

SEQ ID NO: 248326 - DNA, 668 bp, Homo sapiens
  misc_feature: GYAE6OF01BDBZI.47.64.F09.1.454.CMB.1.raw
  modified_base (177)..(177): a, c, t, g, unknown or other
  misc_feature (177)..(177): n is a, c, g, or t
  modified_base (350)..(350): a, c, t, g, unknown or other
  misc_feature (350)..(350): n is a, c, g, or t
  modified_base (500)..(500): a, c, t, g, unknown or other
  misc_feature (500)..(500): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggngaagtccgttcggacgtaccctgtcccctctacgttgctattcgtctcgtggtcgcctccatccacttagttttaatgtgggtggctggactccgccacgcccgagggacggctaggatggtagtgggagtattatttagagtgggtactacttcttaaccacctactcctanaagtcgtacgtacgttacatacgtaccgacgtaacgaccgtaccggtacgaagtaactctaccgtttcctacccgttacgtaaacgtcgacgtcctcgtcggtacgacccgccggaacacgtaccgacgttcgtttatttacgtacgttnttacggaacgtaaccgtctcgacccggacgagtacgtacttagttacgccggtagttacggttacggtttagtaagtttcgggttacgggaccgtaaaggggtccgtaacgggtcccgtaaccccgttcggaccccgtacgcccgtaccccgtaccgtaaaccccggg

SEQ ID NO: 248327 - DNA, 571 bp, Homo sapiens
  misc_feature: GYAE6OF01EI08Q.47.64.F09.1.454.CMB.1.raw
  modified_base (192)..(192): a, c, t, g, unknown or other
  misc_feature (192)..(192): n is a, c, g, or t
  modified_base (253)..(253): a, c, t, g, unknown or other
  misc_feature (253)..(253): n is a, c, g, or t
  modified_base (561)..(561): a, c, t, g, unknown or other
  misc_feature (561)..(561): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccacctgtctttgctcaggggaaangccaccctctcctgcagggccagtcaagaatattcactcctacttacgcctggtaaccaanagaaacctggtcaggctcccaggcctcctcatctatgattgcattcccaaagacggggcctactgggaccacgtccccagactaggttccaggtcggcaggtcgggtcgtgggacacgtacttcgactcgtcaacctatcagcacgctagagcctaggaacgtactttaggtactttagttactcgtcacgcgtagacgtgtacgttctacggccctccgctcgtacgtttcggcggtacgggaccgtagggtaggagtacgaacgaaacgtacgtaggtcggtctgacctacgacttcgtatccttntccttacccg

SEQ ID NO: 248328 - DNA, 744 bp, Homo sapiens
  misc_feature: GYAE6OF01DZHYD.47.64.F09.1.454.CMB.1.raw
tcagagctcacgtacacgaccggtgctcgatttagcgcgtatacaaggggggaggaactgctcagttaggacccagagggaaccatggaagccccagctcagcttctcttcctcctgctactctggctcccagattcccaccggagactatttgttttgacacagtcctccagccctaccctgttctttgtcctccgaaggggaagcgcccaccctctccgtcgcgacgggccagtcgagagtgttggcagtcttacgtacgccgtaggtaacccaagtaagaacgtccgtacggaccgacggaccctacccgacggtcctccgtacacttactatcgtatcgacctactacccgaacggccgggacccacggtcggacctaccgtccccgacggtacccgtaggttccgaaggtcggaccgtaggtacggtaggtccggtagggaccgtaacgttactttaccgacccttcctaccacccgtacgttaccgacgaccgacgtacccgtagacccggtacgtaaaggtaacgtttacgtttacgtaacccttttacgttttaaccttacggtacgttacgacggtacgtacggttaccgtaacggtaaccttaaccggttccgtaccttacgtaccgttccggttacgggaccggtacgggtacgtacggggtagaacgtacgtacggtaaggtacgtacggtcggtacgaccgtacgacccttaagtcgttccgttgtacccg

SEQ ID NO: 248329 - DNA, 725 bp, Homo sapiens
  misc_feature: GYAE6OF01EJDUK.47.64.F09.1.454.CMB.1.raw
  modified_base (438)..(438): a, c, t, g, unknown or other
  misc_feature (438)..(438): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagccacccttgtctttgtctaccgaggggaaagacgcccaccctctccgtgcgacgggccagtcaagtaattacttcaccttcctacgtttacgccgttacggtaaaccaaacgaacgtaaaacccgttgggtaccgacgggtccctaccccgaaggtcccttccctactacttccttatggtaacttgacctactacccgaaacggcgggaccctacgtcgacctactccccagtacgtacggttcgaggtcgcgtaggttcgggtacgngggaacacggtaccgtttccaccttccgtaccaacctagtaccagaccgacgtaccgtaagaccgtaccgtagtaacgttacgttttacggtaacttttacttaacgtcgttacacggtcgtacgtcggtagttaccgtccgtcgtccccttacgccgtttaccgtacggtttccgggacgggtccgggtacgtggggacggacgttacaaacccggtaaacggtacgttgggtacgtcgcggtaccctaacgtcgttacttacggtttcctaccgttcgttccccg

SEQ ID NO: 248330 - DNA, 632 bp, Homo sapiens
  misc_feature: GYAE6OF01AND4W.47.64.F09.1.454.CMB.1.raw
  modified_base (249)..(249): a, c, t, g, unknown or other
  misc_feature (249)..(249): n is a, c, g, or t
  modified_base (391)..(391): a, c, t, g, unknown or other
  misc_feature (391)..(391): n is a, c, g, or t
  modified_base (555)..(555): a, c, t, g, unknown or other
  misc_feature (555)..(555): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgctattgtctcgtggtgctccatcactagttttattgttgggngggtctggactccgccacgcccgaggggacggcgtggagtggtagttgggagtagttatttataagtgggactacgttctttaaccacctctacctacaaggtgtcgtacgttacatacgtccgacagtaccacgtacgtanactcgtacttctcctagtaactgacgtctctacgtcgacccgcgacgtacgaccgtacgttcgttagtttacgtttacgtcgtttacggaacgtactaacgtccgacccggtacgaagtacgtaccttagttacgtcggtacgttacggttacgttttaacggngtttaagggtccgggaacgtagggtaaccgtagggtcccgacgtccgtaccgaccgtcgcccgttaccgaacccggg

SEQ ID NO: 248331 - DNA, 671 bp, Homo sapiens
  misc_feature: GYAE6OF01BH0B3.47.64.F09.1.454.CMB.1.raw
  modified_base (195)..(195): a, c, t, g, unknown or other
  misc_feature (195)..(195): n is a, c, g, or t
  modified_base (412)..(412): a, c, t, g, unknown or other
  misc_feature (412)..(412): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccagtcggagtaagttgtgttgacacagtctccagcccacctgtcttgctccgagggaancgccaccctctctgcgaggccagtcagaatattcactcctatagcctaggtaaccaagacgaaacctgtacgacggcctccgaggtcctcctcatctagtgatgtaccactaacccgaagtcggacctacgtgacctacgtacccaaggactaggttacaggtggaccgtaggttcggggtcgtagggacctaggtaccttcgacttcgacacctancgagcacgccgtagactccgtagaacgttactttacggtactttactagtcgtacgaagtccgtaagtccgggtagttagtacccgttccggcccttaccgtacgttaccggttaccggttaccgggaacggggttaaccggacggtaggggacgtaacgaaccgtaaacggtaaaccgtggtaccggttacggtacctcggtaaaccccgtacgttaccttacgttacgtttaccccttcgtaaccgtttacccccgg

SEQ ID NO: 248332 - DNA, 805 bp, Homo sapiens
  misc_feature: GYAE6OF01EXMJD.47.64.F09.1.454.CMB.1.raw
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgctagggagtcgggcccaggactgggtagaacgtcccgttcgggacgaccccttgtcccctctaccgtttgacctatttcggtccttcgttgggtcggtcctcccaattcctaacccgttaagtttttaattaggttggggtacggggtctggaactcccgaccgaccgccccccgtaaggggaacggggcgtagggaagtggtaggttgggaagttattattttaagtaagtggggtactacttaccttaacaacccctactcccctacgaacgtagttcgtaactttacccaagttacgttcccggactaacgaaccgtaccgtacccggtaagtaaaccgtaccttaaacctttccctaccccgttaacgtaaaaccgttggtaaccgtcttaccgttcggtccggaccccgtacccgacgtaacgaaccgaccggttacttacggttttaacttaacgttcgtttacgacgtaactacgtaccggaccgtaccggtagtaacgtcgttaagttacggtcggtacgttacggtttaacggtttcgtaacgtttaggggttacgggtacggtaaacggggtaacggtaacgggtacccctacccggttcccgtacccgaccgtaaccgtccccgtacccgtaaacccggg

SEQ ID NO: 248333 - DNA, 579 bp, Homo sapiens
  misc_feature: GYAE6OF01A6XRN.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (303)..(303): a, c, t, g, unknown or other
  misc_feature (303)..(303): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangccaccctctcctgcagggccagtcagaatattcactcctacttagcctggtaccaanagaaacctggtcaggctcccaggctcctcatctatgatgcatccaacgngggccactggcactcccagacaggttcaggtggcaggtgggtctggggacaggacttcactctcactatcagcagcctagacgcctagaacgtattttcgactactttattactgtcagtcaggacgtagcctaacgtcggtccctcgtccgtacgtttccgggcgggtaacgggaccggtaggggtaggacggtagtaccggaacggaaccggtaacgttgggtcgggtaccgtcggacccgtaccctacgttccgttcgttccgttcttacccg

SEQ ID NO: 248334 - DNA, 805 bp, Homo sapiens
  misc_feature: GYAE6OF01C9JNC.47.64.F09.1.454.CMB.1.raw
  modified_base (143)..(143): a, c, t, g, unknown or other
  misc_feature (143)..(143): n is a, c, g, or t
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (294)..(294): a, c, t, g, unknown or other
  misc_feature (294)..(294): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctcccagataccatcgganaagttgtgttgacacagtctccagccaccctgtctttgtctccgaaggggaaancgcccaccctctcctgcacgggccagtcagaatattcactcctattagcctaggtaccaanacgaacctggtcacggcctccaggctcctcatctangatgcactaccaacgcgggaccacgtcggacacctacccgaagaccgtaggttacagggttcggactagggttacgggtcgtagggggacctaggtacctttcgaccgtcctactaaccgagtactacggacctaacggtacccgtaacgggtaccgtaccgttaacggtaacggtttaaccgtttttacgggttaaccttttttaaatcccgtttacggttaaccgtacggtaccgtaacggttcccggtttaaggtaaccggtttccggttaccgggtcccctttacccggggttacccgtttaaacccggttccccggggttttccgggggaaccggggttaaccgggggtaccggttaaacgggggttcgggtaaacggtaacccggttaaaccggtaaaacccgggttaccggttaggggttaccggtccgttaaccgggtacccctaacccgttaaccgttcgttttacccggttaccctttaccgtacccgttttaccccccgg

SEQ ID NO: 248335 - DNA, 751 bp, Homo sapiens
  misc_feature: GYAE6OF01DGFD6.47.64.F09.1.454.CMB.1.raw
  modified_base (716)..(716): a, c, t, g, unknown or other
  misc_feature (716)..(716): n is a, c, g, or t
  modified_base (726)..(726): a, c, t, g, unknown or other
  misc_feature (726)..(726): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctccagataccatcggagtaagttgtgttgacacagtctccacgcctacctgttctttcgtcctaccggaaggggaaacgcgaccctacccttccgtcctgccggagggtaccagtacgaagtaacttacttacctaccttaccttacttacgtccgttacggtaacctaacgtaaacggtaaaccgtcggttaccgacggtccctacccgacggttaccttccgtactactctagtgtactcgactaactaccgaaccgtaccggacctacggtcgaccaccgtacccgaagtaccggtaggttacgacggtagggcggtaggtcgggtacggtacgggaaccgtacggttaccttacctcttaccctaccgacctagtaccacgtaccgtaccgaccgtaaggacccgttacggttaacgtaacgtttacgtttaacggtacttttacgtacgtcgacgtaagcgtacgtcgttacgttcgtcgtccggtcccttaccggtaccgtcgttaaccgggtccggacgggtaccgaacggggttaggtacgacggtaacctaacggtaaaggtcgtggttacgcctacgtacnctttaccggntttacctcgtttctacccgttcccg

SEQ ID NO: 248336 - DNA, 547 bp, Homo sapiens
  misc_feature: GYAE6OF01AI4V8.47.64.F09.1.454.CMB.1.raw
  modified_base (245)..(245): a, c, t, g, unknown or other
  misc_feature (245)..(245): n is a, c, g, or t
  modified_base (308)..(308): a, c, t, g, unknown or other
  misc_feature (308)..(308): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagacccctgtcccctcacttgctattgtctctggtgctccatcacctagttttaatnttgggtgggctggatccgccagcccccagggaaggggctggaatggattgggagtatatttanaatggggactactctttacaacccatcccctcaagagtcgagtttccatactccgcagacacgtccgagaactcacttctccctgaaactgagctctgtcgacccgccgcacgacacggcttgtttacttactgttcganacntcgaccgacgagagcattagcggctaggttacgtttgattaggtttcgggacaagggcaacgggtccacgtcctcgacncncccgtccgaacccgg

SEQ ID NO: 248337 - DNA, 703 bp, Homo sapiens
  misc_feature: GYAE6OF01EUN4E.47.64.F09.1.454.CMB.1.raw
  modified_base (302)..(302): a, c, t, g, unknown or other
  misc_feature (302)..(302): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagattccaccgggagacattgttttgacacagtctccagccaccctgttctttgtctccgaggggaagacgcccaccctctcctgcgacgggccagtcagagtgttggcagctacttagcctggtaccaacagaaacctggaccaggcctcccgaggtcctcctcatctangtatgcactccaacgcggccctacgtcggctactacccacggcctaggttcaggtcggacgtaggtcgtaggtcgtacgggactaggtaccttcgacgttcctaccaacctataccgacgtacaacggtaccgtaagacggtaccttaaggtaaacggtttattttaccggtaaccgtttaactttttagttaaccgttcggttaaccgaggtaccggtaaggttacccgtacggaccgttaaccggtccggttacccctacgttccggtttaaccgggttcggggaccggggttaacgggtaccgggtagggggtacaaaggtacccgtacggtaaacggacggttaacggtgggtccgtacgtacggtacctaccgtattccggttacgttccctaccg

SEQ ID NO: 248338 - DNA, 583 bp, Homo sapiens
  misc_feature: GYAE6OF01B64UZ.47.64.F09.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (254)..(254): a, c, t, g, unknown or other
  misc_feature (254)..(254): n is a, c, g, or t
  modified_base (373)..(373): a, c, t, g, unknown or other
  misc_feature (373)..(373): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaangccaccctntcctgcagggccagtcagaatattcactcctacttagcctggtaaccaanagaaacctggtcaggctcccgaggcctctcatctatgatgacactccaagcgggcccagtcggcactccccagactggttcagtggcaggtggctgggacagtaccttcactcacaccntcagcagcctagacgcctagaacgtacttaggtactttagtactgtccagctaggcgttagagtttccgtcggccccttccgtccttccgttaccgtttcgggacgggacgggtacccgaggggtacgagtaaccgtaacgtaaaaccggcgttaggtcggccgttacgaccctaccgtcgttcgtacgtcctttacgtaccgttccccg

SEQ ID NO: 248339 - DNA, 810 bp, Homo sapiens
  misc_feature: GYAE6OF01AR1RV.47.64.F09.1.454.CMB.1.raw
  modified_base (193)..(193): a, c, t, g, unknown or other
  misc_feature (193)..(193): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtcttgtctcaggggaaancgccaccctctcctgcgagggccagtcagtaatattcaactccgtattagcctaggtaaccaacgagaaacctggtcaggactcccaaggctctcatctatgatcgacactacccaaacgcgggaccaacgtggactactacccgaagtaacgtacggtttcaaggtcggaccgtaagggttcgggggtactacggggggaactaacggtaacccgtttacaaccgttctacccaaccgtacttaccgaaaggcctaacggtacctaaacgggaccgtaccgttacggtaaaacggttaacgtttttacgggtaaacctttttaacgtttaaaccgttcgggttaacccgtaggaaccgtaagggttaccggttacggtttacgggtttacccgttacgggtaccccgttaaccgggtccttacccggtttaaaccggtttcccgggggaacgggttaaccgggggaaccccggttaaggggggtaacccggttaacggtaaactaaacccggtaaaacggaaaccggttgggttaccgggacgttccgaaaccggtaaccccgttagggttaccctttaaccgggttaccctttaacgtacccgggtttaaccccc

SEQ ID NO: 248340 - DNA, 734 bp, Homo sapiens
  misc_feature: GYAE6OF01EX1KV.47.64.F09.1.454.CMB.1.raw
  modified_base (160)..(160): a, c, t, g, unknown or other
  misc_feature (160)..(160): n is a, c, g, or t
  modified_base (197)..(197): a, c, t, g, unknown or other
  misc_feature (197)..(197): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctccagataccatcggagtaagttgtgttgacanagtctccagccaccctgtctttgctaccgaggggaanagccacctctcctgcagggccagtcagtaatattcactcctacttacgcctggtaccaacacggtaaaccgtggtacacggcctacccgtaggcctacctcgattaccgtataggtacacgactactaaccaacggtaccgggaccctacggtaccggtactacctacccgtaacgtaacggtacggttacgtacgggtcgggtacgtacgggtacgggttacgggtacgggtacgtaacggttaccttaccgtaccgttccgtaccgtaaccgtacgtacgacgtacgtacggtaccgtaacggtaccgtaccgtaacggtaacgttacgtttacgtttacttttaacttacgttacgtacgcgtacgtacgtacggtagttacgttacggtccgtcccgtccgtccgttaccgttacggttccgggtacgggtaccgggaccgggtacgggtacggtacgtacgtaaccgtaacggtacggtacggtcggtacgtacgtaccgtaccgtacgtacgttcgttccgttacgtaccg

SEQ ID NO: 248341 - DNA, 781 bp, Homo sapiens
  misc_feature: GYAE6OF01BUPFR.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctccagataccatcggagtaagtttattttgacacagtctccagccacctgtctttgtctccgaggggaaancgccaccctctcctgcgacgggccagtcaagtaattacttcacttccttacttacgccttacggtaaccaacgaacgtaaaccgttggtaccaacgggtccctacccggaggtccttcccgtactacttcttagttgggtcacctactccgaccggacgggccctacgtcggtacctccgagtccgtaggttcagggtcggcgtagggttcgggtcgtacgggaactaggtacggtttccaccgtttccgtaccaacctactcgacggacctaccgtccgttagaccgttacggttacgttaaggttaacgttttacgtttttacggaaaccttttaaacgtttttaacgtttacgttacggttaacgtacggttaacttaacggtttaacttaaacgttacccgttacgggtcccctttacggtccggtttaacccgggaaccggtaacggggtaacctacgggtaaccggtagggtaacgttaaacggttaacggtaacgttggaccggtacgtacggtacctaccggttcttaccgttacgttccttacgtaccgtttaccctaccgtacgtcgttaccg

SEQ ID NO: 248342 - DNA, 791 bp, Homo sapiens
  misc_feature: GYAE6OF01C8A1C.47.64.F09.1.454.CMB.1.raw
  modified_base (197)..(197): a, c, t, g, unknown or other
  misc_feature (197)..(197): n is a, c, g, or t
  modified_base (680)..(680): a, c, t, g, unknown or other
  misc_feature (680)..(680): n is a, c, g, or t
  modified_base (748)..(748): a, c, t, g, unknown or other
  misc_feature (748)..(748): n is a, c, g, or t
tcagagctcacgtacacgaccggtgctcgatttagcgcgtatacaaggggaggaactgctcagttaggaccctagagggaaccagtggaagccccagcctcgagcttctcttcctacctgctactctggctcccagactaccatcggagaagttgtgttgacacgagtctcagccacctgtcttgctccaagggaangcccacccgtctcgtcgacgacggctacgtacgaagtactactactaccttacctacgtaccgacgttaccgaacaacgtaaccgtacgttggaccgaccgtcccgtaccgtccgtccgttacctactacgtacgtagacgtacgacgtaaccgtacccgtaaaccgacggggtaccgtaccgtacggtaccggtacctaaccgtaacccgtaacggttaaccgtaccggtaacgtcgggtcggaacggtgggtacggttccggtaacgggactaaccgtacgtacctacgttacccacaaccgtagaccgacggaccgtacgtaccgtaagaccggttaccgttaaggtaaaccttttcgggtttaacttaacgttttaagccgttacgaccgaacggttagtcggtttccgtaagtttccccgttcgggaccccttccgttaccgtaaccgttaggttccggggcggggacttaacggggngtaaggtaacccgtaataccgggaaataaacccgggttgttcgggacctcgtaccccgtaaccccgtnttaccccgttcgtttgtaacccttcccgtacccgttacccccg

SEQ ID NO: 248343 - DNA, 498 bp, Homo sapiens
  misc_feature: GYAE6OF01DFHGT.47.64.F09.1.454.CMB.1.raw
  modified_base (197)..(197): a, c, t, g, unknown or other
  misc_feature (197)..(197): n is a, c, g, or t
  modified_base (252)..(252): a, c, t, g, unknown or other
  misc_feature (252)..(252): n is a, c, g, or t
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (461)..(461): a, c, t, g, unknown or other
  misc_feature (461)..(461): n is a, c, g, or t
  modified_base (480)..(480): a, c, t, g, unknown or other
  misc_feature (480)..(480): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatatcactctactagcctggtaccaanagaaacctggtcaggctccagctcctcatctatgatgcatccaacgaggccactggcatcccagccagtcagtgcagtgagtcgnggacagctcacgtctcacatcagcagcctagacncctagaacgtatttgactactttattactgtcagcagcgtancaactcggcctgtactcgtttacggcggtagggacctagggtgagtancgaagactaagtcgacgtncgcacatctagtcttacg

SEQ ID NO: 248344 - DNA, 889 bp, Homo sapiens
  misc_feature: GYAE6OF01EIN6N.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccacccttgtctttgtctcaggggaaanacgccaccctctcctgcgacggccagtcagagtattagcagcaacgttcgccgttagtaccagcaaggaaccgtgggctacggccctcccgaggcctccctactactctaggttcggtcgacctactcccgaccgacggggtccctaccggtttccggtttaccccaggtaccccgtagggtttaccgaagggtcgggacctaagggttcggccggtttacggtacgggggaactacgggttacgtttacccgaacccgttctacccgaaaccctacgtaaccctaaacgtaccggtacccgttacggaccgtttaacggtacctttaagggtaaaacttttacggttttttacggaaaccgtttttaacggtttttaacgtttaccgtttagggtttaacccctaaggttaccgtttaagttaaccgttaccgttaaaaccgttaaccgggttccggggtacccccgttcccgttaacccggttacccccggtttaacccgggggaaccccgtaaacgggggtacccgaaccgggttaaccgggtaacggggtaaaacgttaaacccggtttaaaaaccgggtaccggtttacgggcgggttacccgttaaccggaacccccgttaaacctaccgggtttaccgtttaacccggtttccttttaccccgttaacccgttttacccccccgg

SEQ ID NO: 248345 - DNA, 644 bp, Homo sapiens
  misc_feature: GYAE6OF01BSJEQ.47.64.F09.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (399)..(399): a, c, t, g, unknown or other
  misc_feature (399)..(399): n is a, c, g, or t
tcagagctcacgtacacgaccggtgctcgatttagcgcgtatacaagggggaggaactgctcagttaggacccagagggaaccatggaagccccagctcagcttctcttcctcctgctactcgtggctcccagataccagtcggagaagttgtgttgacactagtctccagccaccctgtctttgcctccgaagggggaacngcccaccctctcctgcaggccagtcagaatattcactcctacttagcctggtaccaanagtaacctggtccagggcctcccaggtcctcctcagtcctatgatcgacgactccaagcgggaccagtcggacactcccgagtactaggttcagtggactaggtgggctagggactacgtcttcacgttctcgaacctntacgagtccgaagtccgtaagacgaccgtagaacgttacgttacgtactttattacgtcgttacgacgtacgtagtccgtagtcgttaccgtcggtaccctccggcttaccgtacggtttccgggaccgggtacgggtacggaggggttacggaggtaaccgtaaccggaaacggtacgtacgggtacggtcgttacgacccgtacgtaccggttctacggtttaccttcgtaaccgtttccccg

SEQ ID NO: 248346 - DNA, 786 bp, Homo sapiens
  misc_feature: GYAE6OF01AD69O.47.64.F09.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaagngccaccctctcctgcagggccagtcagaatnttcactcctacttagcctggtaccaacagaaaccctggtcaggcctcccgaggcctcctcattctatgatcgctactacccaacgacgggcccacgtcggacctacgtccccaggtaaccgtagggtttaccgagggttcgggaccggtagggttcggggttaccgtacgggggaacctaacggtaccctttacctacttccctaccaaccctaagttccaacggtcccaacgtacccgtaacggtaccggtaccccgttaaggtaaaccggtttaaccggtttttacggttaaccttttaacgtttaccgtcggttaccaggtccgtacggtccggtttacggttacggtttccgttccgggtccccgttcccggtccgtttaccggttacccggttttccgggggaccggggttaaccggggtacccgggtaagggggttaccgggtacgttaaccggtaaccggtaaaaccggttaccgggttacgggttacgggtccttacgggaccctaacggttaccttccgttacggtttccttaccgtctttccccgg

SEQ ID NO: 248347 - DNA, 690 bp, Homo sapiens
  misc_feature: GYAE6OF01C6K9H.47.64.F09.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (294)..(294): a, c, t, g, unknown or other
  misc_feature (294)..(294): n is a, c, g, or t
  modified_base (436)..(436): a, c, t, g, unknown or other
  misc_feature (436)..(436): n is a, c, g, or t
  modified_base (643)..(643): a, c, t, g, unknown or other
  misc_feature (643)..(643): n is a, c, g, or t
  modified_base (672)..(672): a, c, t, g, unknown or other
  misc_feature (672)..(672): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggcctcccagataccatcggagtaagttgtgttgacacagtctcagcccacctgtcttgctccgagggaaangcccaccctctccngcaggcctagtcagtaattactacactcctatagcctggaaccaagacgtaaacctggtacaacgcctacccaggtcctcctanactcgtagtgatcggactactacccgaaacgtacggcccagtcgaccacgtaccaacgtacgtacggttcgaaggtcggtacgtacgggttcgggttacgaaggggtacctacggtaacgtttaccaacgttcctaacccanaacgtacgaacgtcaacgcccttaaggacctaccgttaggtaaacgtttacggtttacgttaaagttttacttacgttacgtagtacggccgtaggtacgttaggaagtttcccgtacgggtacccttccggtaccttacgtaccggtttaccggggacggtacgggtaccgtaggggtagtacgaaagttaaccgaaacgttacgnggtacggtcacgtccaacgtcttaccgtntcccttatccgttacccg

SEQ ID NO: 248348 - DNA, 712 bp, Homo sapiens
  misc_feature: GYAE6OF01B079H.47.64.F09.1.454.CMB.1.raw
  modified_base (143)..(143): a, c, t, g, unknown or other
  misc_feature (143)..(143): n is a, c, g, or t
  modified_base (193)..(193): a, c, t, g, unknown or other
  misc_feature (193)..(193): n is a, c, g, or t
  modified_base (250)..(250): a, c, t, g, unknown or other
  misc_feature (250)..(250): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctcccagataccatcgganaagttgtgttgacacagtctccagccacctgtctttgctccaggggaaangccaccctctctgcagggccagtcagaatattccactcctacttagcctggaccaanagtaaacctggtcaggcctacccgaggcctcctcattctatggaacttcgcactacccgtaaacgacggggcccaacgttcgggcctaactcccccgaaggactacggttccaggtcggctagggttggttccgtaggggacctaaggtaccttcctaactccgttaccacctacgtcgaaggccaacgtcctaacggacgtccccgttaaggtaaacggttccgttttaacgggtaactttttaacttaaccggttgttaccgtacggtaccgtaacgggtccgttagggttaacgtttcccgtaccggggttccccgttcccggttcgttaccggttaccggtttccggggaccgggtaacgggtaccgtaggggggttacgaagtaccgtaaacgtaaaccggtaacgtggtaacgggctcggacctacgtagttcctagttcccttcgcgtttccccg

SEQ ID NO: 248349 - DNA, 874 bp, Homo sapiens
  misc_feature: GYAE6OF01AO2KX.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctctgctactctgctcccgagataccagtcggaagtaagtttgtgttcgaacactagtctccacgcccaccttgttcctttcgtccgtaccggaagggggaaacacgtcccctacccttctccgtgccggacgggcctagtacgaagtaacttacttacctaccgttcctaacgttacgccgtaggaaccaaacgtacgtaaaccgtggtaccgacggtcctacccgaggtccctcctacgtaacttcgtaagttcgtactacgactaaccggttaccaaaccgggtaccggtacccgtacggtaccggtaccctaccgttacccggaacgttaaccggttacgggttacctaagggggtaccgttacgggttaaacgggttcggggttaccggtaacgggaaccgtttaacgaccccgttttaacggtccctttaccggttaaccccaacgtttacccgtaaccggtaccggttaaccgaaccggttaccccggtaaggaacccggtttaccgaagggttttaaaccgtttacggtttttaacggttacctttttaacgttacggttaccgtaacgaaccggtcgttaacggtccgtttaggttacccgtccggtaaccccggtccgtaccgttcgttaccggtacggttaccgggacgttaccgggtacgggcgggttaaccgagtaaccgtaaccgggacgtttacgcggagtcccgtacgacctcggttctaccttcgtttacacccggtcgttaacccc

SEQ ID NO: 248350 - DNA, 750 bp, Homo sapiens
  misc_feature: GYAE6OF01A60O8.47.64.F09.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccatcgggagaagttgtgttgacacagtcctccagcccacccttgtctttgtctccgaggggaaancgcccaccctctccngcgacgggccagtcaagtaatattccaccttcctacttacgcccgttaggtaacccaaacaacggtaaacccttgggtaccacgggtcctaccccgaggtcccttcctacacttctagtgactgacctaactacccgaacgacgggtacccacgttcggacctacgtaccccgaaggtacccgtaggggttaccagggtcggcgtaacgggttcggggtcgtagggggaacctaacggtaccctttccggaaccttcccgttaccgaccctaactccgaacggtccctacggtaccgtaacggaccgtaccgtaacgggtaacgtttacgtttaacggttaacttttacgtaaccgttcggtactacgacgtacggtacggtcgtacgttccgtcggtcccgttccgtacgtccgttacggttccggggacggtaaccgggtacgaggggtacgaagtaccgtaaaccgaaacgtaccggtggtaggtcctacgtccgtaacgtcttacgttactcgttccgtcccgttcccg

SEQ ID NO: 248351 - DNA, 860 bp, Homo sapiens
  misc_feature: GYAE6OF01D6DM2.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaaaccccagcgcagcttctcttcctcctgctactctggctcccagatatcgccggagaaatttgtgttgacacagtctccagcccacctgtctttgctcgaggggaaancgcccaccctctcctgcgacgggccagtcagtagtggttggcagcttacttacgccttacggtaaccaacgaacgaaaccgtcggaccgacggtccctacccgaggtcccttaccactacgttacctagtcgtaactcggacctaacgtacccgaacggaccgggaccctacggtcggacctaccgtacccgacggtaccgtaaggttccgaggttcggacgttaggtacggtacgtcggtacggacgtaaccggtacctttacctaccttccctaaccgtaaccgtacgttaccgaaccggctaaccggtaacccgttagggaaccttacccggttaaggttaacgttttacgttttaccccgtaagttttaaacccgttttttcgtaacgtttaccggtaccgttaacggaccgttacgggtaaccgtaccggtaaccgttacccgtaccggttcccgttacccgtttaccgggtttaaccggggtttccccggggggaacgggtacccggggtaacggggtacggggttacggtaaaacccggtcggttaaaaccccggacgggttaaccggtaaccggtttggggtaccccggtaccgaacccgggtacccgtttaaccctaggtttttcccccgggtactttccccgtttaaccccggg

SEQ ID NO: 248352 - DNA, 545 bp, Homo sapiens
  misc_feature: GYAE6OF01BIK8C.47.64.F09.1.454.CMB.1.raw
  modified_base (194)..(194): a, c, t, g, unknown or other
  misc_feature (194)..(194): n is a, c, g, or t
  modified_base (299)..(299): a, c, t, g, unknown or other
  misc_feature (299)..(299): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccaggggaaangccaccctctcctgcagggccagtcagatattcactcctacttagcctggtaccaacagaaacctggtcaggctcccaggctcctcatctatgatgcatccaacngggccactggcatcccagacaggttcagtcggcagtgggtctggggacaggacttcactctcaccatcagcagcctagacgctagaagtatttgctagtttattactgtacagtacaacgtaatactgcctccgctccgtacgtttccggcgggtacgggaccgagggtcggacgtagtacggaaaacgtacgtgtaggacgtcgacctaccgacttcgtacgttccttctacgttccttaccccg

SEQ ID NO: 248353 - DNA, 712 bp, Homo sapiens
  misc_feature: GYAE6OF01C5SD0.47.64.F09.1.454.CMB.1.raw
  modified_base (197)..(197): a, c, t, g, unknown or other
  misc_feature (197)..(197): n is a, c, g, or t
  modified_base (543)..(543): a, c, t, g, unknown or other
  misc_feature (543)..(543): n is a, c, g, or t
  modified_base (676)..(676): a, c, t, g, unknown or other
  misc_feature (676)..(676): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctcagccacctgttctttgtctccgaaggggaanacgcccaccctctcctgcgacgggccagtcaagtaattattccacttacctacttacgaccgtaggtaaccaaacgacggaaaccgttgggtacaacggtccctacccgtaggccctttaccgtctaattccgtaagttcggaacttcggacctaaccgtaacccgaacgggtaccgggaccctaacggtcgggaacctaccgtccccgaaaggaccgtacgggttacagggtcggacgtagggttcggggtcctaggggactacggtacttccacgtcctaccacgacgtacgacgacgacgtaccgtagcgtacctggtaaacgttcgtttaggttaacttttntaccgttgtacgcgtacgtgtccgttgtaccgttacgtccggtaccttcgtcggttaccgttacgggtccgggacgggtacgggtccggtaggggtcgaacgtaccgtaagtaaccggtcttagggcgttacncgtactactgttactacgtttctccgtaccttcccg

SEQ ID NO: 248354 - DNA, 843 bp, Homo sapiens
  misc_feature: GYAE6OF01A47Q1.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctccagataccatcggagaagttgtgttgacacagtctccagcccacctgtctttgctcgaggggaaancgccacctctcctgcgacgggccagtcaagtaattacttccaacttccgttaacttacggccttagggtaaccccaaacgtaacggtaaaaccgtggggaacctaacggggtaccctaccccgaacgggtcctttcccgtctaactttcgttaacggttcgggtagaccctaccgtaccccgaaccggacggggcccctaacggtttcgggtaaccttccccggaacgggttcccgtaacgggtttcaacgggtttcgggaaccgttaggggttccggggtaactacgggggaactaggttaaccggttactaccgtaccttaccgaacctagtaccgacgaccgacgtacccttggacctaggttaccgttaggtaacgtttacggttttagaaccgttttaaggttttaccgttaccgtgttaccgtaagtacgtaatttaaccgtaacttaacgttaccggcggttcccgttaccgaccggtttaccgttaccggggacgtaaaccggtacggtaaccgtacggtacgggaaacttaaaaccgttaaacggtaccgggtaggtaccgggtacccttagggaacccctacgtttaccgtacctttacgggtaccctttacggtacccgtttacccgttaccccggg

SEQ ID NO: 248355 - DNA, 679 bp, Homo sapiens
  misc_feature: GYAE6OF01A2PIY.47.64.F09.1.454.CMB.1.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggagaaatagtgatgacgcagtctccagccacctgtctgtctctccgaggggaancgccacatctccgtggtacgggccgtcagtagtattacgctatctaacgttagcctaggtaccagcaacggagaccgtgggcacggcctcccgaggtcctccanacgttcctaagtcgagtccggaccgtacccaaccggtaccgggccctaacgttccgggtttccccacggtccgtaagggttccaggtcgggctacgggtcgccggttcgtggggaactaggtccgtttccaccgttctacccaacctacgtacccaaacgtcggtaccctacggtacctacggttcgtaagggtaacgtttagttttacgacgtttaacgttttacgttacgtgtaccagtactagtactactaacgttacgccggtaccctaccttaccgtacccgttccggaaccgaagggtccctaacggacgtaggaacgttaacgttaaacggcgttgggaccgtcacgtaccactaccgttctcgttacgtacc

SEQ ID NO: 248356 - DNA, 796 bp, Homo sapiens
  misc_feature: GYAE6OF01BCXCS.47.64.F09.1.454.CMB.1.raw
tcagagctcacgtacacgaccggtgctcgatttagcgcgtatacaagggggctttctgagagtcatggatctcatgtgcaagaaaatgaagcacctgtggttcttcctcctgctggtggcggctccagatgggtcctgtcccagctgcaactgcaggtagtcgggcccaggactggtgaagtccttcggacgtaccctgtcccctctacttgctattcgtctcgtggtcgtctcctatctaaccgttaagtttttaattagttgggtgggtcgttggacttccgccgacgccccggagggtaacgggcgtaggtaagtggtagttgggtagttattagttttaataaggtagggtactacgtttacctttaaccgaaccctaactcccctacgtaaacgtacggttaccgtaacgtttaccgaacgttaacgtcccgtaccgtaacgtaaccgtaaccggtaccggaacgtaaactccctttaaccttacccttacccgtaacgtaaaccgtaggtacgttacgttacgttcggtaccggtaacccggtacccggtaacgtacgaaccgaccgggttccgttagttttaacgttacgttacgtttacgaacgtacgtaagtccggaacccggtaccggacgtacgacgttaattaccgtacggacgttaacgggtttacggtttagttaacggttagggtttaccgggaacggtaaacggggtaacggtaacgggttacccgtaccgttacccggtacccggaccgtaccggtaccccgttcccgaaaaccccggg

SEQ ID NO: 248357 - DNA, 1025 bp, Homo sapiens
  misc_feature: GYAE6OF01AN7P9.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagtttgtgttgacacagtctccagccaccctgtctttgtctccaggggaaancgccaccctctcctgcgacgggccagtcagtaattattccacttccctacttacgccttacggtaaccaaacgtacgtaaaccgtgggtccaacgggtcctacccccagggtcccttccctacacttcctaagttggacttcgacctaacgtacccaaacggtaccggggaccctaccgttcggggacctaaccgtacccccgaaaggtaaccgttacggggttttaccgaacggggttacgggtacccggggttaagggtttccgggggggtttaccgggttaggggggaaaccccttaacgggtttaacccgttttacctaaaccccgtttcccttaaccccggaaacccccttaatttaccccgaaaaccgggttccccgtaaaccggttaccccggttaaacgggtacccggttaaccccgggtttaagggtaaaccgggtttaaccggtttttaacgggtttaaaccgttttttaacgtttttaaacccggttcggtttaacccgtaaacggttacccgggaacggtttccgggtttacggtttaacggtttccccgggttacccgggttaccccccggttacccggttaccccggtttacccggttaccccgggggtttttacccggggaacccggggggttaaacggggtaccccgggttaacggggggtaaggggttaaaccggtaaaccccggtttaaacgggtaaaacccggggtaacctttcgggggttaccggaaccccggtttcgggaccccttaaccggttacccgtttaccggttacgtttacccgtttcccgttaacccggttaccccccg

SEQ ID NO: 248358 - DNA, 583 bp, Homo sapiens
  misc_feature: GYAE6OF01BO2VH.47.64.F09.1.454.CMB.1.raw
  modified_base (198)..(198): a, c, t, g, unknown or other
  misc_feature (198)..(198): n is a, c, g, or t
  modified_base (444)..(444): a, c, t, g, unknown or other
  misc_feature (444)..(444): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangcccaccctctcctgcagggccagtcagaatattcactctacttagcctggtaccaacagaacctggtacaggcctcccgagcctcctcatctatgatgcatcccaagacgggccacgtggaccactcccaagactaggttcaggtggctaggtgggtctaggggacagtaccttcaactcaccactataccacgcacgtcctaggacgcctaggaacgttacgtttaggtaacttttagttaccngttacagcgtagtgtagtgttcgtcgccttccgctaccgtcgttcgggacgggtacgggtacaggggtcgagtacgtaaccgaaacgacgtttggacggtctcggactaccgtagtcttcgttcttcctacgttccccg

SEQ ID NO: 248359 - DNA, 586 bp, Homo sapiens
  misc_feature: GYAE6OF01EYXU3.47.64.F09.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (569)..(569): a, c, t, g, unknown or other
  misc_feature (569)..(569): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaanacgccaccctctcctgcagggccagtcagaattattcactcctacttagcctaggtaccaacacgaacctggcaggctccagctcctnatctatgatgcactacccaaacggcgggaccacgtggaccactcccagcctaggtcaggtgacagtgagtcgtagggacagtacttcgactcgaccactatacagctacgacctagacgtacctaggtaagttatttcggactttactttatctgtcaggtcagtcgagtaccaaggttccgccttgtaccgttacggtttccggacggggacggaccggtaggggtagacggtaagtccggaacggtacgtacgtggtaccggacttaccgaccgtacttanccgtttcgtcctttacg

SEQ ID NO: 248360 - DNA, 832 bp, Homo sapiens
  misc_feature: GYAE6OF01EGLNM.47.64.F09.1.454.CMB.1.raw
  modified_base (124)..(124): a, c, t, g, unknown or other
  misc_feature (124)..(124): n is a, c, g, or t
  modified_base (206)..(206): a, c, t, g, unknown or other
  misc_feature (206)..(206): n is a, c, g, or t
tcagagctcacgtacacgaccggtgctcgatttagcgcgtatacaaggggggaggaactgctcagttaggacccagagggaaccatggaagccccagctcagcttctcttcctcctgctactcnggctcccagataccatcggagaagtttgtgttgacacagtctccagccctaccctgttctttggtcctccgaagggggaaancgccctaccctctcctgcgacgggccagtacagtaatattccaccttcctattacgcctggtaaccaacaggaaaccttggtacacggcctcccgaggtcctcctcattctaagtgacttcgactaacgttacccaacggacgggccccaacgttcggacctaacgtaccccgaaggtaaccgtacgggtttaccgaacgggttcggtaccggtaaggtttccgggggtactacgggggtaacttaccggtacccttacgtaccttaccgtacccacctattcccgaaagcccgacgtaccgtaagggacctaccggttaggtaaacgttaccggttttaggttaaccctttttagttttaacccgtacggttacgtaacggtaccggtaacggttacgtaacgggtttagtttcccggtccgggttaccccgttcccggtaccgtttacccgggttaccggggttttaccgggaaccgggggggtaccgggtaaaccgggttacgggggaggtaacccgggtaaaccgtaactaaaaccggggtacgttggggtaacccgtaccggtacgtaaccacccggttcgtttacgtaccggttttccttaccgtccccgttacccccgg

SEQ ID NO: 248361 - DNA, 746 bp, Homo sapiens
  misc_feature: GYAE6OF01CQFQ8.47.64.F09.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccatcggagaagttgtgttgacacagtctccacgccaccttgtctttgtcctccgaaggggaaacncgcccaccctctcctgcgacgggccagtcaagtaactnttaccaccttacctacttacgcctaggtacccaacgaacgaaacccgtggtacgacggcctcccgacggtctcctcatctatgatgcactaccaacggcggaccctacgtacggaccaaccgtcccgacggtaccccgtaggtttccgaaacgggtcggtaccgtaaggttcggaacgggttcgtaacgggggtaccaacggttaacccgttccaaccgtttcccaccgtaaccctacgtaccgaaggccaaccggtaccgtaagtaaccgtccgttaagtaacccgtttatttaccgacctttaacgttttacttacgttcgtaaccacgtacgaacggttaccgtacgtaccgtaaccgtcgttacccttaccgtacccggttaacggttcccgggggaccggacggggtaaccgtaaggggggacgtacgtacggtacgaaccggtaacggaacggtgttaacggccgtacgtccaccgttatcccgttagttccgttacccg

SEQ ID NO: 248362 - DNA, 877 bp, Homo sapiens
  misc_feature: GYAE6OF01DZ4ZG.47.64.F09.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagatacccatcggagaagttgtgttgacgcagtctccagccacctgtctgtctctccgaggggaaancgccaccatctccgtgacgggccggtcagagtatagctactctaactgccgtggtaccngcagacgaccgtgggcacggcctccgacggcctccgtcactctagtcgtatcggccgtacccgacccggagggaccctacgtttccggttttccccgacggtacccgtaaggttccgacggtgggcctaggtcggtccgggtcggtacgggaccgtaggtacgttccgaccttcccgtaccgaacctaacttaacccgaaaacccgtcggtaccccgttacggaacccgttaacgggttaccgttaaagggttaaaacggttttacgttttttaacgggaaccggtttttaacggtttttttaacccgtttaaccggtttccggtaaccgttaaacgggttaccgtttaaacgggttttaacttacccgttaaaacggtttaacccggtacccggggttaccccggttcccttttaacccgggtaaccccggttttcccggggaaaccccgggttaaacggggaaccccgttaaaccgggttaaaccgggttacggggtaaaaccgttaaaacccggtttaaaacgggtaccggttttacgggaccggggtttaccgacccgtaaccgttaccgttacccgtttaccgtttacggtttccccttttaacgttaccccccgg

SEQ ID NO: 248363 - DNA, 724 bp, Homo sapiens
  misc_feature: GYAE6OF01AZ31Q.47.64.F09.1.454.CMB.1.raw
  modified_base (335)..(335): a, c, t, g, unknown or other
  misc_feature (335)..(335): n is a, c, g, or t
  modified_base (684)..(684): a, c, t, g, unknown or other
  misc_feature (684)..(684): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagactaccagtcggagtagttgtgttgacactagtctccagccaccttgtctttgtcctccgaaggggaaatcgcctaccctctccgtgaccgagggccagtaccaagaacttagttccacttaccgtacgttacgccgtaggtaacccaaacgtaacggtaaccttcgggtccgaacggtcctcccgaaggtcccttaccttanacttacttaacgtcgtaacgttccgtacctaacgttacccgaaacgtccgggccctacggttccggaccacgttcccgaaggtaccgtaaggttcctaaggtcggacggtacggttcgggtaccgtacggactacgtacttccgaccgttcctacacgtactacgacgtacgtacgcgtaacgacgtacctaggtaacgttacgtttacgtaactttacgtacgttcgtacgtacgacgtacggtcgttacgttacgttaccgtcggccgttccgtagtccgttacggttccggacgggtaacgggtacgacgggtacgacgtaacgtaccgaacgtaccgtgggtacncggtactacacgttcgttcttagttcgtacttccgtaccg

SEQ ID NO: 248364 - DNA, 863 bp, Homo sapiens
  misc_feature: GYAE6OF01DVSUA.47.64.F09.1.454.CMB.1.raw
  modified_base (501)..(501): a, c, t, g, unknown or other
  misc_feature (501)..(501): n is a, c, g, or t
tcagagctcacgtacacgaccggtgctcgatttagcgcgtatacaagggggaggaactgctcagttaggacccagagggaaccatggaacgccccagctcagcttctcttcctctgctactctggctcccagataccatcggagtaaggttgtgttagacacagtcctccacgccctacccgttgttctttgtcctaccggaaggggaaacgccgccctacccctcctccgtgccgacgggcctacgtcagtaatcttccacttaccttacgttcgccgtacggtaacccaacgtaacggaaaccggtcgggaccacggtccccgtacccgacggtcccttccctataacgtccgtttaaggtcgggttacgaccctacctacccccgaaccgggtaccgggaccctacgttccgtaccgtacccgacggtccgtaagggttcgacgggtcgggccgtagggttcgggtccggtacgggacgtaacggtccgtttaacccncgtaacccgtaccctaactaacgaaccctaaacggtccgtacccgtgtaacccttagggtaccgttaaaggtttaccgtttagttttaccggtaaacctttttaacggttttaccgttgtacggttaacgtaacgttccgttaaattaaccgttaaccaaaccgggttccggtttcccgggtacccggttcccttaaccccggttacccgggtacccggtaaccggtaaccggacccgttaaacggtgaaacgggtttaaaaccgtaacgttaaacccgggtggttaacgttccgggacgtaaccctacaccgttacttctttcggttaccctaaccctttccgtttacccgccccgttacg

SEQ ID NO: 248365 - DNA, 768 bp, Homo sapiens
  misc_feature: GYAE6OF01B9VDX.47.64.F09.1.454.CMB.1.raw
  modified_base (703)..(703): a, c, t, g, unknown or other
  misc_feature (703)..(703): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagccaccctgtctttgtctaccgagggaaagacgccaccctctcctgcgagggccagtcaagtaatattcaacttcctacttacgaccgtggtaaccaacaacgaaaccgtggtcaacggtacctcccgacggtcctcctcagtctagtgatgactactaccaacgtaccgggccacgtcggactacgtcccgaaggtactagggttaccgaaggttcggacgtagggttcgggtacggttacggggacctaggttaacccttccgtaaccctccctaaccgtaaccgtaccgttccgaagaccgaccgtaaccggttaacggacggtacctaaggttaaacgttacgttttaggttaactttacgttacgtgtacgtacgcgtacggtcggttagtacggttccgtaccggcccgttaccggtacccgtttacgggtaccggtttccggggaaccggggtaacggggttaccggaagggggttaccggaaaggtaaaccgtaacccggtaaacggtccgggttacggtaccggtntaccccggtaacgtaaccggttacttccggtttagttacccccgttattacccgggtttcccccg

SEQ ID NO: 248366 - DNA, 1052 bp, Homo sapiens
  misc_feature: GYAE6OF01CO5J6.47.64.F09.1.454.CMB.1.raw
  modified_base (117)..(117): a, c, t, g, unknown or other
  misc_feature (117)..(117): n is a, c, g, or t
  modified_base (128)..(128): a, c, t, g, unknown or other
  misc_feature (128)..(128): n is a, c, g, or t
  modified_base (1035)..(1036): a, c, t, g, unknown or other
  misc_feature (1035)..(1036): n is a, c, g, or t
  modified_base (1038)..(1038): a, c, t, g, unknown or other
  misc_feature (1038)..(1038): n is a, c, g, or t
  modified_base (1042)..(1044): a, c, t, g, unknown or other
  misc_feature (1042)..(1044): n is a, c, g, or t
  modified_base (1046)..(1046): a, c, t, g, unknown or other
  misc_feature (1046)..(1046): n is a, c, g, or t
  modified_base (1048)..(1048): a, c, t, g, unknown or other
  misc_feature (1048)..(1048): n is a, c, g, or t
tcagagctcacgtacacgaccggtgctcgatttagcgcgtatacaagggggctttctgagagtcatggatctcatgtgcaagaaaatgaagcacctgtggttcttcctcctgctggnggcgctccagntgggtcctgtcccagctgcaactgcgagggagtccgggcccagggactgggtacgaacggtcccgtttacgggacgtaccccttgtccccctacgtaccttgccttaagtttcgtccttccggttagggtcggtcccttacccacttaccctaaccgtttaagtttttaaagtttggttgggggtcgggggtccttggggtaacttccccggcccgaaccggccccccggaaagggggaacggggtctaaggggaagttgggtaggttaggggtagtttaagtttaatttttagtaaacgggttacgggggaacctaccgttttaccgttttaaccaaacccctacttaccccctagtaaaacggtcgttaccgttaacggtttcctaacgttaccgttcccgaccgtaacgaccgtaacgtaccggaagtaacttccctaccttccctaccctaacggtaacgttacggtaaccgtccttacgttaccgggtaccggtaacccccggacccggtacgtaaaaccgggtaccccggtaaccgggtttaccgtttttaccggttttttaaaaccgtttacccggttttacgggttttacccgggaaacggtacccgttaacgggttaccccgggtaaacccccggggtaaaccccgggtaacgggtaaccggtttaaaccccgttttaaacggggtttttaacccgggttaccccgggggggtttaaaacccccgtttttaaaaccgggggggggtttttttttttttaaaaccccccggggttttttaaggggggggtttaaaaaccccggggtttttttttttaaaaccccggggggggggtttttttaaaacccccccggggggggggggggggaaaaaaaacccccccgggggtttttttaggnngnctcnnncncncacg

SEQ ID NO: 248367 - DNA, 726 bp, Homo sapiens
  misc_feature: GYAE6OF01EZ4WI.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagcccaccctctcctgcagggcagtcagaatattcactcctacttgcctggtaccaacacgaaacctggtacaggcctcccgaggcctcctcattctatgattgcactacccgaacgacgggcctaacgtggacctaactccccgaaggacgtaggttaccgagggtggacgtaggttcggggtcgtagggggaactaacggtacctttccaccttccgtaccaccatccgagacacgaccgtaggaccgtcgtagtaacgttactttaggttaacttttacttacgtagttacgacggtacgtacgttcggtagttacggtttccgtccgggtccctttcccggtcgttacccgttacccgggtttcgggaccggggtaccgggtaaccggtacgggggtaaggaaccggttaacgtaacccggtaaaaacgggttcggtttagggtacgggtacggtaccggtaaccgtaacccgttacgttccccgtttaagtttcccgtttacgttccccgttttaccccccgg

SEQ ID NO: 248368 - DNA, 693 bp, Homo sapiens
  misc_feature: GYAE6OF01CKA9A.47.64.F09.1.454.CMB.1.raw
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (548)..(548): a, c, t, g, unknown or other
  misc_feature (548)..(548): n is a, c, g, or t
  modified_base (661)..(661): a, c, t, g, unknown or other
  misc_feature (661)..(661): n is a, c, g, or t
  modified_base (671)..(671): a, c, t, g, unknown or other
  misc_feature (671)..(671): n is a, c, g, or t
tcagagctcacgtacacgaccggtgctcgatttagcgcgtatacaagggggagaactgctcagttaggacccagagggaaccatggaagccccagctcagcttctcttcctcctgctactctggcctcccagataccatcggagtaagttgtgttgacacagtcctccagccctaccctgttctttggtctccggaaggggaaancgcccaccctctccgngcgacggccagtcaagatntcactcctatgcctgtaaccaanacgaactgtcagccnccagctcctnatcatgatgactactaccgaacgacgggacccagtcggacaccgtaccgaacggtacctaggttacgtacggtcgggacgttagggttccggtacggtacggggtaactaacggttacctttaccgaccttaccaccgaacctacgtaccgacgtaacgtaccggtacctacggaacgtaccgttaacggtaaacgtttacgttttacgtaacttttaagtcgttacggtacaggtaccgttacgcgttacgtacgttcnccgggtaacctccgttacgtaccgttacggttccgggacggtacgggtaccgaggggtcgtaagtaccgtaacggtaacggtcgttagggcgtaccggcctaacgacccgttnttaccggttntaccttccgtcctttaccccgg

SEQ ID NO: 248369 - DNA, 654 bp, Homo sapiens
  misc_feature: GYAE6OF01B8POO.47.64.F09.1.454.CMB.1.raw
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
  modified_base (513)..(513): a, c, t, g, unknown or other
  misc_feature (513)..(513): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccaccggagtaagtttattttgacactagtctccagcccaccctgtctgtctcgtccgaaggggaaancgccaccatcctccgtggtacgggccgtcagagtattagcatacgtaacttcgccgtggtaccagcaacgaacgtcggccacggcctacccgacgtcctacctctactctatgntcgactactacccgaacgcggaccctacggtcggaccaccgtaccccgaggtccgtaggtcgaggtcggacgtagtggacgtcggacggactacgtacctactacgtcctacaccgtatacgacgtacgacgtccgtagcgtacgtagtaagttacgtttacgacctttaacgtttacgttaccgtagtacgtancgtacgtacgtacgacgtaccgtcgtacctcgttacggtaccggttcgggacgggtacggacggtgggtagagtaacgtcgaacggtaccgtaggtcgggtacgtcgacgtacctacgtacttccgttcgttccttacccg

SEQ ID NO: 248370 - DNA, 594 bp, Homo sapiens
  misc_feature: GYAE6OF01EB1RX.47.64.F09.1.454.CMB.1.raw
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (471)..(471): a, c, t, g, unknown or other
  misc_feature (471)..(471): n is a, c, g, or t
  modified_base (582)..(582): a, c, t, g, unknown or other
  misc_feature (582)..(582): n is a, c, g, or t
tcagagctcacgtacacgaccggtgctcgatttagcgcgtatacaagggggctttctgagagtcatggatctcatgtgcaaagaaaatgaagcacctgtggttcttcctcctgctggtggcggctccagatgggtcctgtcccagctgcaactgcaggagtccggggcccaggactggtgaacgtccttacggagaccctcgtccctctacttgctattgtctctggtgctcatcactattttaatntggtggntgactccgcacgcccgagggaggctaggagtggagttggattattagtttagacgtgggactacttcttaacaaccactcctacaagtacgtcgtacgttacatatcgactacgacgacgtccgaagtactctacttccaccctagtaacgtgactctactgtaccgcccgacgcgaacgtaccgagttaccgttagttttacttactgtttacganactatccggaccgacggagacgtactagttacgcggtagttacggtttacggttttagaacgtttcggttacgggacgaaggtacgtacggttcacccgttcaccgactcnccgtccaaccgg

SEQ ID NO: 248371 - DNA, 869 bp, Homo sapiens
  misc_feature: GYAE6OF01ERER6.47.64.F09.1.454.CMB.1.raw
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttagacacagtcctccacgccacccttgttctttgcctaccggaaggggaaacncgccctaccctctccgngcgacgggcctagtcagtaacttattccaccttaccttaacgttacgacccgttacggtaaaccccaaacgtaacggtaaacccgttgggtaccctaacggggtccccttaaccccgaagggtccccttaccctcgtaaacgttcttaacgtacggacttccggacctaaaccgttaccccgaaacggaccgggtaccctaacggtcggaaccctaaccgtaccccgaacgggtaccgttacggggttacacgggttcgggtacgtacggggttcggggttaccgtacggggaacctacggttaccttaccgtacgtacctaccaaccgtacgtacgtacgacgtacgacgtacgaccgtactagtaacgtttactttaggtacttttagtaccgtagtacggtagaccgttggtacgttacgttaccggttcgtacccggtcccttaccggtaccgtttaccgggttaccggggttaccggggacgggtaaccggggtaccgggttaagggttaacccggaaacggttaccggttaaacccggtaaacggtttccggttacgggacccgggttagtaccccgtaaccgtaccgtttaagttcccgttaccggttttcgttaaacccccgtcggtttaccccccg

SEQ ID NO: 248372 - DNA, 691 bp, Homo sapiens
  misc_feature: GYAE6OF01DY8KY.47.64.F09.1.454.CMB.1.raw
  modified_base (388)..(388): a, c, t, g, unknown or other
  misc_feature (388)..(388): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
  modified_base (685)..(685): a, c, t, g, unknown or other
  misc_feature (685)..(685): n is a, c, g, or t
tcagagctcacgtacacgaccggtgctcgatttagcgcgtatacaagggggaggaactgctcagttaggacccagagggaaccatggaacgccccagctcagcttctcttcctcctgcttactctggcctccagactaccaccggagtaagtttattttgacacagtctcacgccacctgttctttgtctcgaaggggaagcgccacctctccgtgcgacgggtcacgtacgagtacgttggttacgacgtacgtactttaacgttacgtcgtaggtaaccaaaggtaacgtaaaccgtcgggacccgaacggtccgtacccgacggtccttaccgtacacgttccggtaggactcgacctacgttacccgaaacgggcgggtcccgnggttcggacctaaccgtccgacggtccgtaagggttccgagggtcggcgtagggttcgggtcggaggacgtacgtacttcacgttcnccgactanacgacgacncgtacctagacgtcgtaacgttagttacgtttgtactttagtttactcgtcgtaacaggtaactaaacgttacgtcgtacggcctacgtctacggttacgtcgggacggaccggtacgtacggtgtactaaggaacggtacgacgttcgggtacgctggacctacgtacgtcttcgtcttactcctttccgcncgtacg

SEQ ID NO: 248373 - DNA, 569 bp, Homo sapiens
  misc_feature: GYAE6OF01E4CMJ.47.64.F09.1.454.CMB.1.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangcccaccctctcctgcagggccagtcagatntcactcctacttagcctaggtaccaacagtaaacctggtcacggcctcccaggcctcctcatctatgatgcataccaacgacggccacgtcggcactcccagacgtacggttcgaggtggcgaggtggtcgtcggggacacgtacttcactctcaccatcgacgcacgccgtagacgtcgtagtaacgttacgtttggtaactttacgttacgtgtcagtcgaggtcgtgtagttcgtcgcctccgctcgtcgttcggacggtacggaccgtagggtggacgtacgtacgaaacgtcgtggtacggtcgtcgtaccactcgtcgtattctcgtacttcccg

SEQ ID NO: 248374 - DNA, 955 bp, Homo sapiens
  misc_feature: GYAE6OF01EUMXA.47.64.F09.1.454.CMB.1.raw
  modified_base (148)..(148): a, c, t, g, unknown or other
  misc_feature (148)..(148): n is a, c, g, or t
  modified_base (223)..(223): a, c, t, g, unknown or other
  misc_feature (223)..(223): n is a, c, g, or t
tcagagctcacgtacacgaccggtgctcgatttagcgcgtatacaaggggggaggaactgctcagttaggacccagagggaaccatggaacgccccagctcagcttctcttcctctgctactctggcctccagtactcccaccggganacttatttgttttgacacagttcctaccgacgcctacccgttgttcttttacgtcctaccggaaagggggaaacncgacccctacccttcctccgtcggacggaccggggaccctaaggttcgaggtacgggtttcgggttacggacgtacggtacccttaagttaccggccctaacgggtaacccaaaacggaacggtaaccgcggaccgacggtccccgtacccgtaacgtcccttcctactacttacgttataccgtagtccgactaaccgtaacccgaaacgggccgggtacctaacggtccgaacctaccgtacccgaacccggtcgtaacgggtttcgacgggtacggtacggtacgtggtacggtacgggtaacggtaacctacgggttaacccttccgacccgttaacgttacccgaaaagtttacccgtaacgacccgaacgttaacccggtaaccgtaacgggtaccggtaacttaacggggttaaacgtttttactaacccgggttaacttttaaccggtttttaaacctttacggtttaccgggtactaaacccggggtacgtaaccggtaaccggtttaacgtaaccccgttaaccgggttcctaacccggttttccggttaacccggttaaccggggtttacccgggggtaacggggtaaacccgggttcggggaaaggggttacccgtaaggttaacccgtaacggggtaacggtaaacccgtggggttaaccgggtcgtaaccgacccgttaaccgtacgttaccggtttctttaccgtacgtttaacccg

SEQ ID NO: 248375 - DNA, 792 bp, Homo sapiens
  misc_feature: GYAE6OF01BH5ZS.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggcctcccagataccatcggagtagttgtgttgacactagtcctccacgccctaccctgttctttgtcctccgaaggggaacgacgccctaccctctcctcgcgacgggttttccagtcaagattacttctacctccttacttacgccgtacgtaccaaacaacgtaaccgtggtacgacggtcctcccgaggtcctcctactcttactagtgtatacgactacgtacccaacggacgggtaccctaccggtcgggtaccaccgtaccccaacggtcccgtaagggttccgtagggtccgggtaccggtacggggttaggggttccggtacgggggtaaccgtacgtacccgtttacccgtaccttacccgtacccgaaacctaccgtaccgacggacctacgggtacctacgggacttaccggtaggttaacggttagtttttacgacgttttaacggttttaacttaccggttagtacgaacgttaaaccgtaaacgtttaactccggtacgtcccccgttagtaccttccggttaccggtttcggggaccggggttacgggaccggtaggggtacgtaccgtaggttaaccgaaacgttcgtagggtccgtacgtcggtaccctacgcgttaccgttcgttacccttactcccgttcccgtacccg

SEQ ID NO: 248376 - DNA, 806 bp, Homo sapiens
  misc_feature: GYAE6OF01DSSSJ.47.64.F09.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (718)..(718): a, c, t, g, unknown or other
  misc_feature (718)..(718): n is a, c, g, or t
  modified_base (777)..(777): a, c, t, g, unknown or other
  misc_feature (777)..(777): n is a, c, g, or t
  modified_base (786)..(786): a, c, t, g, unknown or other
  misc_feature (786)..(786): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagactaccatcggagaagttgtgttgacacagtctccagccctacccttgttcctttgtcctaccgaaggggaaancgcccacccttctccngcagggccagtcaagtaatacttcaccttccgtaacttacgcccttaggtaaccaaactaacgaaacccgttggaccgagggtccttacccgaacggtccttccctactacttacttaagttgaacgttcgcctaactaccccgaaaacgaccggggaccctaaccggttggaccctaaccgttcccccgaaaggtaaccgttacggggtttaccaaggttaccgggacgttaacgggtcggggttacggtaccgggggaactaaacggtcccttttaccgaaccctacttaccaaaccgtactaccgacggaccgtaccgtaccgtaggtaccgtccgttaaggtaaacgttaccgggtttttagtaaaccgtttttattacgtttcgaccgtacgacgtaacgttcgggttacgttacgtttccggtccggtccccgtacccgtcccgtttacccgtaaccgggttttccgggaaccgggtacggtacccgggngggttagggaacgtaccggtaaccgaaaagtccggtggtacggacttccggacaccgtntacccgttnttccgttactcgttaccccg

SEQ ID NO: 248377 - DNA, 1125 bp, Homo sapiens
  misc_feature: GYAE6OF01BGK9E.47.64.F09.1.454.CMB.1.raw
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcgaggagtccgggcccaggtactgggtacgaacgtcccgtttcgggaacgtaccccttcggttcccctacgtacgtttcgactagtttcgtccttcgttggggttcggccttcccaattccctaaacccgtttaaaggttttttttaaaactttacggttttcgggggttcggggggtccgttacggggaaccgttccccgggacccctacccgggacccccccgggtaagggggggtaaaccggggggtccgttaggggtaaaagttcgggggttaaggtttacggggggtaaaagttttaacgttttaacggttttttaaaggtaaacgggtttacggggggtaacccttaacccgttttacccgtttttaaaccccgaaaacccccgttaacctttacccccgtaacggtaaacggttaacggttacccggtttaaccggttttaaccccgtaacgtttaaccgtaccccggaacggtaaccggtaaaccccgtaacccgggttaacccggtaaacgtaaaccgtttacccgttaaaccccgttttacccccttaccccggttaaacggttaaaacccggttcgggtaaccgttccccgtttaccggttcgggttaaccccgggaccccggtacccggaaccgtaaaccgggtacccggttaccggggttccgtttttaacggttttaaccgtttccgtttaacggttccgggtaacgtaacctaccgggttaccggaacccggggtaccggtaacggtacggttaccgttaagtttaccgggtaccgggttaacgttaacggggtttttaccggttttggaaacggtttttacgggggtttacgggggaaacccggtaaacgggggttaccgggttaacccggggtttacccgttaaccccggggttcccgtaccccgggtaacccgtaacccgggtaccccccggtccccggtaaaacccccgggg

SEQ ID NO: 248378 - DNA, 860 bp, Homo sapiens
  misc_feature: GYAE6OF01EOY3U.47.64.F09.1.454.CMB.1.raw
tcagagctcacgtacacgaccggtgctcgatttagcgcgtatacaagggggctttctgagagtcatggatctcatggtggcaagaaaatgaagcacctgtggttcttcctcctgctggtgcggcctcccagatgggtcctagtcccagcctgcaactgcaggagtcgggccccaggactggtgaacgtcctttacggacgaccccttggtcccctactacctttgctatttggtcctaccgttgggttcgaccttcccatccgtaaccttagtttttaatagttgggtcgggtctggactccgtccacggcccccgaggggtaacggggtctagggtaagtcggtagttaggggtagttatttagttttaagtaacggtacggggacctacgttaccttttaacctaacccctacttacccctacgtaaacggtacgttaccgtaacgttttacccattaccttcccggactaacgtaccgtacccgtaccgaacgtaactcctaccgtttcccgtacccgttacggtaaaacccttggtaacctccgttacgtacggttacccggaccccggtccggtaccgaaggtacccgtaccgggtacgtttacgttttaacgttacgttcggtttaacgacggtaacgtaacgtccggtaacccggtacccggaacggtaccgtaaccttaacgttaccggtacccggggtaaccttaacgggtttacccggttttacggaacgttttacgggtttacccgggggaaaccggtaaacggggttaacccgaaccggggttacccaaaccccgggtttcctaaccccggacgtaacccgtaccccgttacccgaaaacccccgggg

SEQ ID NO: 248379 - DNA, 734 bp, Homo sapiens
  misc_feature: GYAE6OF01BKJDN.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttcttttcctcctgctactctggctcccagataccaccggagaagttattttgacacagtctccagcccaccctgtctttgtctccgaggggaaanagcccaccctctccgtgcagggtcagtcagtagttgttgacagtcttacgttagtcgtacggtaccaagacgaaacctggccgaggcctcccgaggtcctcctcattcgtgggatcgacctactacccgaacggaccggggcccgcgtccgggcctaccgtaccccgacgcccggttaggtttccgagggttcggaccgtagggtcgggtacggagggaccacgttaccttccgaccttccctaaccacctagtaccgacgacaccggtacctaggaccgtccgtaagttaacgttagttttcggtactttaagtttaagttaccgttacgttacgtaacgtaaccttaaaacgttacgttaccggttccgtcccgttccgtcctttaccgtaccggtttccggggacgggtaaccggggtacccggtagggtaccggtacggtaacgtacggtaaaccggtcgtggtaccggtaccgtcgaccctactacgttccttcggttccttacttacccgttcccgtcccttcgtcgtcg

SEQ ID NO: 248380 - DNA, 660 bp, Homo sapiens
  misc_feature: GYAE6OF01CIEPA.47.64.F09.1.454.CMB.1.raw
  modified_base (144)..(144): a, c, t, g, unknown or other
  misc_feature (144)..(144): n is a, c, g, or t
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcgganaagttgtgttgacacagtctccagcccacccttgtctttgtctccgaagggggaaangccaccctctcctgcagggccagtcagaatattcactcctattagcctgtaccanagaacctggtcaggctccaggctccncatctatgatgcatccaacgacgggccacgtcggctacgtccccagaccgtaggttcaaggttcggacgtaggtcggggtctacggggacaggtacttacacgttctaccgaaccagtcaacgcagacccgttaagacgccttacggaacgttacgttttacggtaacttttaacttacgttacgttacgagtacctaacggtccgttagtaacgtttcgtacgggtcccttaccggccttaccgtaccggtttccggggacgggtaacgggtaccggaggggttacggaacggtacgtaaccgaaaccggtacggttacggtagggtccgtacgtaccgtaccgtacttcgtacgtttctttccgtaccttaccccg

SEQ ID NO: 248381 - DNA, 867 bp, Homo sapiens
  misc_feature: GYAE6OF01C30ZQ.47.64.F09.1.454.CMB.1.raw
  modified_base (207)..(207): a, c, t, g, unknown or other
  misc_feature (207)..(207): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccagtcggagtaagttgtgttgacacagtcctccacgcccacccttgttctttgtcgtaccgaaggggaancgacccacccttctcctggccgacgggccagtcaagtaacttacttcaccttaccttacgttacgccgttacggaaccaacgacgtaaacgtggtaccacggccctacccggacggtcccttacctactacgttaccttatcggtactacggacctaaccgtacccgaaacggtaccggggccctacggtacggacctacctaccccgaaggtaaccgtacggtttaccgagggtcgggacgttacggggtcggggttacggtacggggaaacctaccgggtttacttcccgaaccttacccgccctaaccgtacgttacgacgtaccgtacgtaccgttaacggaccgtacgttaacggttaaacggttaccgttttacggtttaacttttacgttacgtcgttaccgtaacggtcgttacggtcggtttacgtaccggtttccggtcccggttcccgtaccggttacccgtttacccgggttaccggggttttacccgggggaccggggttaaccggggttacgggtaacggggttaaccgggtaacgtaaccggttaaacggaaaccgggtttacggtccggggtacggtaccgtaccggtaacccgtacgttaaccgtttacggttccttttaccggtcccttccggttacccccg

SEQ ID NO: 248382 - DNA, 838 bp, Homo sapiens
  misc_feature: GYAE6OF01B9GDK.47.64.F09.1.454.CMB.1.raw
  modified_base (199)..(199): a, c, t, g, unknown or other
  misc_feature (199)..(199): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgttctttgtctccgaggggaaanacgcccaccctctctgcgaggccagtcagaatattcacttcctacttagccctaggtaacccaacaacgtaaacctggtacacggtcctacccgaggccttcctctactctatgactgactactaccaacgacgggcccacgtggcctactacccgaagaccgtaggttacgaggtcggtacgtagggttcggggtacgtacggggacctaacgggttaccctttaccgaaccttacccttaccgaaaccctacgtaccgaaccggtaccgaacgtacccgtaaggtaaccggtacccgttaaggtaaaccggtttaacggttttaaccgggttaactttttaacgtttaaccgttacggttaccgaacggttacgtaacgggttcggtttaggttacgggtttacccggtccgggttcccccgttcccggttaccccgtttaccgggtttaacccgggttttaccgggggacccggggttaacgggggtacccgggttaaggggggttaccggtaacggtaaccgttaaaaccgggtaaaccggtaaccggttacggggttaccggtacccggtaccgtacccgttaccgtacggtttccgttaccggtttcctttacccgttacccgtttcccccgg

SEQ ID NO: 248383 - DNA, 876 bp, Homo sapiens
  misc_feature: GYAE6OF01CVXLS.47.64.F09.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (479)..(479): a, c, t, g, unknown or other
  misc_feature (479)..(479): n is a, c, g, or t
  modified_base (798)..(798): a, c, t, g, unknown or other
  misc_feature (798)..(798): n is a, c, g, or t
tcagagctcacgtacacgaccggtgctcgatttagcgcgtatacaagggggaggaactgctcagttaggacccagagggaaccatggaagccccagctcagcttctctcctcctgctactctggctcccagactaccaccggagaagttattttgacacagtctccagccaccctgtctttgctccgagggaanacgccacccgtcncctgcagggtcacgtcagtagtgttgacgacgtcttaacgttacggttcctacgggtaaacccgaaaggtaaccgtaaaacccggtgggaccccgtaacggggtaccccttaacccccggaacgggttccccttaccccttaaccgtaaggtttcccggtaagggggtaactttccggaaccctaaccgtaacccccggaaaacggtaccggggccccgcggttcgggaacccaccgttaccccggaagggtccccgtaaggggtttaaccncgggtacgggtaccgttacggggtcggggttccgtacgggggtaactaacgggttacgttacccgtacgttcccgtaaccgtaacccacgttccgaacgtacccgaccgtacgttcgaccgttaacgtccgttaagtaacgtttagtttaccgtaactttaacttttaaacgtccggtttagaccgtaacgttaacgtaaagttaaccgtttaaaccgtaacgggttcccgtaaccgttcgggttaacccccggtagggtaaaccccgggaaggtacccggtaaccgtaacggtaggtaacgttaaacggtttaaccgngttcggtagtacccgagtaccccggtataaccgttcggttcctaacgttcccgtccttacccgtcccgaatttaccgg

SEQ ID NO: 248384 - DNA, 779 bp, Homo sapiens
  misc_feature: GYAE6OF01BUA6D.47.64.F09.1.454.CMB.1.raw
  modified_base (204)..(204): a, c, t, g, unknown or other
  misc_feature (204)..(204): n is a, c, g, or t
  modified_base (740)..(740): a, c, t, g, unknown or other
  misc_feature (740)..(740): n is a, c, g, or t
  modified_base (754)..(754): a, c, t, g, unknown or other
  misc_feature (754)..(754): n is a, c, g, or t
tcagagctcacgtacacgaccggtgctcgatttagcgcgtatacaagggggaggaactgctcagttaggacccagagggaaccatggaagccccagctcagcttctccttcctcctgctactctggcctcccagataccagtcggagagttgtgttgacacagtctccagcccaccctgttctttgtctaccgaaggggaaacncgcccaccctctccgtgcgacgggccagtcaagtaatattccacttcctacgttacgccgtacggtaaccaaactaacgaaaccgtggtaccgaacggtcctacccgaacggtcccttacctacctacttaccgtatacggtacttcgacctaacgtaccccgaaacggaccgggtaccctaacgtcgggacctaaccgtaccccgaaaggtaaccggtaggttccgaagggttcgggaccgttacggggtcggggttacggtaggggaaacctacggttacccttacgtacccgtacctacccaaaccgtacgtaccaacggacctaccggtaccgtaaggacccgtaacgttaacggtaaacgttaccgttttacgggttaacttttaacgttacgttacggtacgtagtaccgtaaggtccggtacgttacggttccgtccgtacccgtaccgttccgtaccgttaccggttcggggacgggtaacgggtacggtacgggtagacgtaacgaaccgtaaacgtcgtggacgtntaccgatacccgtntaccttcgtaccttgtccttacccg

SEQ ID NO: 248385 - DNA, 773 bp, Homo sapiens
  misc_feature: GYAE6OF01DM5JM.47.64.F09.1.454.CMB.1.raw
  modified_base (141)..(141): a, c, t, g, unknown or other
  misc_feature (141)..(141): n is a, c, g, or t
  modified_base (196)..(196): a, c, t, g, unknown or other
  misc_feature (196)..(196): n is a, c, g, or t
  modified_base (442)..(442): a, c, t, g, unknown or other
  misc_feature (442)..(442): n is a, c, g, or t
tcagagctcacgtacacgaccggtgctcgatttagcgcgtatacaagggggaggaactgctcagttaggacccagagggaaccatggaagcccagctcacgcttctctcctctgctactctggctccagataccatcgganaagttgtgttgacacagtctccagccacctgttctttgtctccgaaggggaaacncgcccaccctctccgtgcgagggccagtcagaattactcacgttcctacgttacgccgtcggtaaccaacacgaaaccgtggtacgaacggtcctcccgaggtaccttcccgtactattccgtaatcgtagtcgactactaccgaacgtcgggaccctacgtcggacacctaccgaggtaacgtggttccagggtcgacgtaggtcgggtacgtacgggactacgtaccttacacgttccactacnctacgacgacgacgtaccgtaacggctaacccggttagtaaacgggttcgttttacgggttaacttttaacgttaccgttccgggtaactacggtcgtaacgggtaccgttacggttccgtttcggttacccgtcccgttaccgttcccggtttaaccgttacgggggtttacccgggacccggggttaaggggacccgggttaggggggtaaaccgtacggttaaaccggtaaacggtaaacccgtaagggtcccgggtacggtacccgtacggtacccgtaaccgtcgttttaacgtcccggtttcttacccggtccgttttaccccgg

SEQ ID NO: 248386 - DNA, 846 bp, Homo sapiens
  misc_feature: GYAE6OF01DW14O.47.64.F09.1.454.CMB.1.raw
  modified_base (147)..(147): a, c, t, g, unknown or other
  misc_feature (147)..(147): n is a, c, g, or t
  modified_base (202)..(202): a, c, t, g, unknown or other
  misc_feature (202)..(202): n is a, c, g, or t
tcagagctcacgtacacgaccggtgctcgatttagcgcgtatacaagggggaggaactgctcagttaggacccagagggaaccatggaacgccccagctcagcttctcttcctcctgctactctggctcccagactaccagtcgganaagttgtgttgacacagtctccagccacctgttcttgtctaccgaaggggaaacncgcccacccgtctccgtgaccggacgggccctaaggtacaacgtaacttacttccgtaccttacccgttaactttaccggcccgttaggtaacccaaacgaacgtaaaccgtcggtacgacggtcctaccgaggtccttacctcacttactatggtactcgactacctaaccgaacggacggtacctaccgtggacctaccgtaccgaacgacgtacggttacaacgggtcggtacggtacggttcggggtacggtaacgggaaccgtacggttaacccttaccgtacggttaccctaccgtaacctccggttaacgaacgtaccgtaccggtaccgtaacgaccggttaccgtaacgggttaaacgtttacccgtttttaacggttaaccgttttaacgtttaccggttacgtaccggtaacggtacgtacgggttacgtttaggttaccgttccgggttccgtaacccgttcccttaccggtttaccggtaccgggtttacggggacccgggtacgggtacgggtacggggtacgttaaacgaccgggttaacaaaccgggtttcggtaggtcccggtacttaaccgggtccctaaccggttacttacgggtttcttaaccgttccctccggtttacccccg

SEQ ID NO: 248387 - DNA, 742 bp, Homo sapiens
  misc_feature: GYAE6OF01C9QIL.47.64.F09.1.454.CMB.1.raw
  modified_base (365)..(365): a, c, t, g, unknown or other
  misc_feature (365)..(365): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgttctttgtctccgaaggggaaagcgcccaccctctcctgcgacgggccagtcagtaatacttcacctcctacttacgcctggtaaccaacgaacgaaccgtggtacacggcctcccgaggcctcctctatctatgatcgacactaccgaacgcgggaccactcggacacctaccagacgtacggtacgnggtcggacgtaggtcgggtcgtacgggactacgtaccttacgacctcctactacctacgtccacgtaccgtacggaccgttaacggaccgtaccgttaggtaaacggttacccggttttttacggtaaccttttttaacgtacccggttagtccgtaacggtaccgtaggttaccggttacggtttaccggtttaccggtcccgggttaacccgttcccggtaacccgtttccggttaacgggtttcccgggggaacggtacggggttaccgggtaggggtaacgaaggtaccgtaaaccgggtaaacggtcgttgggtaccggtcgtaccgcgtaccctaggttccttacgtttaccttccgtaccggtttccccg

SEQ ID NO: 248388 - DNA, 746 bp, Homo sapiens
  misc_feature: GYAE6OF01E3PZZ.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgttctttgtctccgaggggaanacgccaccctctcctgcgagggccagtcgaagtaatacttccacctcccttacttacgacccttacggtaacccaaacaacggtaaacccttgggtaccgaacggcccgttaccccgaggtcccttcccgtctacttaccttagtcggattcgaccacgttacccaaacggtaccggggcctaaccgtcggacccaaccgttccccaacggtaccgttaaggttccgtaagggtcggacggtagggtcggggttacgtacggggaactacggtaccttaccgaccttaccgtaccaacctaataccgaaccgacgtaccgtactaacgaacgtccgttaaggtaacgttaccgttttagttaactttagtttactgtactagccgtagtcgtgtacgttccgtcgccgttccgcgttcgtaccggtttcggacgggtacggaccggtaggggtacgaacgtacgtaaccgtaaacggtacggttcggacggtcgtacgacccttacccggtacttccggttatttccttaccgttccgtttaccccgg

SEQ ID NO: 248389 - DNA, 868 bp, Homo sapiens
  misc_feature: GYAE6OF01APGU4.47.64.F09.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
tcagagctcacgtacacgaccggtgctcgatttagcgcgtatacaaggggggaggactgctcagttaggacccagagggaccatggaagcccagctcagcttctcttcctctgctactctggctcccagataccgatcggagaagttgtgttgacacagcctccagccaccctgttctttgtctccgaggggaaancgcccaccctntccgtgcagggccagtcaagtatacttcactcctacttacgcctggtaaccaacgagaaaccctggtcacggtccgtacccctaggcccttcctactacgtacctagtcgtacgtcgacctactacccgaaacgacggggtacccacggtcggacctaacctaccccgaacggaaccgttacgggttaccgagggttcgggaccgttaacggggttcgggggttacggtaccggggtaacctaacgggttaacccgtttacccggtaaacctttcccgttaacccgtaaccccgtaagttccccgaacggtcccgtaaccggtaccccgtaaggaccggtaccccgttaggtaaaccgggttacgtttttaccgttacgttttaactttaccgtttcgtaccgtaacgtcgtagggccgggttttacgtacggtttcccgggttaccggtcccccgtttcgtaaccccgtttaccgtttacccggggttttacccggggaacgggggttaaccggggtacccgggtaggggggttaaccgacggggttaacaaaacccggtttaaaacccgggtacggtttccggggtagggtcccgttaccggaccgtaacccctgggtttcccttaccgtttacccgttacgttcccgttttacccccg

SEQ ID NO: 248390 - DNA, 798 bp, Homo sapiens
  misc_feature: GYAE6OF01EJI4J.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctccagataccatcggagtaagttgtgttgacacagtcctccacgcctacccttgttctttcgtcctaccgaaggggaaagacgccctaccctcctccgtcgccgacgggccagtcgaagtaattattaccaccttccttacttacgccttacggtaaccaaccgaacgaaaccgtcggtacgacggtcctacccgacggtccttcctactacgtacttacgtgtactcgactactacccgaaccggacggggaccctacggtcggcctaaccgtacccgaacggtaacgtacgggttacgacggtacgggcggttagggtcgggtcggtaggtaccgaagtccgttactaccttcctacgacctacgtacgaccgtacgacggttacctaacggaccgtacgtaggttaaaccttacggtttaacgttacttttacgtttaccgtacgttacgtacgtacggtacggtacgttacggttacccgtttcgtaccgggtacccttcccggttcctacgggtttacccgggtcgggtaacccggggttacgggaacgggtacggggttaacggacgtaacggtaaaccggttaacgtaccgggtttggacccgggttctaccgaaccgttaccgttacttccgttagtttacccttccggtacctttcccccggg

SEQ ID NO: 248391 - DNA, 601 bp, Homo sapiens
  misc_feature: GYAE6OF01CBBLE.47.64.F09.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcctaccctgtctttgtctccgaaggggaaangcccaccctctcctgcgagggccagtcagaatatcactcctacttagcctggtaccaanacgtaaacctggtcaggcctcccgaggcctcctntatctatgtacngcactccaacgcggccagtggcactccagactaggttcaggtcgacgtggtcggtcgtaggaccagtccttacgactcctacacagtcagcacgcctagacgtacctagtaacgtacgtttaggtaactttacgttacgtcgtacgagtcgagtcggtagtcgttcgtcgcccgttcgtcgtaccgtacgttccgggacggtacgggacgtaggggtcgaagaccgtaagaaacggtcgtggtacggtccgtacgcccgacgtacgtttccgtagtttccttaccgtcgttaccccg

SEQ ID NO: 248392 - DNA, 704 bp, Homo sapiens
  misc_feature: GYAE6OF01EF6WZ.47.64.F09.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagactaccatcggagtaagttgtgttgacactagtctccagccaccctgtccttgctccgaggggaancgccaccctctctgctagggccaggtcaagaatnttccactcctattacgcctagtaccaacagaacctggtacacggtcctacccgnggtcctacctcgtattactacgtgtatcgactactccaacgtcgggccacgtcggcactccgagtactaggtcaggtcggcgtaggtcggtcgtagggactaggtacttcgaactctaccaccgtataccgacgtacgtaaccgtccgtaacgaccgtaccgttaggtaaaccggttacgtttaaacgggttaaacttttagttaaccgttacgtacgtaacgtaccgtacggtacggttacgttcggtttaccgccggtacccctaccggttccgtaccggtttacggttccggggaccgggtaacggggacccgtaggggtaccgaacggtagtaaacccgtaaacgtacgggttacgacgggttcctaccggacctacggtacgttccacggtttactcccttaccgttccccgg

SEQ ID NO: 248393 - DNA, 679 bp, Homo sapiens
  misc_feature: GYAE6OF01APE7K.47.64.F09.1.454.CMB.1.raw
  modified_base (162)..(162): a, c, t, g, unknown or other
  misc_feature (162)..(162): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (520)..(520): a, c, t, g, unknown or other
  misc_feature (520)..(520): n is a, c, g, or t
  modified_base (539)..(539): a, c, t, g, unknown or other
  misc_feature (539)..(539): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagtaagttgtgttagacanagtctccagccaccctgtctttgcacgagggaaancgccacctctcngcagggccagcaagaatntcactcctattacgctaggaaccaanacgaaacctggacacggcctccgaggcctacncagtntangatgacactaccaacgacgggaccacgtaggcctacctacccgtaggtaactacgggttacaagggtcgtaccggtaagggttcccggggtagtaacggggaccttacgtaaccttaccgaacgttccctaaccaccgtataccgaacggtaccacgttaaccgtaacgacgtccgttaagaaccgttacgtttaacggtacttttaagtcgtgtaacctgaaccgnggttcgtaggtagttcccnggtcctaccggtctaaccgtcgggttacggacggtacgggaacgtcgggtaggaaggtaccctaaggaaaccggttacgacggttcggtaccgacgtaccaaccgggttactcgttaacggtcttccggtaacttacccg

SEQ ID NO: 248394 - DNA, 757 bp, Homo sapiens
  misc_feature: GYAE6OF01AQXXY.47.64.F09.1.454.CMB.1.raw
  modified_base (164)..(164): a, c, t, g, unknown or other
  misc_feature (164)..(164): n is a, c, g, or t
  modified_base (192)..(192): a, c, t, g, unknown or other
  misc_feature (192)..(192): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtcnccacgccacctgtcttgctcgagggaancgcccaccctctcctgcacgggccagtcagatatccactcctacttacgtcctaggtaaccaacagaaacccgtggtaccacgggttccaccccgaggtcccttccctacgtaactcgttaagtgtacacgtcacttaccgaacggtaccggaccctactggaccctacgtaccccaaggaacccgttaggggttaccgaaggttcggtacggttacgggtttacgggggttcgaagggggtaaccaccgttaccgttaccacccgttccgttacccaaaccgtacgttacccggaactccgtaaccggaccgtaccggtaccgtaccgttacgtaaacgttacgtttaacgtttaactttacgttactacggtactggactaggtacgtggttacgtccgtccgtaccgttccgtaccgttaccgttaccggttccgggaccgggtaacgggaccggtaggggtacggtactaaccggtaaccgtaaaaccggtcgtacggtccgggacttaccggtacctaaccgtcgttacccgtttgttaccgttccgttccgttaccccg

SEQ ID NO: 248395 - DNA, 739 bp, Homo sapiens
  misc_feature: GYAE6OF01B2FZQ.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagccacctgtcttgtctccgaggggaaancgccaccctctcctgcgagggccagtacaagtaatacttcactcctacgttacgcctaggtaaccaagacgtaaacctggtacacggtcctcccgaggccttccgtactactctatcgatcgactactacccgaacgacgggacctaacggtcggtacctacgttaccccgaagtaaccggttaggttaccgtagggtacgggtacgtaggtcggggttcgtacggggaactaggtaccctttcgtaaccgttccctaccgtaaccgtagtaccgacggtaccgacggtcccgtaacggaccgtccgttaacggtaacggttaccgttttacggttaacgttttacgtacgttcgtacgtaacgtcgtacgggtcgtttaacggtacgttttccggtaccgggtcccgttacccgtacctttaccgggtaccggtttccggggaccgggtacgggtaccggtaggggtacgacggtacgtaaacgaacgtacggttaggcggtactcgtactacgtcgtacttacgtccttgtaccgttcccg

SEQ ID NO: 248396 - DNA, 741 bp, Homo sapiens
  misc_feature: GYAE6OF01AV7YZ.47.64.F09.1.454.CMB.1.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
  modified_base (444)..(444): a, c, t, g, unknown or other
  misc_feature (444)..(444): n is a, c, g, or t
tcagagctcacgtacacgaccggtgctcgatttagcgcgtatacaagggggaggaactgctcagttaggacccagagggaaccatggaagccccagctcagcttctcttcctcctgcttactctggctcccagataccatcggagaagttgtgttgacacagtctccagccacccttgttctttgtcctccgaagggggaaanacgcccacccttctccgtggccacgggccagtcagaatnttcacctcctacttacgccctaggtacccaacgacgaaacctggacacggcctacccgaggtcctccctanacgttctagtgtatcgccactccgaacgcggaccacgtcggccactcccgaagtactacgggttcaaggtcggccgtagggttcgggtcgtagggacctaagtacctcctacgttccctaccaaaccgttntaccgaccgtcgaacgtacccggtaacggtaccggtacccgttacggtaacggtttaccgttttacgggttaacttttaacgtttaccgtttacgtaccgtaacggtaccgtagttcggttacgttacggttccgttccggtacccgttcccgttaccggttacccgttcccgggtttccgggtaaccggggtaaccgggtaccgggtacggggttacgggacgtaaaccgtaaccgaaacgtacggtggtacgggtctacgaccctacgtacgttctattcttcctcgttaccccg

SEQ ID NO: 248397 - DNA, 697 bp, Homo sapiens
  misc_feature: GYAE6OF01BGY8W.47.64.F09.1.454.CMB.1.raw
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctgtcgtctaccgaaggggaaancgcccacctctccgngcgagggccagtcagagtattagcaacgcaattagcctaggtaccagacaacgaaaccgtgggactacggcctacccgaggtcctcctacaattcctagtgggtcacctaacgtcccaccgaggggaccctaacgtcggtacaccccgtacgaccgtagggttccaggtcggtacgagggttcgggtacgagggacgtagtacgtttacaccttacctaccgtaaccattcggactcgacgtacccgtgacgtaagtcttaaggtaaggtttattttcgaaacttttaagttttaacgttaccgttagtaacgaaccgtaagttaattaaacggttaaaaccttacggtaccggtacccgtacgttaccgtacccgggaaccggaaggtacccgaaggaccgttggaaactaaacgttaaacggacgttgggtacagtaccgaacaccgttagtacttaggtaccttgtaacccttcccgg

SEQ ID NO: 248398 - DNA, 642 bp, Homo sapiens
  misc_feature: GYAE6OF01ES6XI.47.64.F09.1.454.CMB.1.raw
  modified_base (198)..(198): a, c, t, g, unknown or other
  misc_feature (198)..(198): n is a, c, g, or t
  modified_base (340)..(340): a, c, t, g, unknown or other
  misc_feature (340)..(340): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccacccttgtctttgtcctccgaggggaaanacgcccaccctctcctgcgacgggccagtcaagaatacttcactccttacttacgcctacggtaaccaaacaacgaaaccgtggtacgacggctcccaggtcctcctcattctatgtagtcgacactaccaacggacggccnccggtagcacctcccgaacggtacgaggttccgaggttcggcgtaggttcggggtcggtagggaactacggtacttacacgtcctaccacgtactcgacgctacgacctagacggtacctaggaacgtttcgttagttactttagtacctcgtactacgctagcggtagtcgttcgtccgtcccgtccgtcgtccgttaccggttcgggtacgggaacggtaccgggtggggacgtagtacgaacgtacggtaactggtacgcgtcgccacgtacttcgtagttcctaacgtcgttaccccg

SEQ ID NO: 248399 - DNA, 746 bp, Homo sapiens
  misc_feature: GYAE6OF01BBL6Q.47.64.F09.1.454.CMB.1.raw
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (587)..(587): a, c, t, g, unknown or other
  misc_feature (587)..(587): n is a, c, g, or t
  modified_base (669)..(669): a, c, t, g, unknown or other
  misc_feature (669)..(669): n is a, c, g, or t
tcagagctcacgtacacgaccggtgctcgatttagcgcgtatacaagggggaggaactgctcagttaggacccagagggaaccatggaacgccccagctcagcttctcttcctcctgctactctggctcccagataccatcggagagttgtgttgacacagtctccagccaccctgttctttgtcctccgaaggggaaancgccctacccgtctcccgngcgagggccagtcaagaacttattccgacttaccctacttacgccctaggtaacccaaacgaacggtaaaacctggtaccacgggcctacccgaggtaccctccctactattaccttacgtgacgttacgaccgtaaacaccccaaaccgggtaccgggtaccccgtaacggttaccggccgtaacttacccccgaagtaacgtacggttaccgaggttacgggacgtagggtcggggtacggtacggggaacctaagggttacccttaccgtaaccttccgtaccctaaccactaccgagtacccgacgtaccgtaggaacctaccgtagtaaacggttacgtttagttaaccgtttattacccgtnttacggaggttactcggtaggtacttacgttccggtcgcccgttaccgtcgtaccgttaccgggtcggacgggacggtacgnggagtacgtaacgtaacgaaccggtacgtggtacgtcgaccgactacgtacttctacccggtctcgtacgttccccg

SEQ ID NO: 248400 - DNA, 614 bp, Homo sapiens
  misc_feature: GYAE6OF01CEF92.47.64.F09.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcgganaagttgtgttgacacagtctccagccaccctgtctttgtctccgaggggaaancgcccaccctctcctgcgagggccagtcagaatnttcactcctacttagcctggtaaccanagaacctggtcaggctccaggctcctcatctatgatgacatcccgaacgacgggtaccagtggctactacccaaggactaggttcaggttggcctaggtcggggtctggggacacggtacttcactcgtcaccatcatcacgctagacgtcctagtaacgtacgtttggtactttagtcgttatcgagtacgacgtacgtcgtaagttccgtcgtcccgtacgtcctccggttacgtttcggggacggtacgggaccggtaggggacgtaacgtagtaaccggaaaccggtacggttacggacggtcttacgaccctaacgtcgttacgttacggttaccttcgtaccgttccccg

SEQ ID NO: 248401 - DNA, 834 bp, Homo sapiens
  misc_feature: GYAE6OF01C4K33.47.64.F09.1.454.CMB.1.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccagtcggagaagttgtgttgacacagtctccagccctacccttgttctttgtctccgaaggggaaancgcccaccctctcctgcgaggtcagtcagtgtgtagacngtcttacttagtcgtaggtaaccaaggaacgtaaaccgtcggacccaggccttacccgaggtccttacctacgagttccggtaggggaacttcggaacctaactaccccggaaaccggacgggggtccctcggtacggacctaacctaccccggaacgtccggtaaggtttccgaaggtcggaccgttaggggttcgggtccgtaggggaactacggtaccttccgtaactcccgtaccgaacctacgtacgaacgaccgtaacgtcgttaaacggacctacggttaaggtaaagttttacgttttacggtaacgtttaagtttttaaccgttacgtttaacgttaacgtaacgtaaaccgttaaaacggttaaccttccggtaccggttacccgtccgttacctttacccggttaaccgggtttccggggaaccggggtacgggtaaccgggtaggggtaacgtaaaccggttaaggtaaaccggtaaacccggtaaggttcgggtacggtaccgtaccggaccgttaacccttacggtttaccgttacggtttaccgttaacccgttccggtttcccccgtttaaccccg

SEQ ID NO: 248402 - DNA, 797 bp, Homo sapiens
  misc_feature: GYAE6OF01A5RBN.47.64.F09.1.454.CMB.1.raw
  modified_base (214)..(214): a, c, t, g, unknown or other
  misc_feature (214)..(214): n is a, c, g, or t
tcagagctcacgtacacgaccggtgctcgatttagcgcgtatacaagggggaggaactgctcagttaggacccagagggaaccatggaacgccccagctcagcttctcttcctcctgctactctggcctccagacgacccagtggagaaatgtgatgacgcacgtctaccgagccctacccttgtctgtacctccgtaccggaagggggaaacnccgacccctaacctattcccgtccggtaggggtaaccggggtcccggtacaaggtaactttacgttacctaccttccgttaacgtaggtcccgtaggtaaacccaaacgagtaaacccgtggtaccgacggtccctaccgacggtcctcctctaattctagtgacgtcgacctacgtacccgaaacggaccggacctaccgtcggaccctacgtacccgaaggtaccgtagggtttaacgacgggtacggtacggttacggggttcgggtacggtacgggacctaacgttaccgttactacccttaccacccgtaactccgtacaacgtaccacggtacccgtaagtccgtaccgttaacggtatttaccgtttaagttaactttactacgttacgtcgagtccgtagtcgttacgtccgttcgccgtaccgtccgtaccgtttccggtaacggttccggggaacggtccgggacggttacgggacgtaaccggaagttaaaccgggtaaccgtagggttacggtaccgtcgtaacccggccttacggtacgttacctttccggttccttaacgttcccccgg

SEQ ID NO: 248403 - DNA, 703 bp, Homo sapiens
  misc_feature: GYAE6OF01C68R7.47.64.F09.1.454.CMB.1.raw
  modified_base (193)..(193): a, c, t, g, unknown or other
  misc_feature (193)..(193): n is a, c, g, or t
tcagagctcacgtacacgaccggtgctcgatttagcgcgtatacaagggggaggaactgctcagttaggacccagagggaaccatggaagccccagctcagcttctcctcctcctgctactctggctcccagataccatcggagaagttgtgttgacacagtctcagccacctgtctttgctcgaaggggaanacgccaccctctcctgacgagggccagtcagaattatcactctacttagcctgaccaacagaaacctgtcagcctaccaggcctcacatactatcgatcgactactaccgaacgacgggtaccacgcggtaccaactacccgaaggtaccacggttacgacggtcgacggtaggttcgggtcgtaggggaactacggtacttccgactcccgtacaaccgtactacacggacctacgaccgttaacggaacgtaccgttaaggaaaccgtttacgttttacggttaaacttttaacgttacggttcttaacggagtaccgaggttccgttacgttacgttcggtcggtacccctccgttaccgttaccgtacggttacggggaacccgggtaggggaccgtaaggggtaccggaaacggtactaaaccggaaacgggttcgttaaccggtggtccgttaacgaccgtaccttaacggttcttcgtttaccgtacctttccgggttaaccc

SEQ ID NO: 248404 - DNA, 889 bp, Homo sapiens
  misc_feature: GYAE6OF01BHH3Z.47.64.F09.1.454.CMB.1.raw
  modified_base (201)..(201): a, c, t, g, unknown or other
  misc_feature (201)..(201): n is a, c, g, or t
  modified_base (332)..(332): a, c, t, g, unknown or other
  misc_feature (332)..(332): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagcccacccttgttctttgtctccgaaggggaancgcccaccctctcctgcgagggtcagtcagtaggtgttagacagtccttacttagtcgtaggtaaccaagacgaaacctgggacccaggccctacccgaggtccttcctacgacttcgttagtcgggtacncctacgtcccgaccggtacggggacccctacggttacgggttaccctcccgacggtacccgtaagggtttaccaagggttccgggaccgtagggggttacgggttccgggtaacgggggaacctagggttaacgtttcccgtaaccgtttaccgttacccgaaacctacgttacgaacggtcccgaccggtacccgtttaccggaccgtttaacgggttccgttaagggttaaacgttttacgtttttaacggtaacctttttaaaacttttttaccgttaccggttttacggttaccgtaaaggttaacccgtttaaaggtttaaacccgtttaaacgttaaccgggttcccggtacccgttaccggtttaccggtaaccccggggtaaccggaaacggggtaacccgtaaccggttaaccgggttaagggtaaaccggttaaacgtttaaacccggtaacggttcgggttacggtaacccggttcgaaacccgttacccttacgtttccgttaccggtttaccttaccgttaaccctttcccggtcccctaaccg

SEQ ID NO: 248405 - DNA, 639 bp, Homo sapiens
  misc_feature: GYAE6OF01AZI2P.47.64.F09.1.454.CMB.1.raw
  modified_base (199)..(199): a, c, t, g, unknown or other
  misc_feature (199)..(199): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagtttgtgttgacacagtctccagcccacctgtctgtgtctccgaggggaaangcccaccctctcctgcagggccagtcagagtatagcagcaacttagcctggaccagcaagaacctggcaggctccagctcnatctanggtnctacnccacgngggccagtgacnccagctggtnaggtcggcaggtcggcgtagggacacgtacttcacgtctacacctataccgacgacgacgccgttaagacgtacgtagaacgttacgtttaggtaacttttacgtacgtcgtacgagcgtaaggtcgttaggttaccttcggtccggtacccgttcccgtaccgtttaccgttaccgggttttcccgggacggggtaccggggtaacccgtaggggggttacgaagtaaaccggtaacgtaaaaccggttacggttgggttacggccgtaacgacccgtaaacttcgtttacgttccgttatttaccccgtacccg

SEQ ID NO: 248406 - DNA, 736 bp, Homo sapiens
  misc_feature: GYAE6OF01AX7T5.47.64.F09.1.454.CMB.1.raw
  modified_base (199)..(199): a, c, t, g, unknown or other
  misc_feature (199)..(199): n is a, c, g, or t
  modified_base (690)..(690): a, c, t, g, unknown or other
  misc_feature (690)..(690): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagtaagttgtgttgacacagtctccagccacctgttctttgtctccgaaggggaancgcccaccctctccgtgccgacgggccagtcaagtaacttattccacctccgttacttacgcctacggtaaccaaacgtacgaaacctgggtaccacggtccctacccgaggtcccttccgtacactttctaagtgtactcgactacgtaccgaacggacgggccctaacgtggacctaaccgtcccgaaggtaccgtaggttaccagggtacggtcgtagggttcgggtacgtacgggactaacggtacctttccgaccttcgtacccaacgttcgtaccgacggtaccacggtaccctaagggaccgtaccgtaaggtaaacgtttacgttttaaggttaacttttacgttacgtgtaccgacggtacgacggttcgtacggttacgttcccgtaccgggtcccttaccgtcgttaccgttaccgggttcgggacggtacgggtaccgtggggtacgaacgttaccgaacgtaaaccggtgtggtccgngtaccgtctaaccgttcgtttctaccgtttctaccgtcgttccccg

SEQ ID NO: 248407 - DNA, 569 bp, Homo sapiens
  misc_feature: GYAE6OF01E1ET9.47.64.F09.1.454.CMB.1.raw
  modified_base (197)..(197): a, c, t, g, unknown or other
  misc_feature (197)..(197): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (489)..(489): a, c, t, g, unknown or other
  misc_feature (489)..(489): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgctccgaggggaaangccacctctcctgcaggccagtcagaatatcactctatagctgtaccaananaacctgacagctccagctctcatctatgatgacagaccaacgacggccacgtcgcaactccgaagactaggttacgagtggacgtaggtcgggtacgtagggacagtacttcactcgtacacatcacgcacgctagcgtactagtaagtacgttcgtaatttagttactgtacagtcgtagtcgtgtagtcgtcgtacctccgtctcgtacggttcgggacggacgggtaccggtagggnggaacgtagaacgtaaaacggtacgtaggacggtcgaccggtactacccgtacgttcttagttccttacgtcgttacccg

SEQ ID NO: 248408 - DNA, 882 bp, Homo sapiens
  misc_feature: GYAE6OF01BAQ4W.47.64.F09.1.454.CMB.1.raw
  modified_base (205)..(205): a, c, t, g, unknown or other
  misc_feature (205)..(205): n is a, c, g, or t
tcagagctcacgtacacgaccggtgctcgatttagcgcgtatacaagggggaggaactgctcagttaggacccagagggaaccatggaacgccccagctcagcttctcttcctcctgctactctggctcccagataccatcggagtaagttgtgttgacacagtcctccagccctaccctgttctttgtcctaccgaaggggaancgccctaccctctcctgcgacggccagtacaagtaattacttccaccttccttaacgttacgccgttacggtaacccaaacgaacgtaaacccgttggtaccgaacggtcccttaccccgaacggtcccttacccgtactacttacgtaacgtcgtaacttcgacctaaccgttaccccgaaaaccggaccggggtaccctaacggtccgggaaccacccgttacccgaagtaccgttacggttaccgtaagggtccggtacgtagggttcggggttaccggtaacggggtaacctaacggttacccgtttaccgaacccgtttaccgtacccgaaccgttacgtacccgtaacggtacccgtaaccgtacccgttaaggtaccccggtaccgttaaagggttaaccggtttacccgttttaaggttaacctttttacgttaccggtacggtttaaccgacgtaccgtacgggttaccggttagtttacccgggttaccgtaccgggtccccttacccggttacttacccgggtttaccggttacggggaacccgggtacgggttaccggaagggttacggaaacgttaccgtaaacggtaaacgtccggttagggtccgtaccgtcgaacccttacgttaccgtttcgtactttcccgttctacccgtttaccccg

SEQ ID NO: 248409 - DNA, 799 bp, Homo sapiens
  misc_feature: GYAE6OF01DFX4Z.47.64.F09.1.454.CMB.1.raw
  modified_base (204)..(204): a, c, t, g, unknown or other
  misc_feature (204)..(204): n is a, c, g, or t
  modified_base (629)..(629): a, c, t, g, unknown or other
  misc_feature (629)..(629): n is a, c, g, or t
  modified_base (638)..(638): a, c, t, g, unknown or other
  misc_feature (638)..(638): n is a, c, g, or t
  modified_base (749)..(749): a, c, t, g, unknown or other
  misc_feature (749)..(749): n is a, c, g, or t
tcagagctcacgtacacgaccggtgctcgatttagcgcgtatacaagggggaggaactgctcagttaggacccagagggaaccatggaagccccagctcagcttctctcctcctgctactctggctcccagataccatcgggagaagtttgtgttgaccacagtctccacgcccacccttgtctttgtcctccgaaggggaacncgcccaccctctccgtgcgacgggccagtccgaggtagttgttacgactacgtcttaacgttacggttaccgtcgggttaacccaaaggaacggtaaaacccgttcggggacccacgggcccttaccccggaacgggtcccttccctacacttcgtaatcgtacttcgcctaacgtacccgaaaggaccggggaccctacggtcggacctaaccgttaccccgaacggtaccgtacggtttacgtaacggtcggggacgttaggggttcgggggttcgtacggggtacctaacgttacccgttacaaccgttccgtaacccaaccgtacttaccgaacgtccgtaacgtcccgtaaacgaccggttccgtaaagggtaacgtttacgtttaacggttaactttacgttaacgtgtacgagtacgngtacggttntacgttccgtcggtacctccgtcgtacgttcggttaccgggacgggtacgggaaccggtaggggttacgaaacggtagtacccggaaaacggtccgtcggtacggttaccncgggtaaccctaccggttacgtccgtttacctccgtttacgtaacccccg

SEQ ID NO: 248410 - DNA, 797 bp, Homo sapiens
  misc_feature: GYAE6OF01D3YQM.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagtaagtttattttgacacagtctccagccacctgtctttgtctccgaaggggaanagccaccctctcctgcgagggtcagtcagagtgttgacagtcttacgttagtctaggtaaccaagacgaaaccgtggccaggcctcccgaggcctccgtacagtcgtggatgactataccgaagacgggccgcgtaggcctacgtccccgaagtccgtaaggttcacggttaggccgtagggttggggtccgtaggggacctaagtaccgtttcgccgttaaaaaccctcgaaccctagtccgaaggcctaacggtacccgtaacggtacgtaccgttaggtaaagtttacgttttacgtacgtttaaacgttttacgtttaaccgttacggttaccgtaacggtaaccggttaaaccggttaaactttaccggtaccgggttacccgtttacccgtaccgtttacccgttaaccgggttttacccggggaccggggtaaccgggtaccgggttaacggggtaacggtaacgtaacgtaaaccggtaaaccggttaacggttacgggtacggttaccgtaccgtaccgtaaccctaacgttcccgtttaaccgggttacctttaccggttaccctttccccgttacccgtccgttaacg

SEQ ID NO: 248411 - DNA, 704 bp, Homo sapiens
  misc_feature: GYAE6OF01DTNE8.47.64.F09.1.454.CMB.1.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaaggggaanagcccaccctctcctgcacgggccagtcagaatntcactctacttagcctggtaccaanagaacctgggcaggcctccaggctcctcatctatggtcgcactccaccgacgggccacgtggtactcccgacgccgtaggttcaggtcggcgtaggtgggtcgtagggactaggtacgttcacgttcctaccaccagtaccacggacctacgtacctcggtacgtacgttccgttaagtaacgtttagtttttacgaacgtttaaactttttacgttaccgtttagttaccgtaagtacgttaagtttaacttaaacgttaaccgttcggtacccgttcggtacccgttacgggtaacccgtaacggggtaacccgtaacggtaaccggtacgggtaaagttaaaccgttaaacggtaccttagggtcggtaaccgtacgtacccgtactacgttccgttacgtttaccttaaccgtacctttccccgttaccccgttacttaaccgg

SEQ ID NO: 248412 - DNA, 807 bp, Homo sapiens
  misc_feature: GYAE6OF01A7R6I.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggcctccagataccagtcggagaagttgtgttgacacagtctccacgccacccttgtctttcgtcctaccgaggggaaagacgccctaccctctccgtgcgacgggcctagtcaagaatacttccaccttcctacgttacgtccgttacggtaacctaacgaacgtaaaccgttggtacgaccggtcctacccgaggtcccttcctaccaacttcttactgactcgacctaactacccgaaaccggaccgggtaccctaacggttcggacctaaccgtaccccgaaggtaaccggtaacggtttacggacgggtcggtaccgggtaagggttcgggggtttaccgtggggtaacctaacggtttacccgttacgtaaccttacctaccgaacctaacgtcgaaccgtacccgtaacgtacccgtaaggaccgtaccgttaaggtaaccggtttacgttttaacggtaactttttaacgttccgtacgtacgaacggttacgtaacggtcgttacggtaccgtttacgtccgggtccccgttacccgttccgttaccggttaccgtttacgggggacgggtacggtacccgggtggggtacggtaaacgtacgttaaaccggaaacggttaccgtggacggtctacgtccaccgttcgttctaccgtttctcccttccgtttccc

SEQ ID NO: 248413 - DNA, 826 bp, Homo sapiens
  misc_feature: GYAE6OF01B3D1C.47.64.F09.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctcccagataccatcggagaagttgtgttgacactagtctccagccacctgtcttgtctccgaaggggaaancgccacctctcctgcgaggccagtcagaatatcactcctacttagcctggtaccaanagaacctggtcaggctccaggctcctcatctatgactgcacgtacccaacgacgggtccaacgtcggaccaacgtcccgaagtaacctacgggtttacaagggttcggaccgtagggttacggggtcgtacggggaacctaaggttacccgttacgtaaccttacccgtacctaaacccgtagttacccgaaacggttccgtaaacggtaccccgttaacgggaaccgttaaccccgttaacggggtaaaaccggtttaaccgtttttaaccggttaaaccgttttttaaacgtttaaacccggtttcggttaacccgtaagggtacccgttaaaccgggtcgggtttaccgttaacggttttcccggtttacgggtccccctttacccgggttacccgtttaccggttaacccgggttttccggggaaccgggttaacggggtacccgtaagggggtacgggtaacggaaaccgttaaccggtaaaaccgtacgggttaggcgggttacccgtcggtaaccctaccggttacgttacccgtttcgtttacccttccgttaaccgttcccccg

SEQ ID NO: 248414 - DNA, 739 bp, Homo sapiens
  misc_feature: GYAE6OF01A28SX.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaaggggggagaactgctcagttaggacccagagggaaccatggaagccccagctcagcttctcttcctcctgctactctggctcccagataccatcggagaagttgtgttgacacagtctccagccaccctgtctttgtctccgaggggaaancgcccaccctctcctgcagggccagtcagaatacttcactcctacttagcctggtaccaacagaaacctggtacacggtcctcccgaggtcctcctcaactcttagtcgtattgaccactacccgaaacgaccgggccctaacgttcgggacctaccgtacccccgaggtaccccgttagggtttccgaacgggttcgggaccgtaagggttacggtaacggtttacgggtaccggggaacctaacgggttaccctttaccgtaaccctttcctaacccggtaaacctaccgttacgaaaccgtaccgaaccgggttacccgtaaacggaccgtaacccgttaaggtaaacggtttacgtttttacggaccttttaacttttacgttacgtacgtacgacgtcgacggtcgtacgactacgtcgtaccctcgtacgttacggttaccggggcggtaacgggtccgtaggggtacgtactacggttacgaggttaccggacgttgggacgtcgtcggaacctcgtactcgttcgttcttaccg

SEQ ID NO: 248415 - DNA, 713 bp, Homo sapiens
  misc_feature: GYAE6OF01BAG39.47.64.F09.1.454.CMB.1.raw
  modified_base (159)..(159): a, c, t, g, unknown or other
  misc_feature (159)..(159): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacanagtctccagcctacccttgttctttcgtcctaccgaaggggaacacgcccaccctctcctgcgacgggccagtcagtaatatcactcctacttcgcctggtaccagacagaaccgtgggacacggcctaccgagtcctccgtactattcctagtagactcgtccgtacccacggaccggtccctagttccggtttacccgagtacccgtaggttcgaggtcgcgtagtcgtcgtcgtagggtactaggtcgtacaccgttccaccgtacactaccaacgcgtacctcgacgtagtcgtaagtagttctttgtacgttaagttttacgtacgtacgtacgtacgtacgtacgttagtaaccttaacgtaacccgtacggtcccgtaccgttacccggacccgtttaaccggggaccgtaaccgggtacctaaccgggtaacggtaggtaaaccggttaaactaaaaccggtggtaccgtagggtacccgttaggacccctaacggttaccgttacttaccggtttacctaaccttcccgttccccggttaacccc

SEQ ID NO: 248416 - DNA, 691 bp, Homo sapiens
  misc_feature: GYAE6OF01AZTGA.47.64.F09.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (237)..(237): a, c, t, g, unknown or other
  misc_feature (237)..(237): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaacgtttgtgttagacacagtctaccagccaccctgtctttagctaccgaggggaaacncgtccaccctntcctgcagggccagtcagtaatntcactctattgcctaggtaccaacagtaacctggtacacggcctacccaggtcctcctacacttctagtcgtatgacctaactacccaacggacgggcccacgtcggacctaccgtacccgaagacgttaggttccagggtcgcgtaggtcgggttcgagggtaactcgtaccgttcaccttctaccgacagtcacggctacggtacgtacggacgtaccctaagggtacgttaaaccgtttcggtttaactttacggttaccgttgttaaccgagtaccgtggtacgtcgttacggttccgtaccggtccgtaccgtctttaccgttaaccggttcgggaccgggtcgggaaccggtgggtacgggacgtaacgtaaccggaacggtccgttaggtcggtctaacccgcgtaacgttccttacttaccggttacttcccgttacgttaccccg

SEQ ID NO: 248417 - DNA, 768 bp, Homo sapiens
  misc_feature: GYAE6OF01D9YKK.47.64.F09.1.454.CMB.1.raw
  modified_base (201)..(201): a, c, t, g, unknown or other
  misc_feature (201)..(201): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccatcggagaagttgtgttgacacagtctccagcccacccttgtctttgtctccgaaggggaaancgccaccctctcctgcagggccagtcaagaatattcacttcctacttagcctggtaccaacagaacctgtacaggcctcccgagtcctctcatctatgatcgacactaccaacgcgggaccctacgtcggccactccccgaagtaccgtacggtttaccgaggtcggcgtagggttcgggttacgcggggaccagggtacctttcaccgttacctaccaacctactccgaacgtccgaacgtacctaaggaccgtaccgttaagtaaacggtttaccgtttttagggtaacctttttaagttacccgttacgtaccgtaacgtcgtaaccggtccggtacgttaacggttttccgtaccggttccccttacccggtccgtttccgttaaccgggttttcccgggggaaccgggtaccgggggtacccgggtaagggggttacgggtaaaccggtacgttaacccgtaaaggggtaaacccggtttaaggtacgggttcggggtacttacccggtaaccctaaccgttacctttcccggtttacggttaccccttcggttaacccccg

SEQ ID NO: 248418 - DNA, 729 bp, Homo sapiens
  misc_feature: GYAE6OF01C2WJI.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgttcttgtcctcgaaggggaaacncgcccaccctctccgtcggcgacgggaccagtcaagtaattacttcacttacctacgttacgccgttacggaaccaaactacggtaaaccttgggtaccgaacggtcctacccgaggtcctcctactaacttcgtaatcggtattcgactaaccgtaccgaaacgacgggaccctacgtcggccaaccgtacccgaagtaccgtagggttacgaacggtcgggtacgagggtttcggggtacggttacggggaacgacggttaccttacctaacgttcctaaccgacctaagtaccgaacgacgacgtaccgtaagaccgtacgtacgaacgttacgtttaggtaacctttaagttactacgtacgacgtcgtaggtcgtagtacgttcggcgtaccctcgtcctaccggtaccggttcgggacggaacggggtaccgtaggggtacgtaacggacgtaacgtaaacggtacgtagggcggtccaccgtacaccgttagttaccgtactttcgttacgtccgtttacccgg

SEQ ID NO: 248419 - DNA, 954 bp, Homo sapiens
  misc_feature: GYAE6OF01D735B.47.64.F09.1.454.CMB.1.raw
  modified_base (227)..(227): a, c, t, g, unknown or other
  misc_feature (227)..(227): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcgtgaagtagttgtgtcactacgacgttcctaccgacgaccctaccgtttcgtttccttttcgtacccgtaccgggaaaggggaaacncccgacccctacccgttctccgcgacggacggcctagtacgaaggttagtttacgtacgacgaacgtaacctaacgttaccgtccggttacggtaaccacggtaccgtaaaaccggtaaaccgggtcgggaccgaccggtccctacccggcggtaccctcccttaactattaaccgttagtagaacggtcctaacctaaaccgttacccggaaaacggtccgggtaccctaacggttcccgaaccttaccgttaacccggaaacgttaaccgggtacggttaccgtaacggggtcggtaccggtttaggggttcccgggggtacgtaaacggggtaaccttaccggtttaaacccttcccgtacccttacccgttaacccgaaaccttccggaaacggtccgtaacccgtaccgtaccgttacggtaaacgttaacccggttacgtaaaagggtttttccgtttaacggtttttaccgttacgtttttaaacgtttttacgttaaccggttacggtaaccttacggttaacttaaggttaccttaaccgtaccgtacccgggttacgtaccccgtttaccgaccccgttaccgggtaacccggaaacggtaaccggacccggtaacgttaaccggggttaacggtaaaacccggtttaaagttaaacccgggtacgttgggtaaacccgtccggtaaactaccccttagttccgttaccgttacccg

SEQ ID NO: 248420 - DNA, 627 bp, Homo sapiens
  misc_feature: GYAE6OF01EY831.47.64.F09.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (286)..(286): a, c, t, g, unknown or other
  misc_feature (286)..(286): n is a, c, g, or t
  modified_base (464)..(464): a, c, t, g, unknown or other
  misc_feature (464)..(464): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctcgaggggaangccaccctctcctgcgagggccagtcagaatattcactcctacttagcctggtaccaanacgaaacctggtcaggcctcccaggcctcctnatctatgatgcaactcccaacgacgggcccacgtcggaccaactccccgaagtaccgtaggttaccaggttcggacgtaggtggggtcgtacggggacacgtacttccgtactcgtaccacctatcgacgctacgcctagacgtcctagtaacgtacgttttagacttttaattcgtnttccgagtcacgtcgttaggtacgttcgtcgtcccttccgcttcgtacggtttccgggacggtacggaccggtgggtacggacgtacgtaaaccgtaacggacggttgggtacgtccgtacgacccgtaaccttgttaccgttgttaccttctacgttccccg

SEQ ID NO: 248421 - DNA, 764 bp, Homo sapiens
  misc_feature: GYAE6OF01C39QQ.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacagtctccacgccacctgtctttgctccgaaggggaaancgcccaccctctcctgcgagggccagtcagaattcttaccacctacgttactacgtcgtaacgaaccacgaacgtaccgtgtaccgacgcccaccgtacgtcctacctactactacgtatacgtagtacacctaccgaaccgaacggtacccggacctaccggtacggaccctaaccgtacccggtaacggtaaccggttacggtttaacggaaccggggtcgtaacggttacgggggtttccggttacgggaacgggtaacctttacggttacccttaacgtcccttaccaccctaacgtacgtaccacggaccagtaccgtacggacgttaccgtaagaacgtttacgtttaacgttaacgttttactcgtagtacacggtagtccggtaggtttcgtaccgttccgtacgccccgttacgtaccgttaccgttcgggttacgggacggttacggggacggtacgggttacgaacggtacgaaaccgtacggtacggttacgggtaccgtacgaccgtacgacgttacccttagttacccgtttacctcttaaccccgttcccg

SEQ ID NO: 248422 - DNA, 955 bp, Homo sapiens
  misc_feature: GYAE6OF01AS9KR.47.64.F09.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (924)..(924): a, c, t, g, unknown or other
  misc_feature (924)..(924): n is a, c, g, or t
tcagagctcacgtacacgaccggtgctcgatttagcgcgtatacaagggggaggaactgctcagttaggacccagagggaaccatggaagccccagctcagctttctcttcctcctgctactctggcctccagataccatcggagaagtttgtgttcgacacgagttcctccacgccctacccgttgttccttttgtcctaccgagggggaaagtcnccctaccccttntcccctgccgacgggccctaggtaccaggtagttcgggttgaccgtacgaccgtttaactttaccggcccggtttaccgggtaaaaccctaaaccggtaacgaaaaccccggttgggaccccgtaaacgggtcccttaccccgtaccgggcccttacccgttactaactttaccggtacgtttacgggtacttacggcccttaaaaccggttacccccgtaaaacccggaccgggggtacccctttaaaccgggcccgggttaaccctaaaccccgggtttacccccgaaaggggttcccccgtttaaacggggttttaccgggaaacgggtttccgggaccggtaaaccgttggggttaacggttacccggtacggggtaaccccgtaaacgtttcccgtttacccaaccgtttcccggaacttacccgaacgttcccaacgtaccgtaacgtacccgttaagtaccggtacccgttaggtaaacgtttcggtttaacttaccgtttaacgtttaacgtttacgttcgtaaacgtccgtacgtacggtaccttaaccgtacgttaaccgtccgttacccgtccctttaccggttcggtttaacccggggacggtaacccgggaacggttcggggtaataccgggttagtaccggtaaccgtcggtaaccggttcggtacgtccgggttaaaccncggtaacccttcgttcgtttaccgttacccg

SEQ ID NO: 248423 - DNA, 761 bp, Homo sapiens
  misc_feature: GYAE6OF01B500L.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctgtgtctccgaggggaaancgccacctctcctgcagggccagtcagagtatagcatacaacttagcctggtaccagcgagacggtccgtgggccacggtcctacccgaggtccctccgtacattcctagtcggtacttcggaccccgtaccgacccggacggggtcccctacggtttccggttacccacggtccgtaaggttcgaggtcggacgtcggtcggtcgtacggtggggaacctaggttaccgtacctacctaccgtaccctaaccgtactaccgaaaccgttccgacccgttacggaccgttaacggttacgttaacggttaacggtttacttttaccgggtacttttaacgtttacgtttacggttccggtaccgaaggttacgttaagtaccgttaaccgtacgttaacccggtccggtacccgttacctacccgttacccggttaccgggaacccgtaacggaccaccgggttaacggaggtaaaccggttaaaccctaacgggtaaccgttgggtacccggtacgtacccggttacaacccgttagttcccggtttaaccgttcttaacccg

SEQ ID NO: 248424 - DNA, 787 bp, Homo sapiens
  misc_feature: GYAE6OF01AIH4E.47.64.F09.1.454.CMB.1.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
tcagagctcacgtacacgaccggtgctcgatttagcgcgtatacaagggggaggaactgctcagttaggacccagacggaccatggagcccagcgcagcttctcttcctctgctactctggctcccagataccactggagaaatgagatgacgcagtcctcagccaccctgtctgtgtcctcgaggggaancgccaccctcnctgcgagggcctagcaggagttatagcagtccaaacgttcgccttacggtaccacgtacacggtaaaccgtggacgacggccctaccgagtcctaccgtactaactccgttagtcggtagcctacgttacccgaccgtacgggtcccgtacgttacggtaccctaccgacggtccttacgggttccgacggtcgggtacgtacggtcggggtcgtagggtaccgtaagtaccggtttacaacttcccgtaccaaccgtacgttaccgacggtaccacggtcccttaacgggaccttacggtaccgttaagtaacgttcgttttaacgttacgtttaaactttcgtttactaagggttccgtaagtaccgtttaaagtaacgttaaaccgtaccggtttacccggccgtttccggtaccgttaacccggttaccgaaacgggtaccgttaacggtcccggttaaaaccggggtaacttaaaccggttaaaccggtttaaccgggttacggttaccgggtaaaccgttaccgtaacccggtaaaccgtttcttaccggtttacctttaccggtactttacccccggg

SEQ ID NO: 248425 - DNA, 638 bp, Homo sapiens
  misc_feature: GYAE6OF01B0067.47.64.F09.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccagtcggagaagttgtgttgacacagtctccagccacctgtctttgctcgagggaaancgcccaccctctccgtgcgaggccagtcaagatatcactcctattagcctggaccanagaactggtcaggctccgagcctcctcatctatgatcgcactccaacgcgggccacgtggaccactccccgagtacgtaggttcaggtggctaggtcgggtctacggggactacgtaccttcacctctcaacctgtaccacggcacgtcctagacgtctaggtaacgttacgtttacgttaacttttaacgttacgtcgtacgacgtcgacggtacgttagtacgttcgttcgtcccgttccgtcccgttacgtaccggtttccgggacgggtaacggggtacggacggggtagggtaacgtacgtaaccgaaacggtaacgttgggtacggtcgtaccgtaccgtaccgtcgttaccgttcgtttccttaccgttcgttaccccg

SEQ ID NO: 248426 - DNA, 772 bp, Homo sapiens
  misc_feature: GYAE6OF01EC42F.47.64.F09.1.454.CMB.1.raw
  modified_base (167)..(167): a, c, t, g, unknown or other
  misc_feature (167)..(167): n is a, c, g, or t
  modified_base (205)..(205): a, c, t, g, unknown or other
  misc_feature (205)..(205): n is a, c, g, or t
tcagagctcacgtacacgaccggtgctcgatttagcgcgtatacaagggggaggaactgctcagttaggacccagagggaaccatggaacgccccagctcagcttctcttcctctgctactctgcctccagataccatcggagtaagttgtgttagacactagtccncacgtccctacccttgttctttgtctacgaagggaacncgcccacctctcctggacgacgggctagtcaagtaattacttcaccgttcctacgttacgccgttagtaacccaaacgtacgtaacgtcggtacacggtaccctccgaaggtcctccttacagttacctagtgacttcgactacctacgaaccggcgggtacctacggtcgcctaaccgttccaaacgtacgttacggttcgaacggtcggccgtagggttcgggtacgtagggaacctcgtacgtttaaccgtctacctaccgtaacttacgtacgttaagcccgtaaacgtaccgtaacggaccgttaaaccgtcggttaaaccggtttaactttaagggttaaccttttactaacggttcttaacggtacgtcgtacggttacgtggtttacgtccgttaccgtccgttaaccgttcccggttagttacccgggttcgggaaccgggttacgggtaacgggtgggacgtacgtaaacgaaccggttaacggaacgttgggtacccgtagtcccgacgttacccgttaacttcccgttaaccgttcttccgtaccgtttaccccg

SEQ ID NO: 248427 - DNA, 818 bp, Homo sapiens
  misc_feature: GYAE6OF01A3Q7Q.47.64.F09.1.454.CMB.1.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
  modified_base (768)..(768): a, c, t, g, unknown or other
  misc_feature (768)..(768): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttagacacagtcctccagcccaccctgtctttgcctccgaggggaaancgcccacccgtctcctggccgacgggcaagtcgagtaatacttccacctccgttactttaggcccgttaggtaacccaaacgtaaggtaaacccgttggttaccaacgggtcccttaccccggtaaggttcccctacccgttacctaagttccttaaggttntaaccgttcgacctacctaccccgaccggacgggtccctaaccggtcggttacctacccccgaggtcccggtaacgggtttcaacggggttcggtacggtacggggttggtaccggtcggggaacctaacgggtctttaccgaccttcccgtaccgaaaccgtcctaacggcgtaccccgaccgtccgtcgtaccgtacggttccggttagtaaacgttttcgtttaacgaacgttttacttttaacggttacctagttaccgatacgttaaaggttattacctaccggttcgtacctccggttcgtacccgggtaacgtacgggccgaacggtaccgacggttaaataacccggttaaaacgtccgttaagggtccggacctttacggacccgtttaacccgtnttcccgttaattacccgttacccgtaccctttccccgttaccccgtaacg

SEQ ID NO: 248428 - DNA, 763 bp, Homo sapiens
  misc_feature: GYAE6OF01EDWVQ.47.64.F09.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
tcagagctcacgtacacgaccggtgctcgatttagcgcgtatacaagggggaggaactgctcagttaggacccagagggaaccatggaagccccagctcagcttctcttcctcctgctactctgctccagactaccatcggagtaagttgtgttgacatagtctccagccacctgttctttgctcgaggggaacncgcccaccctctcctgccgacgggccagtcaagtaatnttcacttcctacttgcctaggtaaccaacaacgtaacctggtcaacggtcctccccgaggtccttccctctaattccttagtcggtaattcgacctaacgttacccgaaacggaccggggtacctacgttacggccctaacgttaccccgaggtaacgtacggtttcgaggtcggcgtaaggttggggacgttacggggactaacggtcttaccacgttcctacaccatccgagcgtacgtacccgtaagacctcgtacgtaaacgtttacgttttacgtaacttttacgttacgtagtttacaagtccgtagttaccggttcggttacgggttcccgtacgggccccgttacggtaccttacccgggtttaaccgggtttccggggaacggggtaaccgggtcccgggtaaaggggtaggtaaccgtaaccgtaaaaccgggtaaaccgtacgtttggggaacgtcggtaccgtaacccgtaaccgttcgttaccggttacctttccttaacccgttccttacccccgg

SEQ ID NO: 248429 - DNA, 691 bp, Homo sapiens
  misc_feature: GYAE6OF01BIFRD.47.64.F09.1.454.CMB.1.raw
  modified_base (194)..(194): a, c, t, g, unknown or other
  misc_feature (194)..(194): n is a, c, g, or t
  modified_base (276)..(276): a, c, t, g, unknown or other
  misc_feature (276)..(276): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagccacctgtctttgctcgaggggaancgccaccctctctgcaggccagtcagatatcactcctactagcctggaccacagaaacctggtcaggcctccgagtcctccntatctatgactgacactaccaacgcggccacgtcggctacgtcccagacgtacggttcgaacggtcggacgtaggtcggtcgtacggggacaggttacctccacgttccctacgaacttcgaccgaacgtcgtaacgtaccgtaggtaccgtacgttaacgtaacggtttacgttttaacggttacttttaacgttaacgtcgtaccggtacgtaacgtcggttcgtacggttacggtttccgtacccggtcccgtaccggttcctaccggttccgggtttacccgggacggggttaacgggacccggtagggggtaccgaacgggttaacctaacgggtaaaccgtcggtagggtacggtccgtcggtaaccaccgtacgttcgtaccggtttacctcccgtacgttacccccg

SEQ ID NO: 248430 - DNA, 728 bp, Homo sapiens
  misc_feature: GYAE6OF01A3TLX.47.64.F09.1.454.CMB.1.raw
  modified_base (117)..(117): a, c, t, g, unknown or other
  misc_feature (117)..(117): n is a, c, g, or t
  modified_base (205)..(205): a, c, t, g, unknown or other
  misc_feature (205)..(205): n is a, c, g, or t
  modified_base (351)..(351): a, c, t, g, unknown or other
  misc_feature (351)..(351): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (647)..(647): a, c, t, g, unknown or other
  misc_feature (647)..(647): n is a, c, g, or t
tcagagctcacgtacacgaccggtgctcgatttagcgcgtatacaagggggaggaactgctcagttaggacccagagggaaccatggaacgccccagctcagcttctcttccgtccngctactctggctccagactaccatcggagaagttgtagttgaactactagtctccagcctacctgtcctttagctaccgaaggggaancgacccacccttctcctggaccacgggtccaagtacaaggtaaacttctttccaacgttcctaacgtttacgaccgttacggaacctaaaccgaagtaaaacccgttggtaacgacggtcctacccgaggtcctcctactaccttntaagtggtactacggtaccaacgttaacccgtaaaccgacgggacctaacggtacggacctaccgtaccctaggaaccgtagttacgagtacgacgtacggtcggtactagggactacggtacttcacgttctacgaaccacgtnaacncgaacgttaccgaggtacctacgttaagtaacgttacgtttgttaacgtttattacggattacgagctaagggttctacgttacggtcgtaccgtcctaacggtccttacggtaccgtttcgggacgggtaacggcgtacggggtanaacgtaccaaacggtaaccggttatacgggtaccgcttaacggactacgttactcgttacgtcttaccgtacgttaccccg

SEQ ID NO: 248431 - DNA, 807 bp, Homo sapiens
  misc_feature: GYAE6OF01AHACN.47.64.F09.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccgaggggaaangccaccctctcctgcagggccagtcagaatattcactcctacttacgcctaggtaccaaacagaaaccgtggtcacgggcctcccgaggcctcctnattctatgatcgctactcccaacgtcgggcccacgtcggacctacgtaccccgagaccgtagggttccgaggttcggacgtagggttcggggtccgtagggggactaacggtacctttaccgaacctttccgtaacccgtaaccctacgttccgaaacggtcccgtaacggtacccgttaacggtaaccggtaccgttacggtaaacggtttacccgttttaacgggtttaacctttttaacgttttaaccggttacggtttaccgaacggtacccgtacgggttaccggttacggttacggtttaccggttccggggtaccccctttacccgggtcctttacccggttaccgggtttccggggaccggggttaaccggggaccgggtaggggttacgggaacggttaacgtaacccggtaaaaccggttacggttacgggttacgggccgttaccggacccgtacgtaccgtttaccgttaccgtttccttacccgttaccgtttacccccg

SEQ ID NO: 248432 - DNA, 754 bp, Homo sapiens
  misc_feature: GYAE6OF01DU36G.47.64.F09.1.454.CMB.1.raw
  modified_base (194)..(194): a, c, t, g, unknown or other
  misc_feature (194)..(194): n is a, c, g, or t
  modified_base (437)..(437): a, c, t, g, unknown or other
  misc_feature (437)..(437): n is a, c, g, or t
  modified_base (478)..(478): a, c, t, g, unknown or other
  misc_feature (478)..(478): n is a, c, g, or t
tcagagctcacgtacacgaccggtgctcgatttagcgcgtatacaagggggaggaactgctcagttaggacccagagggaaccatggaagccccagctcagcttctcttcctctgctactctggctcccagataccatcggagaagttgtgttgacacagtctccagccaccctgtcttgtctcgaaggggaanagcccacccttctcctgcgacgggccagtcaagaattattcactacctacttacgccgtaggtaacccaacagaaaccgtggtacgacggcctacccgaggtcctccgtcacgttcgtgggactgctactaccgaacgacgggccgtgtcggcaccgtccacgaccgtacggttacgaggtcgacggtaggttcggtcgtacgggactacgtaccttctaccgtacctacgtaacctgtaccnggaccacgtaccgtaggaccgtaccgttaaggtaacgtttntttacgtacgtttaacgttttaactttaccggtcgtaacctaaggtaaacccttaaaagttaaacccgttccgttaaccggtccccgttaccgttaccttacccggttacccgggtttcggggaaccggggtaacgggtaacccggaggggtacccggaacgtacgttaaaccggaaaccggtaaggttcggtcgggtacccgtacggaccctaaccgggttactttcccggttacgttccccttaacttccgtttcccccgtttcccgtaacccg

SEQ ID NO: 248433 - DNA, 795 bp, Homo sapiens
  misc_feature: GYAE6OF01ELMS7.47.64.F09.1.454.CMB.1.raw
tcagagctcacgtacacgaccggtgctcgatttagcgcgtatacaaggggggaggaactgctcagttaggacccaggagggaaccatggaagccccagctcagcttctcttcctcctgctactctggcctccagataccatcggagtaagttgtgttgacactagtctccagcccaccttgttcttcgtctaccggaaggggaagcgccctaccctctcgtcgcggacgggccagtcgaggtggttgtggctacgtccttacgtacgccgtacggtaccaaacgacggtaaacctcggacccacggcccgtcccgaggtcccttccactacttactaagtcgtacgtaccggactaaccgtacccgaaccggtaccggggaccctacggtaccggacctaacccgtacccgacgggtacgtacgggttccggaaggtcggacgtacggggtcgtacgggttacggacggggtaaccgtaccgttacctttaccggtacccttccgtaccccaacgttacgaccgacgtacccgaccgtaccggtacgtacgtacccgttaagtaacgtttcgttaccgtaactttacttttacacgttatcgacgtagtacgtacgtaccgtcgttacgtccgttaccttaccgttccgttaccggggttcggacggggttaacccgggaggggtaacgggtacgtaacgggttaacgtaccggtaaacgggtacccggtacggttcgggtaccggtacgttacgggtaccccaaggtttcccttaccgttcccggttttaaccc

SEQ ID NO: 248434 - DNA, 934 bp, Homo sapiens
  misc_feature: GYAE6OF01CX1F5.47.64.F09.1.454.CMB.1.raw
  modified_base (138)..(138): a, c, t, g, unknown or other
  misc_feature (138)..(138): n is a, c, g, or t
  modified_base (261)..(261): a, c, t, g, unknown or other
  misc_feature (261)..(261): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccntacggataagttcgtgttgacacagtcctccagccctaccgttgttcttttgcttaccggaaggggaaactcgaccctaccctcgtccgtcgccgacgggaccatccgaagaacttattaccncttaccgtaccgtttacgtaccttacggaacctaaaccgtacggaaaaccgtttacggtaccgaacggtccccgttacccgtacggtaaccttcccgttaccgttactttaccgttaacttagggtacttacggttacccaaccgtttaaccccgaaaacggtaccggggtaacccttaacccggcggggtacctaacccgttaccccgtaaagttaaaccggtacggttacggtaacgggttcgggtccgtaacggggttaccggggttcgggtaaccggggttacgtaacggtttaccctttaccctaccggttacctccccgtaaacgtaccggtttaccaaccgggtaaccgtaacggtccccgtaaggtaccgttaccccggttaaacggttaacggtttaccgttttaacgtttaacgttttaaactttaccggttaacgtaccgtaaccggtaaccgtacggtacggtttacggtttaccgttttccgtcccggttccccggtttccggtaacccggttttcggttaacccgggtttcggggtaaccgggtaaccggggtaggtaacggggtacgtaacggtacgtaccgggtaaacgtcggttagggtacggtccgttaacgacccgtacgtacttacgttcgttaccttcgttcccgttacccg

SEQ ID NO: 248435 - DNA, 750 bp, Homo sapiens
  misc_feature: GYAE6OF01A9Y5L.47.64.F09.1.454.CMB.1.raw
  modified_base (210)..(210): a, c, t, g, unknown or other
  misc_feature (210)..(210): n is a, c, g, or t
  modified_base (343)..(343): a, c, t, g, unknown or other
  misc_feature (343)..(343): n is a, c, g, or t
  modified_base (574)..(574): a, c, t, g, unknown or other
  misc_feature (574)..(574): n is a, c, g, or t
tcagagctcacgtacacgaccggtgctcgatttagcgcgtatacaagggggaggaactgctcagttaggacccagagggaaccatggaagccccagcctcagcttctcttcctcctgctactctggcctcccagataccagtcggagtaagttgtgttgacacagtctccagccctacccttgttctttgtccgtaccggaaggggaaancgcccaccctctcctgacgacgggccagtcaagtaattacttacctaccttacctacgttacgccgttacggtaacccaaacaacgtaaaccgtggtacacggtcctacccgaggtcctcctctaatctagtnagtcgacaccgtacccgaacggcggaccctacggtcgacctaccgtaccccgaaggtaccttaggtaccgtagggtacggcgtaaggggtcggggttacgtacggggaactaacggtacccttaacgtaccttcccgtaaccaccctacgtacccgaagtcccggaacgttccgaacggtaccaaccggtaggttaacgtttacgtttacgttaactttacgttaaccgtntaccgtagcgttacggtcgtcgttcgggttcctacggtcccgttacgtcccgttacgttacggttaccgggacggtacgggtacggtaggaggtaacctaggaaaccgttaggtacgtggtaccggtcaccgtaaccttcgtacttcgttacgttccttaacccgtcgttcccccg

SEQ ID NO: 248436 - DNA, 646 bp, Homo sapiens
  misc_feature: GYAE6OF01BJ50Q.47.64.F09.1.454.CMB.1.raw
  modified_base (374)..(374): a, c, t, g, unknown or other
  misc_feature (374)..(374): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagccacccttgttctttgtcctccgaggggaaacgcgcccaccctctcctgcgacgggccagtcagtacgtgttggcagtcttacttagccttacggtaaccaacgacgaaaccctggaccgaggcctcccgaggcctcctcatctatgatcgcactccaacgacgggaccacgtgaccactcccgagcctaggttcaggtcggacnggtcgacggtcgtaggggactagtacttccgacctcctacaccgtataccacgacacggaccctaaggaccgtctaaggaacgtttacttttcgaccttacgttttattaccttggttaccacggtacgagaccgtaagaccgtaacgtcgtccttccttaccgtccggtttacgggacgggtaccgggtacggtaaggggttcggaaggtacgtacgaagggtacggtacgtgggtaccgtcgtcggacccaacgtcttccgtcgttaccc

SEQ ID NO: 248437 - DNA, 833 bp, Homo sapiens
  misc_feature: GYAE6OF01BC12L.47.64.F09.1.454.CMB.1.raw
tcagagctcacgtacacgaccggtgctcgatttagcgcgtatacaagggggagaactgctcagttaggaccagagggaccatggaagccccagctcagcttctcttcctcctgctactctggctccagaataccatcggagaagtttggtgtgacacagtctccacgcctacccttgttcgtttcgtaccgtaccgaaggggaaacacgccctaccctccgtcctagcgacgggacagtacgaagttaacttacttccgtaccttccttacgttacgtaccgtacgggtaacccaaaacgtaaccgtaaaccgtcggtaccgtaaccggtccgtacccggtaacggtcccttcctacgttaacctacttaagttgaacgtccgacctaacgtacccgaaacgggaccggacccgtaggtccggactaccgtacccgaagtaaccgtacgggttacgcggttacggtccgtagggtcgggtaccgtagggaactacggtacccttttacacgttccacctacgtacacccgaaggtccgtaccgaaccgtacgggtacctaccgtaacgttaacgtttaacggttaaccgtttaatttcgtacgttcgtaacgtgtaaccgtcgttacgtcggttaccggttccgtaccggcccgttaccgttccgttacccggtacggttccggggtaacggaccggggtcggttaacggggacggttaaacgtaaccgggtaaaccgttaacggacgtttcggggtaccggtacggtacccgtaaaccggttcgttaacggttcggtttaaccctttacgggttcccttacccgttacccgg

SEQ ID NO: 248438 - DNA, 920 bp, Homo sapiens
  misc_feature: GYAE6OF01D5H0T.47.64.F09.1.454.CMB.1.raw
  modified_base (133)..(133): a, c, t, g, unknown or other
  misc_feature (133)..(133): n is a, c, g, or t
  modified_base (144)..(144): a, c, t, g, unknown or other
  misc_feature (144)..(144): n is a, c, g, or t
  modified_base (158)..(158): a, c, t, g, unknown or other
  misc_feature (158)..(158): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggctccaganaccactagganaaatgtgatggacnctagtcctaccagcctaccctgtctgtcctcgtaccgaagggggaatacgacccaacctactccgttacccgtagggttaccgggaccggtacaagggtaacttaattacggcctattaccgtaactttcggtaccgtacgggtaacccaggaccgaaggtacgtacccggtaggggactaccggggtccctaccgacggtccctcctaccgtactttaccgttaagtggaacgtccgtaccgttaccccgaaaccggtcggggtacccttaccgggttttacccggttaaccccgacggtttacccgttagggttaccgagggtaccggtagtaccggttcgggtccggttaccgggtagggtaacaacgggttccgttccacgtttaaccctcgaaacccgtactacccgtaaagccggtacccgtaggtaaccgtacgttaacggttacggttaacgtttacggtttaacgttacgtttaacgtttttaacgttaaccgttggtaactaagggtttacctaagttaacccttaaggttaaacccgttaccgttaaccggtaccccgggtttaccgttaacccgttaacccggggttaacccggaaccccggttaaacggggtaaccgtaaaccggttaaccgggtaaacgggtttaaaacgtttaaaacccgggttaaacttaacgggtttccgggtacggtaccgtacccgtaaaccctccggtttaactacccggtttgtttaccccgtttaaaccg

SEQ ID NO: 248439 - DNA, 725 bp, Homo sapiens
  misc_feature: GYAE6OF01CQ5D4.47.64.F09.1.454.CMB.1.raw
  modified_base (373)..(373): a, c, t, g, unknown or other
  misc_feature (373)..(373): n is a, c, g, or t
  modified_base (495)..(495): a, c, t, g, unknown or other
  misc_feature (495)..(495): n is a, c, g, or t
tcagagctcacgtacacgaccggtgctcgatttagcgcgtatacaagggggaggaactgctcagttaggaccagagggaaccagtggaacgcccagctcgagcttctcttcctacctgctactctggactccagactaccgatcggaagtaagtttggtgttacgacacgtacgtcctccacgtccctaccgttgttactttcgaccgtaccggaaaggggaaactccgcccacccttcgtccgcgggaccgaacgggcctaaggtccaaaggtaacttcttaccaccttccttaacgtacgtaccgtacggaaaccaacgaacgtaacgtgggtaccacggtcctacgcgtcctcctacacttcgaatcggntccgacacgtaccgaacgcggtacccacggtcgctaaccgtcccgagtccctaagggtcacgggtgactaggcgtcggtacgtgggaactacggtaaccttcaacttcccactaaaccggtnaccgacgtccgaacgacgtacgtaccgtcgttaaagttaacgtttacgttactactttagttacttcggtactacgaccgtagtacgtacgtaccgtacgttcgtccgtacccgttaagtccggttaccgggttacggggaccggtacgggacgggtacggtaggacgtaacgcgtaacggtacggtaggtcgacggtcgacctacgttacgtccttcgcgtttctaccg

SEQ ID NO: 248440 - DNA, 849 bp, Homo sapiens
  misc_feature: GYAE6OF01DAK8E.47.64.F09.1.454.CMB.1.raw
tcagagctcacgtacacgaccggtgctcgatttagcgcgtatacaaggggggaggaactgctcagttaggacccagagggaaccatggaagccccagctcagcttctcttcctcctgctactctggctcccagataccatcggagtaagttgtgttgacactagtcctccacgcccacctgttctttgtctccgaaggggaagacgccctaccctctccgtgcgacgggccagtcaagtaactacttactacctccttacgttacgcctaggtaaccaacaacgtaaacctggtcacggcctccgacgtccttacctcgattctatacgatcgtaccactaccgaacgtacgggccctacggtcggacaccgtacccgaagtaccgtacggttagacggtggtacgtacgggttcgggttacggtacggggaactacggtttaccttaccgtaccttacccgactaccgtaacgtcgtacgacccgtacgtaacccgtacggtaccggtaccgttaacggttaacgtttaacggttttacgtttacgttttaaacgtccgttacggtacgtaaccgtccgtacggtttcggttacggttaccgttcccggttacggtccccttcccgtacgtttccccgggtttacgggttacccggggaacccggggttaggggtaaccggggttcggggtaaacggtacccgggtaaaccgtttaaacccggaaacccgggtttaacgggttaccgggtttacgggtcctttaaacccggggtcctaaaccccggtttacggttttactttacccccgggttttacttacccccgtttaccccggtttccccccggg

SEQ ID NO: 248441 - DNA, 951 bp, Homo sapiens
  misc_feature: GYAE6OF01BG85T.47.64.F09.1.454.CMB.1.raw
tcagagctcacgtacacgaccggtgctcgatttagcgcgtatacaagggggctttctgagagtcatggatctcatgtgcaaagaaaatgaagcacctgtggttcttcctcctgctggtggcgctccagatgggtcctgtcccagctgcaacgtgcgaggacgtccgggcccaggacgtgggtgaacgtccgttacggacgaccctcgtccctctacttgctagttcgtcgtcgtggtcgcctaccgtactaccgtacttaagtttttaattaggttggggtgggtccgtaggtaccgttccccggacccgaacccggacccccggaaggggaacggggtccgttagggaacgtagggtaggttacggggtaagtttaagtttaagtttttaagtaaacggtaggggtaaccttaaccgtttacccgtttaacccgtaaaccccgtaccgttacccccgttaacgtaaacggtaaccgtttaccggttaacgtttacccgtaacgttaacgtcccggtacgaaacgtacccgtaaccggtaccggaaacgttactacccgtaacctttccctacccgtttaacgaaccgttacgtacttcccgtttcgttacggtaccccgggtacccccgaccgtaccggaacggtaacccgtccgggtttacttttaacgtttttacgttaaccgtttccggttaccgtaacgcgttaacgtcccggaacccgggtaaccgaggttaacgtacccgttaacggttttaacggcccggttaaacggtttaacgggttttaaccggttttaggtttaaccgggtttacggggtttaccgggaaacccggggttaaacggggtaacccgggttaacccggtttaccccggtaacccggtttcccggtaaccccggttacccggccccgttaaaccccccggtacccgtaaaaccccccggggg

SEQ ID NO: 248442 - DNA, 901 bp, Homo sapiens
  misc_feature: GYAE6OF01E4U1P.47.64.F09.1.454.CMB.1.raw
  modified_base (218)..(218): a, c, t, g, unknown or other
  misc_feature (218)..(218): n is a, c, g, or t
  modified_base (269)..(269): a, c, t, g, unknown or other
  misc_feature (269)..(269): n is a, c, g, or t
  modified_base (395)..(395): a, c, t, g, unknown or other
  misc_feature (395)..(395): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccgatcggagtaagttgtgttacgacactagtcctccacgccctacccttgttctttcggtccttacccggaagggggaaanaccgcccctaccccttccttccgcggccgaccggggtcctacggtaccaanaacgtttacttaccaccttacccttacctttacggcccgttacgggtaaccctaaacgaacggtaaacccgtcggaccgtaaccggtccctcccggacggtccctcccgttcctacttactacgtntaacgtcgtacctaccgtacccgaacggtaccggggaccctacgtaccgggacctaaccgtaccccgtaacggtaaccggttacgggttaccgtacggggtacgggtacggtacggggtttcggggtacgttacggggaacctagttacccgttcctacctttaccgtaccaacccgttacgtaccgtaacggacccgtaaccgttccggtaaacggtcgtaaccgtacgggttaaacgtttacggttttaaccgtttatttacgtttaaccggtcgtaacgtacgacggtacggttcgtaggtttacccggtaccgttccggtccccgttcccggtactacccgggtttaccgggtttccggggacgggggtaccggtaccgggtaaggggttaccggtaccgtaaaccggtaaaccggtaaccgggttctaggggttcgggtacccctgaacccttacccggttactttccggttacctttcggtaccccttccgttaccccgg

SEQ ID NO: 248443 - DNA, 845 bp, Homo sapiens
  misc_feature: GYAE6OF01E1CLJ.47.64.F09.1.454.CMB.1.raw
  modified_base (199)..(199): a, c, t, g, unknown or other
  misc_feature (199)..(199): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtcctcacgccaccctgtctttgtctccgaaggggaaancgccctaccctctccgtgcgacgggccagtacagaatattcacttcctacgttacgcctacggtaaccaaacgaagtaaaccgtgtacaacggccttacccgaggtcctcctactaactacttagtacgaacgttcgacctaactaccccgaaaacggaccggggaccctaccggttacggacctaccgttacccgacgtaaccggtacggtttacgagggtcggtcggtacggtcggggtacgtacggggactacgtaccgttaccaccttctaaccacctagtccaggacctcgaccgttaagccgtaccgtaggtaacgttacgttttaggtaactttttacgtaacgttggtaaccgtaggtcccgtaggtaccggtttacgttacggtttcccggttaccgggtaccccgtttaccggttccgttaaccggtttacccggggtttaccggggggtaacccggggtaaccggtaccgggggtaaacgggggtaccggtaaacggtaaacccgtaaaacgggtaaacccgggtaaacggttggggtaccccggggtaacttaccggtaaccccgtaaaccgtttacggttttaccccgttaccgtttaacccgttttacccgtccccgttttaaccccccggg

SEQ ID NO: 248444 - DNA, 851 bp, Homo sapiens
  misc_feature: GYAE6OF01DWJUE.47.64.F09.1.454.CMB.1.raw
  modified_base (215)..(215): a, c, t, g, unknown or other
  misc_feature (215)..(215): n is a, c, g, or t
  modified_base (649)..(649): a, c, t, g, unknown or other
  misc_feature (649)..(649): n is a, c, g, or t
tcagagctcacgtacacgaccggtgctcgatttagcgcgtatacaagggggaggaactgctcagttaggacccagagggaaccatggaacgccccagctcagcttctcttcctcctgctactctggcctccagataccagtcgggagtaagttgtgttcgactacaggtcctccacgccctacccttgttcttcgtcctccggaagggggaaacncgacccctaccctctccgtcggcgacgggccctaggtccaagtaacttacttcctaaccgtccttaacttaccggaccgttacggaaacctaaactaacggtaaaccgttcgggtaccgaaccgggtaccccttacccggaggtccccttacctacgtaacgttacctaaggtagtacttaccgaacctaaccgtacccgtaaaacgggccgggtacccgtaacgtcggacctaccgtaaccccgaagtaaccggttacggttactacggggtcgacggttgggtacggtaccgttaacgggacttaacgtaccgttactaccgcctaacctagtaccgacgaccgtacgcgtaccgtaacggcgtaaccgttagtaaccgttcgtttacggtaactttacgtcgtcgtaaggacgtacggtcgttacggtttnacccggttcgttacccggtaccgtccggttaacccgttccgggtttaccgggtccgggtaacgggaaccggggttaggaacgggtaccggttaaacacgggttaaacccgtaaaccgggtcgttacggggtcgtacccggaccgtacccgttacgtaccgttttaccggtactttaaccccggtcttaaacccggttccccg

SEQ ID NO: 248445 - DNA, 784 bp, Homo sapiens
  misc_feature: GYAE6OF01CWS0I.47.64.F09.1.454.CMB.1.raw
  modified_base (199)..(199): a, c, t, g, unknown or other
  misc_feature (199)..(199): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccacgccaccctgttctttgtctccgaaggggaancgccctacctctcctgcacgggccagtcaagaatattccacttcctacttacgcctaggtaccacgagaaacctggtaccaggtcctcccgaggtcctacctcaacgttctagtcgatacgacctactacccgaacgacgggtaccctacggtcggacctaccgtaccccgaagtaaccgtacggtttaccgagggtcggtctagggttcggggtcgttaggggacctaacggttaccttaccgtaccttacctacccgaactacgtacccgagtaacccgacggtaacccgtaacggtccgtaaccgtttaagggtaaaccgtttacgttttacgggttaaaccttttaacgtccgtttacggtacgtacgggtacctacgggtccggtttagtccggtttacgtccgggtaccccttccgggtcctttaccggttaccgggttaccggggacgggttaacggggtccgtaaggggtaacggtaccgtaaagtacccggtaaacggtaaccggtggttaacgggccttaaccgggacctaaccgttacgttacccgttgtttacccttcgtcccgtttaccccg

SEQ ID NO: 248446 - DNA, 900 bp, Homo sapiens
  misc_feature: GYAE6OF01EVP89.47.64.F09.1.454.CMB.1.raw
  modified_base (92)..(92): a, c, t, g, unknown or other
  misc_feature (92)..(92): n is a, c, g, or t
  modified_base (224)..(224): a, c, t, g, unknown or other
  misc_feature (224)..(224): n is a, c, g, or t
tcagagctcacgtacacgaccggtgctcgatttagcgcgtatacaagggggaggaactgctcaggttaggacccagagggaaccatgggaanccccaggctcagcttctcttcctcctgctactctggctcccagataccagtcggagtaagttgtgttgaccacagtctccagccacccgttgtactttgtctaccgaaggggaaatcgcccaccctcttccnggaccgaggccaggtcacgagttgtcggcacgtcctacttaggcctaggtaaccaactacgaaacggtcggaccgtacggcctaccgaggtcctccgtataacgttcgttaggtgaccgtcgactacgtacccgaacggtccggtacctacgtcggtaccaaccgtaccccggacgtaccccgttagggttacccgtaacgggttcgggacccgttaagggtacccgtacggttacccggtacggggtaaccctaaccgggttaacccttacccggtaaaccgtttcccaacccgttaaccgtaaccgtaccgggtaacggtaacctaacccggggttacccttaagggggtaaacccttccggttaaaaacgtaaccggttttaacggtttcccgtaagtttttaaacccctttagtttaacggaccgttaacgtccgtaacggtaaccgggtttaaccggactaccgggttaaccgttcggtaccccgttttacctacccggggttttaccgttaacccgggggtacggggtaacccgggttaacgggtacggggttttaaacccgggataaccccggggttaacggtaacccgggttaaacgtaccggtttaccggggtaacctccggtaaaggtcccctttaaaacgtccggtttacctaacccgggtttac

SEQ ID NO: 248447 - DNA, 815 bp, Homo sapiens
  misc_feature: GYAE6OF01BC47H.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggcctccagataccatcggagtaagttgtgttgacacagtctccacgccctacctgttctttgtcctccgaaggggaaacacgcccacccctcgtcctgccgaacgggcctagtacaagtaaacttacttccaaccttcccttaacgttacgacccgttaggtaacccaaaacgaacgtaaaccgtggtaccacggtccctacccgacggtcctccctatacttcgtaatgatcgactaactacccaaaccggaccgggaccctacgtacggacccaacgtaccccgaagtaaccggtacggttaccgagggttccggaggtacggttcggggtacgtacggggtaacctacggtacctttaccaccttaccctaaccgtacctaatacccgaaccggaccgaacccggttcgtaacgggtaaccgttaccgttaacggttaaacgtttaacggttttaaccgtttaacgttttaacgtttaaccgtcgtttaaccggaacgtacgttacggttcggttagtaccggtttccggtaccgttccccgtaaccgttccgttacccggttaccggttcggggaaccgggtcggggtacgtacgggggtacgtaacgtaacgtaaccgtaaacgtaccggtgggttaccgcgtacgaccgacttacgttcgttacttccgttactcccgttacccg

SEQ ID NO: 248448 - DNA, 915 bp, Homo sapiens
  misc_feature: GYAE6OF01E4OU7.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctccagataccaccggagaaattgtgttgacacagtctccagccaccctgtctttgtctccgagggaancgccaccctctcctgcgagggccagtacagagttagttaacaactacgttacgccgttacggtaccaaacgaggacgtaccgtcggacccgacggtaccctccccggaacgggcccttacccgtacctaacgttaccgttactacggtaagttacggttaaccttaaccccgaaaccgggtaaccgggaccctaaccgggtaccggaccccgaacccccgaggtaacctagggttaccaagggttcgggtacgtacggggttcgggttaccgttaaggggaacctaacggtaccctttaccctaaccgtttacccgtacccaacccgtaagtcccgaccgtaccgtacggtaccctaacggacgtaccccgtaaggtaaaccggtttaccgttttaaggttaacctttttaacggtttaaccgtttacggaaccgtaacggtaccgtaggtccggtttacggttaccggtttaccggtcggttacccccgtttccggtaccggtttacccgttaccggggtttaccggggaccgggggtaaaccggggtaccggggttaacgggggacgggttaacggaaaccgttaaaccggtaaaaccgggttacgggttaccgggtcggggtaccttaggaacccccgtacgtttaccgtacccgttttaccgtttcccgtttaaccgtaccccgttttccccggttaacccccgtccgttaaccgg

SEQ ID NO: 248449 - DNA, 665 bp, Homo sapiens
  misc_feature: GYAE6OF01ADOBH.47.64.F09.1.454.CMB.1.raw
  modified_base (198)..(198): a, c, t, g, unknown or other
  misc_feature (198)..(198): n is a, c, g, or t
  modified_base (650)..(650): a, c, t, g, unknown or other
  misc_feature (650)..(650): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccacctgtctttcgtctccgaaggggaaagngcccaccctctcctgcgagggccagtacagtaatacttcacctcctacgttcgcctaggtaaccaacacgaaaccgttggtaccgacggccgtacccgacggccttacccgtctattctactagtatcgacctacgtacccgaacgaccgggtaccacgtcggaccactaccccgaagtacgtacggttcaggtcggacgtaggtcgggtcgtacgggactacgtaccttcaactctaccactcgtcgacgcacgtcctaggacgtaccgtaggtaacgtttacgtttacggtaactttagtttacgagttacgacgtacgtaggtcggttagtacgttccgtaccggtcccttacggtccgttaccgttaccgggttcgggacgggtaccggtacgggagggtacgacgtaacgtacggaacgtacgtgacggtctacgactcgtattcgngttcttcgcgttccc

SEQ ID NO: 248450 - DNA, 501 bp, Homo sapiens
  misc_feature: GYAE6OF02G9XFD.47.64.F09.1.454.CMB.1.raw
tcagagctcacgtacacgaccggtgctcgatttagcgcgtatacaagggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcgagggaccagggtggagagtacgaaacggaactgtggctgcaccatctgtcttcattccg

SEQ ID NO: 248451 - DNA, 497 bp, Homo sapiens
  misc_feature: GYAE6OF02F0GMP.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagacttggactttattactgtcagcagcgtgagttctggcctccgctcactttcggcggacggaccgagggtgagatcgaaacgactgtggctgcacatctgtcttcattcc

SEQ ID NO: 248452 - DNA, 567 bp, Homo sapiens
  misc_feature: GYAE6OF02IAKHP.47.64.F09.1.454.CMB.1.raw
tcagagctcacgtacacgaccggtgctcgatttagcgcgtatacaaggggtagggtaacggtttgctcagttaggacccgagagggaaccaagtggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctattagcctggtaccaacagaaacctggtcaggctcccaggctctcatctatgatgcatccaacagggccactggcatcccagacaggttcagtggcaggtgggtctggggacagacttcactctcaccatcagcagcctagagcctgaagtactttggactttaattactgttcagtcagcgtgtagttctggcctccgctcgacttttcgggcggtagggacccgtaggggtagggtagacgttacgaaaacggtaaccgttaggtagggccgttggaccaccgtaacgttccgttaggttcctttacctagtttccccg

SEQ ID NO: 248453 - DNA, 526 bp, Homo sapiens
  misc_feature: GYAE6OF02JPU7Y.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagagtattagcagcaacttgcctggtaccagcagaaacctggccaggctcccaggctcctcatctatgatgcatccaacgagggccactggaccatccccgagccaggttcaggtggcagtgagtcgtgggacagacttcactctcaccatcagcagcctagacgcctagaagtatttgactactttattactgtcagctagcgtagctaacgtcgcctctcgtacgttcggacgggtacgggaccgagggtggagtacgtacgaggaacgtaacgtggtacggctaggacaccgtagtccgtcg

SEQ ID NO: 248454 - DNA, 497 bp, Homo sapiens
  misc_feature: GYAE6OF02H1MPU.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcgagggaccaggggtggagatcgaaacgaactgtggctgcacatctgtctcatcc

SEQ ID NO: 248455 - DNA, 514 bp, Homo sapiens
  misc_feature: GYAE6OF02GPFMF.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggagaaatagtgatgacgcagtctccagccaccctgtctgtctctccaggggaaangccaccctctcctgcagggccagtcagaatattcactcctacttagcctggtaccaacagaaacctggtcaggctcccaggctcctcatctatgatgcatccaacagggccactggcatccccagacaggttcagtggcagtgggtctgggacagacttcactctcaccatcagcagcctagacgcctgaagtactttggtacttttattacttgtcagcagcgtgagttctggcctccgctcacgtttcgggcggtagggaccgagggtggagacgtacaaacggtacgtgtggcgtcgcaccgactcgtcgtcttc

SEQ ID NO: 248456 - DNA, 500 bp, Homo sapiens
  misc_feature: GYAE6OF02IPD10.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagacattgttttgacacagtctccagccaccctgtctttgtctccaggggaanagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagacgcctagaagtatttgctactttattacttgtcagcagcgtagcaactggcctctctacgtttcggcggaggaccgagggtggagatcgagaacgaacgtggtggctgcaccatctgtcttc

SEQ ID NO: 248457 - DNA, 521 bp, Homo sapiens
  misc_feature: GYAE6OF02GO6XF.47.64.F09.1.454.CMB.1.raw
  modified_base (193)..(193): a, c, t, g, unknown or other
  misc_feature (193)..(193): n is a, c, g, or t
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctccagataccatcggagaagttgtgttgacacagtctccagccaccctgtctttgctccaggggaaangccaccctctcctgcagggccagtcagaatatcactcctacttagcctggtaccaacagaaacctggtcaggctccaggctcctcatctatgatgcatccaangggccatggcatccagacnggtcagtgcagtgggctgggacagcttcactctcacatcagcagcctagacgctgaagtacttggactttatactgtcagcagcgtgtagttctcggtcctccgtcgtcgtacgtttcggcggtacgggacgtagggtcgacgacgtacgaacggtacgtaggtcggacgtacggaccacgtacgtccgtagtccttcgacttccg

SEQ ID NO: 248458 - DNA, 998 bp, Homo sapiens
  misc_feature: GYAE6OF02G06YU.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcgggagaagttgtgttgacacagtctccagcccaccctgttctttgtcctccgaaggggaaagcgcccaccctctcctgcgacgggccagtcaagaattacttaccaccttcccttaacgttacgcccgttacgggtaaacccaaacgaacggtaaaacccgttgggttaccgaacggggtcccttacccccggaaggggtcccctttcccccgttaccgtaactttacccttaaagttacgggtaaatttccgggaccctaaacttacccccgaaaaaaccggtaaccggggggaccccctaaaccggttcggggaccctaaccttaccccccgaaaggaacccggttaacggggttttacccaaaggggtttcggggaacccttaagggggtttacggggggttcccggttacgggggggaacctaaacggggtttaacccttttacccggaaacccgtttcccgttaaccccgaaacccctaacgtttacccgaacgggtacccgaacgggtaccccgttaaagggaaccggtaccccgttaagggaaaaccggttttaaccggtttttacggggttaaacccttttttaaacgtttaacccgttacggttaaccgtaacggtaccgtaacgggtccggttagggttaacgtttccggttccgggtccccgttcccggtccttacccgttaaccggttttccgggggaccggggtaaccggggtaacccggtagggggttacgggaacggtacgttaaccggaaaaccggtaacgttacgggttacgggccgttacgggaccctaacccgtacgtttacccgttacggtttacctttaccgtaactttccccccgg

SEQ ID NO: 248459 - DNA, 501 bp, Homo sapiens
  misc_feature: GYAE6OF02GXG1J.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggacgggaccagggtggagatacgaaacggaactgtggctgcacatctgtcttcatcc

SEQ ID NO: 248460 - DNA, 545 bp, Homo sapiens
  misc_feature: GYAE6OF02GSGKF.47.64.F09.1.454.CMB.1.raw
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtgctccatcaccagttttaatattggtggggctggatccgccagcccccagggaagggctggatggattgggagtatattttataatggggacactctttacaacccatccctcaagagtcgagtttccatatccgcagacacgtccgagaatcacttctccctagaactgagctctgtgaccgccgcagaccacggcttgtttattactgttcgagacatgaccgaccgagacgcatttacgcggactaggtacggttttgagttagtttggggacctaaggggacaacgggtcaccggtctccggcacgtcctccgtaacccgg

SEQ ID NO: 248461 - DNA, 518 bp, Homo sapiens
  misc_feature: GYAE6OF02HD716.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccacgtggcatcccagacaggttcagtggcaggtgggtctgggacagacttcactctcaccatcagcagcctagacgcctgaagtactttggactttattactgtcagcagcgtgtagtctggcctccgctcgtacgtttcgggcggagggaccgaggggtgagatacgaaacggtaacgtggtcggctgcacctatccgtgtcttcattccg

SEQ ID NO: 248462 - DNA, 506 bp, Homo sapiens
  misc_feature: GYAE6OF02H5O1K.47.64.F09.1.454.CMB.1.raw
  modified_base (365)..(365): a, c, t, g, unknown or other
  misc_feature (365)..(365): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaagagccaccctctcctgcagggccagtcagaatattcactcctacttagcctggtaccaacagaaacctggtcaggctcccaggctcctcatctatgatgcatccaacagggccactgcactcccagacaggttcagtggcagtgggtctgggacagacttcactctcaccntcagcagctagacgcctgaagactttggactttattatgtacagcagcgtgagttctgcctcgctcacgtttcggcggtacgggaccgagggtgagagtacgaacggactgtggctgccacatcgtcgtcttccattcccg

SEQ ID NO: 248463 - DNA, 536 bp, Homo sapiens
  misc_feature: GYAE6OF02GY64F.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagacttcactctcaccatcagcagcctagacgcctagaacgtactttggactttatactgtcagcagcgtgagttcgcggcctcgctcgtacgtttcgggacgggtacgggaccgtaaggggtcgagtacgtaccgaaacggtaacgtggtacggcgtagccacctgttccgtgtcttcacttcccg

SEQ ID NO: 248464 - DNA, 521 bp, Homo sapiens
  misc_feature: GYAE6OF02FJEIP.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagacttcactctcaccatcagcagcctagagcctgaagactttggactttattactgtcagcagcgtgagttcgtggcctccgctcacgtttcgggcggtagggacccaggggtggagtagtacgaaacggtaacgtggtaggcctgccaccatcctgtccttcacttccg

SEQ ID NO: 248465 - DNA, 513 bp, Homo sapiens
  misc_feature: GYAE6OF02G9FHK.47.64.F09.1.454.CMB.1.raw
  modified_base (303)..(303): a, c, t, g, unknown or other
  misc_feature (303)..(303): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataaccatcggagaagttgtgttgacacagtctccagccaccctgtctttgtctccaggggaaagagccaccctctcctgcagggccagtcagaatattcactcctacttagcctggtaccaacagaaacctggtcaggctccaggctcctcatctatgatgcatccaacncggccactggcatcccagacaggttcagtggcagtgggtctgggacagtacttcactctcacatcagcagcctagacgcctagaacgtactttaggtactttattactgtacagcagtcgtgtagttctcggcctcgctctacgtttcggcggagggaccaggggtgagtactacgaacgactggtcgcgtgacacatctgtctcatccg

SEQ ID NO: 248466 - DNA, 520 bp, Homo sapiens
  misc_feature: GYAE6OF02JBOOA.47.64.F09.1.454.CMB.1.raw
  modified_base (197)..(197): a, c, t, g, unknown or other
  misc_feature (197)..(197): n is a, c, g, or t
  modified_base (513)..(513): a, c, t, g, unknown or other
  misc_feature (513)..(513): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctccaggctcctcatctatgatgcatccaacagggccactggcactcccagaccaggttcagtggcaggtgggtctgggacaggacttcactctcaccatcagcagcctagagcctagaagtacgtttgtactttattactgtcagcagtcgtgagttctggcctcgctctcgtttcggcggagggaccgagggtgagactacgaaacgacgtggtaggctgaccacacttcgtcgtcttacncttcccg

SEQ ID NO: 248467 - DNA, 513 bp, Homo sapiens
  misc_feature: GYAE6OF02GMFBV.47.64.F09.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (420)..(420): a, c, t, g, unknown or other
  misc_feature (420)..(420): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaanagaaacctggtcaggctcccaggctcctcatctatgatgcatccaacagggccactggcatcccagacaggttcagtgcagtgggtctgggacagacttcactctcaccatcagcagcctagacgcctgaagtactttggtactttattactgtcagcagcgtgngttcgtcgtcctccgtctctacgtttcggcggtacggccgagggtgagactacgaacggactggtcggctcgcacgtatctgtcttcattccg

SEQ ID NO: 248468 - DNA, 582 bp, Homo sapiens
  misc_feature: GYAE6OF02GJCWM.47.64.F09.1.454.CMB.1.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctccaggctcctcatctatgatgcatccaanagggccactggcatcccagacaggttcagtggcaggtgggtctggggacagacttcactctcaccatcagcagcctagacgcctgaacgtactttggactttattactgtctagcagtcgtgagttcgtcggtcctccgccttctaccgttttccgggacgggtacggggaccgaagggggttggaggtacgttaacgaaacggtaacgttaggttacgggaccgttacggacctaacccggtattacccgttacggtttacctttccgaactttcccccgg

SEQ ID NO: 248469 - DNA, 536 bp, Homo sapiens
  misc_feature: GYAE6OF02G7F45.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctccaggctcctcatctatgatgcatccaacagggccactggcatcccagccaggttcagtggcagtgagtctgggacagacttcactctcaccatcagcagcctagacgcctgaagtatttgactactttattactcgttacagtcagctatacgacaacgtcggtaccttctctacgtttcgggcggaacgggaccgtagggtacggagacgtacgaacggacgtaacgtcgtaggcgtacgaccaccgtagttccgtgttacc

SEQ ID NO: 248470 - DNA, 503 bp, Homo sapiens
  misc_feature: GYAE6OF02IK59V.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaaacctggtcaggctcccaggctcctcatctatgatgcatccaacagggccactggcatcccagacaggttcagtggcagtgggtctgggacagacttcactctcaccatcagcagcctagagcctgaagattttgctagtttattactgtcagcaaacgtaatactggcctcgctcactttcggcggagggacaggtcgacagtagaacgacgtgtggctgcacatctgtcttcatccttcccg

SEQ ID NO: 248471 - DNA, 582 bp, Homo sapiens
  misc_feature: GYAE6OF02I24ST.47.64.F09.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
  modified_base (385)..(385): a, c, t, g, unknown or other
  misc_feature (385)..(385): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagccaccctntcctgcagggccagtcagaatattcactctacttagcctggtaaccaanagaaacctggtcaggctccaggcctcncatctatgatgacatccaagacgggccatggcacgtcccagacaggttcaggtggcaggtggtcgtgggacagtacgttcacgtctaccgacctatcgaacncacggccctaagacgtcctaggtaactacgtttggactttagttaacctggttacagtacagtcgtgtacgttcgtacggccttccgacttcgtacgtttccgggacggtacggtaccgaggggtggaacgacgtaacgaaacgacgttggacgcgttacgaccgtacgtcttacgtcggttaccttgaccttcccg

SEQ ID NO: 248472 - DNA, 501 bp, Homo sapiens
  misc_feature: GYAE6OF02JEYJ2.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaaggggaggtaacgtgctcagttaggacccagagggaaccatggaagccccagctcagccttctcttcctcctgctactctggctcccagataccatcggagaagttgtgttgacacagtctccagccaccctgtctttgctccaggggaaangccaccctctcctgcagggccagtcagaatagttcactcctacttagcctggtaccaacagaacctggtcaggctcccaggctcctcatctatgatgcatccaacagggccactggcatcccagacaggttcagtcgacagtgggtctgggacagacttcactctcacatcagcagcctagagctagaagactttggactttatactgtacagcacgcgtgagttctgcctccgctctacgtttcggcgaggccagggtgagatacaacgtactgtggctgcactgtccgtgtcttctattccg

SEQ ID NO: 248473 - DNA, 484 bp, Homo sapiens
  misc_feature: GYAE6OF02GO3QZ.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagagtattagcagcaacttagcctggtaccagcagaaacctggccaggctcccaggctcctcatctatgatgcatccaacagggccactggcatcccagccaggttcagtggcagtgagtctgggacagacttcactctcaccatcagcagcctagagcctgaagatttgctactttattactgtcagcagcgtagcaactgcctctcactttcggcggagggaccagggtgagatcagacgaacgtgtggctgcacatctcg

SEQ ID NO: 248474 - DNA, 505 bp, Homo sapiens
  misc_feature: GYAE6OF02ITKT2.47.64.F09.1.454.CMB.1.raw
  modified_base (433)..(433): a, c, t, g, unknown or other
  misc_feature (433)..(433): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcacatcagcagcctagagcctgaagtactttggactttattactgtcagcagcgtgagttctgcctcgctcncgtttcggcggagggaccgagggtggagatacgaaacggaactgtggctcgcaccatcgtgtcttcattccg

SEQ ID NO: 248475 - DNA, 505 bp, Homo sapiens
  misc_feature: GYAE6OF02FX5SY.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagagtgttggcagctacttagcctggtaccaacagaaacctggccaggctccaggctcctcatctatgatgcatccaacagggccacgtggcatcccagccaggttcagtggcagtgagtctgggacagacttcactctcaccatcagcagcctagacgcctagaagtatttgactactttattactgtcagctagcgtagcacgtcgcctctctacgtttcggcggtagggaccgagggtggagtagtcgagacgtaacgtgtggctgccacctatctgttcc

SEQ ID NO: 248476 - DNA, 505 bp, Homo sapiens
  misc_feature: GYAE6OF02IQ4DJ.47.64.F09.1.454.CMB.1.raw
  modified_base (500)..(500): a, c, t, g, unknown or other
  misc_feature (500)..(500): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacgtttcggcggagggaccgaggggtgagatcgaacgacgtggtggctgcaccgatcctgtcttcntcccg

SEQ ID NO: 248477 - DNA, 531 bp, Homo sapiens
  misc_feature: GYAE6OF02I9RX1.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagtactttggactttattactgtcagcagcgtgagttcgtggcctccgctctacgtttcgggccggtagggacccgaggggtcggagtagtacgaaacggtaactggtacggtcgtacgaccaccgattccgtgtccttcattcccg

SEQ ID NO: 248478 - DNA, 566 bp, Homo sapiens
  misc_feature: GYAE6OF02GLBZP.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaagagccaccctctcctgcagggccagtcagaatattcactcctacttagcctggtaccaacagaaacctggtcaggctcccaggcctcctcatctatgatgcatccaacgacgggcccacgtggccactccccagaccaggttcaggtggcaggtgggtctgggacagtacttcactctcaccatcagcagcctagcgctagaagtactttggtactttatactgtcagcagtcgtgtagttcgtcggtcctccgtctcgtaccgtttcgggacgggtacgggaccggtaggggtggacgtacgtaccgaaacggtacgttaggtcggcgtacgacccaccgtattccgttagttccttactacttccccg

SEQ ID NO: 248479 - DNA, 531 bp, Homo sapiens
  misc_feature: GYAE6OF02JCV5G.47.64.F09.1.454.CMB.1.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
  modified_base (378)..(378): a, c, t, g, unknown or other
  misc_feature (378)..(378): n is a, c, g, or t
  modified_base (458)..(458): a, c, t, g, unknown or other
  misc_feature (458)..(458): n is a, c, g, or t
tcagagctcacgtacacgaccggtgctcgatttagcgcgtatacaaggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctccaggctcctcatctatgatgcatccaacngggccactggcatcccagacaggttcagtggcaggtgggtctgggacagacttcactctcacatcagcagcctagancctagaagtcctttgtactttatactgtacagcagcgtgagtttctggcccttcgctctaccgtttcggcggtaggaccnggggtgagacttaacgaacggtaactggtacggcttacgaccgtaccattcgttaggtcctttcgatttcccg

SEQ ID NO: 248480 - DNA, 594 bp, Homo sapiens
  misc_feature: GYAE6OF02IEDX3.47.64.F09.1.454.CMB.1.raw
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcacctagttttatattggtggggctggatccgccagcccccaggaaggggctggaatggattgggagtatattttagtaatggggacacttctttacaacccatccctacaagagtcgagtttccatactccgcagacacgtcgagaatcacttctcctgaaactgagtctctgtcgcgccgcacgacacggcttgttttacttacgtgttcgagactatcggaccgaccgagagctattagtcggactaaggttacggttttagaagtttacggttttagggggaccctaaagggggaacctaacggggttaccgtacccggttaccgttcccggccgtaacggtccccttacccgaaaccccgg

SEQ ID NO: 248481 - DNA, 589 bp, Homo sapiens
  misc_feature: GYAE6OF02J095M.47.64.F09.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctccccaggcctcctcatctatgatgcatccaaacgngggcccactggcactcccagacaggttcaggtggcaggtgggtctgggacagtacttcactctcaccatcagcacgctagacgcctagaacgtactttggtaactttattactgtacagctagcgtagtacgttcgtcggtccctccgtcttccgtaccgtttcgggaccgggtaacgggtaccgtaggggtcggagtacgtaccgtaaaccggtaacgttcggtacggtccgttacggaccgaaccgtacgttccgttacgttccttacctacgtttccccg

SEQ ID NO: 248482 - DNA, 534 bp, Homo sapiens
  misc_feature: GYAE6OF02HAVKI.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagacgcctagaagtactttaggtactttattactgtcagcagcgtgtagttcgtcggccctccgcctccgtaccgtttccgggcgggtacgggaccgaggggtggagagtacgaaacgtaacgtggtcggcgtcgacaccatcctgtcttcacttcccg

SEQ ID NO: 248483 - DNA, 525 bp, Homo sapiens
  misc_feature: GYAE6OF02HX4YQ.47.64.F09.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (503)..(503): a, c, t, g, unknown or other
  misc_feature (503)..(503): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctattagcctggtaccaacagaaacctggtcaggctcccaggctcctcatctatgatgcatccaacgnggccactggcatcccagcaggttcagtggcaggtgggtctggggacaggacttcactctcaccatcagcagcctagagcctgagtactttggactttattactgtcagtcagcgtgtagttctggcctccgctcgaccgtttcgggcgtacgggaccgagggttggagtactacgaaacggacgtggtggctcgcaccgngttccgtcgtcttccattcccg

SEQ ID NO: 248484 - DNA, 534 bp, Homo sapiens
  misc_feature: GYAE6OF02GKZXT.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggcctcctcatctatgatgcatccaacacgggccacgtggcactcccagacaggttcaggtggcaggtgggtctgggacagtacttcactctcacatcagcacgcctagacgcctagaacgtacgtttggtactttatactgtcagcagtcgtgacgttcgtcgcctccgctctacgttcgggcggacggccgagggtgagactacgaacgtacgtggtcggactcgaccacgtagtccgtcgttcttctacttcccg

SEQ ID NO: 248485 - DNA, 518 bp, Homo sapiens
  misc_feature: GYAE6OF02H0Y01.47.64.F09.1.454.CMB.1.raw
  modified_base (352)..(352): a, c, t, g, unknown or other
  misc_feature (352)..(352): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagacatttgttttgacacagtctccagccaccctgtctttgtctccaggggaaagagccaccctctcctgcagggccagtcagagtgttggcagctacttagcctggtaccaacagaaacctggccaggcctcccaggcctcctcatctatgatgcatccaacagggccactggcatcccagacaggtcagtgcaggtgggtctgggacngacttcactctcaccatcagcacgcctagacgcctagaacgtactttaggtactttattactgtcagtcagcgtgcgttctggcctccgctcacgtttcggcgtacgggacgagggtgagagtacgaaacgacgtggtcggctcgcacgatctgtcttcattcccg

SEQ ID NO: 248486 - DNA, 503 bp, Homo sapiens
  misc_feature: GYAE6OF02GGTFV.47.64.F09.1.454.CMB.1.raw
  modified_base (500)..(500): a, c, t, g, unknown or other
  misc_feature (500)..(500): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggccaggctcccaggctcctcatctatgatgcatccaacagggccactggcatcccagccaggttcagtggcagtgagtctgggacagacttcactctcaccatcagcagcctagacgcctgaagtattttgctactttattactgtcagcagcgtagcaactggcctctcgtacgtttcggcggacgggaccgagggtggagatacgagacgacgtgtgctcgcacctatctagtntac

SEQ ID NO: 248487 - DNA, 575 bp, Homo sapiens
  misc_feature: GYAE6OF02HOV93.47.64.F09.1.454.CMB.1.raw
  modified_base (195)..(195): a, c, t, g, unknown or other
  misc_feature (195)..(195): n is a, c, g, or t
  modified_base (436)..(436): a, c, t, g, unknown or other
  misc_feature (436)..(436): n is a, c, g, or t
  modified_base (478)..(478): a, c, t, g, unknown or other
  misc_feature (478)..(478): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccaccctgtctttgctccaggggaaagngccaccctctcctgcagggccagtcagaatattcactcctacttagcctggtaccaacagaaacctggtcaggctcccaggctcctcatctatgatgcatccaacagggccacgtggcatcccagacaggttcaggtgcaggtgggtctgggacagacttcactctacacatccagcacgcctagacgcctagaacgtactttaggaactttatacttgtcacgtcagtcgtgtagttcgnggtccctccggctccgtacgtttcgggacgtacgggtaccgngggggtacgacgtacgttacgaaacggtaacgtgggttacggtaccttggaccctaaccgtacgttcctacggtttccctttactaccgtttccccg

SEQ ID NO: 248488 - DNA, 546 bp, Homo sapiens
  misc_feature: GYAE6OF02IW5NW.47.64.F09.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (523)..(523): a, c, t, g, unknown or other
  misc_feature (523)..(523): n is a, c, g, or t
tcagagctcacgtacacgaccggtgctcgatttagcgcgtatacaaggggaggaacgtggctcagttaggacccagagggaaccatggaagcccagctcagcttctcttcctcctgctactcgtggcctcccagataccatcggagaagttgtgttgacacagtctccagccacctgtctttgctaccaggggaaangccaccctntccngcaggccagtcagatntcatctatncctgaccananaactgnagctccaggctcctnatctatgatgcatccaaacgcggccanggcaatcccgagacctaggttcaggtgcagtgggtctgggacagccttnactctgaaccntcagactaggaccaggacnccgtagtaacgagttttacgactttagtaacgtgttacgaggtaccaaggtcctaagtcgttacctggtaccctcgactcgacgtttcggnggtacggacnggggtgaacgttaacgaacggaacgtcggttgaccgttcgacgaccgtntacctggtaccttcagtttaccc

SEQ ID NO: 248489 - DNA, 514 bp, Homo sapiens
  misc_feature: GYAE6OF02G646B.47.64.F09.1.454.CMB.1.raw
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagacattgttttgacacagtctccagccaccctgtctttgtctccaggggaaagagccaccctctcctgcagggccagtcagagtgttgacagctacttagtctggtaccaagagaaacctggccaggctcccaggctcctcatctgggatgcatccaacngggccnctggcatcccagccaggttcagtggcagtggtctgggacagacttcactctcaccatcagcagcctagacgcctgaagtatttgctagtttattactgtcagcaacgtaatactgcctcgctctacgtttcggcggacgggaccgagggtgacgagtagaacgacgtggtggctgcaccgtatctcgtcttcacttcctccgtcc

SEQ ID NO: 248490 - DNA, 522 bp, Homo sapiens
  misc_feature: GYAE6OF02H5TV6.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaagagccaccctctcctgcagggtcagtcagagtgttgacagctacttagtctggtaccaagagaaacctggccaggctcccaggctcctcatctgggatgcatccaacgagggcccgctggcactcccagccaggttcagtggcagtgggtctgggacagacttcactctcaccatcagcagcctagagcctgaagtatttgctagtttattactgtcagacaaacgtaatactggcctccgctctacgtttcggcggacgggaccgagggtacgacagtagaaacgacgtggtacgcgtgcaccgatctgtcttctacgtccttcccg

SEQ ID NO: 248491 - DNA, 520 bp, Homo sapiens
  misc_feature: GYAE6OF02HK6J8.47.64.F09.1.454.CMB.1.raw
  modified_base (504)..(504): a, c, t, g, unknown or other
  misc_feature (504)..(504): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacaggacttcactctcaccatcagcagcctagagcctagaacgtactttggactttattactgtcagcagtcgtgtagttctcggcctccgcctctacgtttcggcggtacgggaccgaggggtgagtacgtacgaaacgacgtgtggctgcaccngtctgtcttcattccg

SEQ ID NO: 248492 - DNA, 519 bp, Homo sapiens
  misc_feature: GYAE6OF02IPHBQ.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagagtattagcagcaacttagcctggtaccagcagaaacctgggcaggctcccaggctcctcatctatgatgcgtccaccgagggccactcggtttcccagcccaggttcagtggcagtgcgtctgggacagagttcactctcaccatcaacagcctgcagtctagaagtattttgctagtttattactgtcagctagtatcataactggccgtctctaccgttcggaccgaagggacaacgacgtggagtaacgttaaacgacttaggtaggctgacacatctgtcttcattcccg

SEQ ID NO: 248493 - DNA, 537 bp, Homo sapiens
  misc_feature: GYAE6OF02G5YU8.47.64.F09.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaaacctgggcaggctccaggctcctcatctatggtncatccaccagggccactggtactcccagccaggttcaggtggcaggtgggtctgggacaggagttcactctcacctatcagcagcctgcagtctgaagtattttgacttaatttattactgtacagtactagttaataataacgtcggtacctcgtcgttccggaccgtaaggacacgtacgtaggaagtaacgttaaacgacgtggtcggtacgtagactaccgtcttcgtcgttctctaccg

SEQ ID NO: 248494 - DNA, 519 bp, Homo sapiens
  misc_feature: GYAE6OF02IT44D.47.64.F09.1.454.CMB.1.raw
  modified_base (423)..(423): a, c, t, g, unknown or other
  misc_feature (423)..(423): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccaggggaaagagccaccctctcctgcagggccagtcagaatattcactcctacttagcctggtaccaacagaaacctggtcaggctcccaggctcctcatctatgatgcatccaacagggccaactggcatcccagacaggttcagtggcagtgggtctgggacagacttcactctcaccatcagcagcctagagctgaagtactttggactttattactgtcagcagcgtgagttcnggtcctccgcttctacgtttcgggcggtacgggaccgtagggtggagagtacgaaacggtactggtggcgtgcacctactctgtctttcattcccg

SEQ ID NO: 248495 - DNA, 527 bp, Homo sapiens
  misc_feature: GYAE6OF02IB94X.47.64.F09.1.454.CMB.1.raw
  modified_base (196)..(196): a, c, t, g, unknown or other
  misc_feature (196)..(196): n is a, c, g, or t
  modified_base (343)..(343): a, c, t, g, unknown or other
  misc_feature (343)..(343): n is a, c, g, or t
  modified_base (429)..(429): a, c, t, g, unknown or other
  misc_feature (429)..(429): n is a, c, g, or t
  modified_base (502)..(502): a, c, t, g, unknown or other
  misc_feature (502)..(502): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccaccctgtctttgtctccgaggggaaangccaccctctcctgcagggccagtcagaatattcactctacttagcctggtaccaacagaaacctggtcaggctccaggctcctcatctatgatgcatccaacgagggccacgtgcactcccagacaggttcagtggcagtgggtcngggacagacttcactctacaccatcagcagctagacgcctagaacgtactttggaactttagttactgtcagtcagcgtgagttcnggcctcgctcacgtttcgacggagggccagggtcgagacgtacgaacgtaactggtcggcttggacctaccgngtaccttggtactttcgattccccg

SEQ ID NO: 248496 - DNA, 570 bp, Homo sapiens
  misc_feature: GYAE6OF02IT9CU.47.64.F09.1.454.CMB.1.raw
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (541)..(541): a, c, t, g, unknown or other
  misc_feature (541)..(541): n is a, c, g, or t
tcagagctcacgtacacgaccggtgctcgatttagcgcgtatacaaggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcgacgggccagtcagaatatcactctactgctgtaccanagaactgcagctccagctcncatctangatgcatccaacgnggccacgtgcaactcccagacgtaggttcaggtggcaggtcgggtctgggacagtacttcactcctacaaccagtccagcacgacctagacgtcctagaactcgtttagaactttatactgtctaagcaggtcgtagtacgttcgacggcccttccgcttacgtaccgtttcggggacggacggaccgtaggggttagaactacgtaaccgaaacggtcgtgggtaggcccttaggacctaacgtacgttnttacggttacctttacgaccgtttccccg

SEQ ID NO: 248497 - DNA, 522 bp, Homo sapiens
  misc_feature: GYAE6OF02GP2NM.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctcccaggctcctcatctatgatgcatccaacagggccactggcatcccagccaggttcagtgcagtgagtctgggacagacttcactctcaccatcagcacgcctagacgcctagaagtattttgctactttattacttgtctagcagcgtagcaacgtcgcctctctacgtttcgggcggtacggaccgagggtggagacgtacgaaggaacgaacgtggtcggcgtacgccacctagtctcgtcttacg

SEQ ID NO: 248498 - DNA, 652 bp, Homo sapiens
  misc_feature: GYAE6OF02IH27N.47.64.F09.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgactacagtctccagtccacctgtctttgctccgaggggaaangccaccctctcctgcgacgggccagtcaagtaattacttcacttaccttacttagcctaggtaaccaacaacgaaccgtggtacacggcctaccgaggtcctcctnattctatgatcgctactaccaacggnggcccagtggcacgtccgaagtcgtaggttcaggtgactaggtcgggtcgagggaacaggtacttcgactctacaactagtaccaacgcgtcctgctacgtcgtaaggaacgttatttacgacttaagttttacttacgttcgtactagacttaagtactactaacgttaacgtcgggtaccctacgtaccgtaccggttaccggaaccgtaaacgggaccaacggtacgtagggtaacgttaacgttaaacggtaacgttacgggacggtacgttacgacctaacgttacgttccgttacgttcctttactaccgtttccccg

SEQ ID NO: 248499 - DNA, 620 bp, Homo sapiens
  misc_feature: GYAE6OF02IVD6G.47.64.F09.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaanagccaccctctcctgcagggccagtcagaatattcactcctattagcctggtaccaanagaaacctggtcaggctcccgaggctcctnatctatgatgcatccaacgagggccactggaccactcccagaccaggttcaggtggcaggtgggctgggacagcttcactctcaccntccagcacgcctagacgcctaggaacgtacgtttaggtaaccttttaagttacctagttactaacggtccgtaacggtcggttgtacgtttccgtcgggtacccttcccgtacgttaccgtaccgttttccggggacgggtaacgggtaccgtaaggggttcggaaggtacgttaaccgaaaccggtaacgttggtacgggtcgtacgaccgtaccgtacgtaccgttcggtaccttacgtacttccccg

SEQ ID NO: 248500 - DNA, 497 bp, Homo sapiens
  misc_feature: GYAE6OF02GQTD5.47.64.F09.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctntcctgcagggccagtcagatattcactcctacttagcctggtaccaacngaaacctggtcaggctcccaggcctcctcatctatgatgcatccaangggccactggcatcccagacaggttcagtggcagtgcgtctgggacagagttcactctcaccatcaacngcctgcagtctgaagtattttgactagtttattacgtgtcagtcagtatcataacgtggccgtctcaccttcggccaaggacacgacgtgagagttaaacgacgtgtagctgcacatcngtcttnac

SEQ ID NO: 248501 - DNA, 553 bp, Homo sapiens
  misc_feature: GYAE6OF02H5HCN.47.64.F09.1.454.CMB.1.raw
  modified_base (195)..(195): a, c, t, g, unknown or other
  misc_feature (195)..(195): n is a, c, g, or t
  modified_base (521)..(521): a, c, t, g, unknown or other
  misc_feature (521)..(521): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggagaaatagtgatgacgcagtctccagccaccctgtctgtctctccaggggaanagccaccatctcctggtagggccggtcagagttattagcatcaacttagcctggtaccagcagagacctggggcaggctcccgaggcctcctcatctatgatcgctccaccgagggccacgtggtactcccagcctaggtttcaggtcggacagggttcgggtcctggggactaggtagttcactctcaccatccagcacgcctgcagtctagaagtattttgacttaatttattactgtacagtactagttataattaacgtggtcctcgcttacgaccgaaggacgacgacgtaggacgtaagtaaccgaacgtgtaggtaccngtaccaccgtattccgtagttccttactaccg

SEQ ID NO: 248502 - DNA, 526 bp, Homo sapiens
  misc_feature: GYAE6OF02HCUGJ.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccacgtggcatcccagccaggttcagtgcagtgagtctgggacagacttcactctcaccatcagcagcctagacgcctagaatagtttgctactttattactgtcagcagcgtagctaacgtgcctctctacgtttcgggacggtacgggaccgaggggtggaggtagtcgaggtacggtaacgtggtggcgttcggacctacctacgttcgttcgttcc

SEQ ID NO: 248503 - DNA, 619 bp, Homo sapiens
  misc_feature: GYAE6OF02GSTIS.47.64.F09.1.454.CMB.1.raw
  modified_base (308)..(308): a, c, t, g, unknown or other
  misc_feature (308)..(308): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagagtgttggcagctacttagcctggtaccaacagaaaccctggccaggcctcccgaggctcctcatctatgatgcatccaacgngggccacgtggcactcccagccaggttcagtggcagtgacgtcgtgggacagtacttcactctcacatcagcagcctagcgcctagtaacgtatttcgacttaactttattacgttgtacagctagcgtaagacctaacgtcggtcccttcgttcctaccgttttccggggaccgggtaacggggtacccggtagggggttacgggaacggtacggtaccggaacgggtaacccggtaaccggtttacgggtaccggggtacccgttcgggtaccccgaacccgttagttaccccggtttaggtttacccc

SEQ ID NO: 248504 - DNA, 510 bp, Homo sapiens
  misc_feature: GYAE6OF02IPQZE.47.64.F09.1.454.CMB.1.raw
  modified_base (196)..(196): a, c, t, g, unknown or other
  misc_feature (196)..(196): n is a, c, g, or t
  modified_base (345)..(345): a, c, t, g, unknown or other
  misc_feature (345)..(345): n is a, c, g, or t
  modified_base (502)..(502): a, c, t, g, unknown or other
  misc_feature (502)..(502): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagatattcactcctacttagcctggtaccaacagaaacctggccaggcctcccaggctcctcatctatgatgcatccaacagggccactcggcatccccagccaggttcagtggcagtgagtcngggacagacttcactctcaccatccagcagcctagacgccgtagaacgtatttgctacgttttattactgtcagctacgcgtagcacgtcgcctcgtctacgtttcggcgggtaggaccgagggtcgagagtcgagtacgaacgtgtgcgtcgcacntctgtctc

SEQ ID NO: 248505 - DNA, 494 bp, Homo sapiens
  misc_feature: GYAE6OF02HG23P.47.64.F09.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggagaaatagtgatgacgcagtctccagccaccctgtctgtctctccaggggaaanagccaccatctcctgtagggccggtcagagtattagcatcaacttgcctggtaccagcagagacctgggcaggctcccaggctcctcatctatgatgcatccaangggccatggcatcccagacnggttcagtggcagtgggtctgggacagaccttnactctcacatcacagcctgcagtctagaagtattttgacttagtttattactgtcagcagtatcataactggcctctctaccgttcggacggagggaccgagggtggagagtcgagacgaacgtgcggctggcacgatcg

SEQ ID NO: 248506 - DNA, 510 bp, Homo sapiens
  misc_feature: GYAE6OF02GE78M.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagacttcactctcaccatcagcagcctagagcctgaagtactttggactttattactgtcagcagcgtgagttctggcctccgctcgtacgtttcggcggagggaccgagggtggagatacgaaacggaactggtggctgccacatctgtcttcattccc

SEQ ID NO: 248507 - DNA, 539 bp, Homo sapiens
  misc_feature: GYAE6OF02FF8VX.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaanagaaacctggtcaggctcccaggctcctcatctatgatgcatccaacagggccactggcatcccagacaggttcagtggcagtgggtctgggacagacttcactctcaccatcagcagcctagagcctagaagtacgtttggtactttattactgttcagcagcgtgagttctggcctcgctcctacgtttccgggcgggagggaccgaggggtcggagtacgtacgaaacggtaacgtggtcggtccgtgccaccgtactccgttcggtcctttcgacttcccg

SEQ ID NO: 248508 - DNA, 514 bp, Homo sapiens
  misc_feature: GYAE6OF02GR8UU.47.64.F09.1.454.CMB.1.raw
  modified_base (196)..(196): a, c, t, g, unknown or other
  misc_feature (196)..(196): n is a, c, g, or t
  modified_base (511)..(511): a, c, t, g, unknown or other
  misc_feature (511)..(511): n is a, c, g, or t
tcagagctcacgtacacgaccggtgctcgatttagcgcgtatacaaggaggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggctctcatctatgatgcatccaacagggccacgtggcatcccagacaggttcagtgcaggtgggtctgggacagacttcactctcaccatcagcagcctagacgcctagaagactttggactttatactgtcagcagcgtggagttctggcctccgcttctacgtttcgggcggtacgggaccgaggggtggagataccgaaacggtaactggtggctgccacatctcgtcttntac

SEQ ID NO: 248509 - DNA, 720 bp, Homo sapiens
  misc_feature: GYAE6OF02IIKSL.47.64.F09.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatnttcactcctacttagcctggtaccaacagaaacctggtcaggctccaggcctcctcatctatgatgacataccaacacgggacctactggaccacgtaccccagactagggttccaaggttcggctaggtcggggtactggggaacagtactttcgacttcctacacctatccgaggtccaacggtaccctaagacgtcccgtacggtaaacgtaccgtttttaggtaacttttaacgtttaaccgttacgttcgtaacggtacctaacgggtaccggttaggtacggtttaccgttcgggtccccgtttacccggtaccgttcccgttaccggtttttccgggggaccgggtaaccgggggtacccggtaagggggttacgggtaacggtacggttaaccgtaaaaccgggtaacggttacgggtacgggtacccgttcggaacctacccgtacgttccgttacggttacctttaccgtacgtttcccccg

SEQ ID NO: 248510 - DNA, 519 bp, Homo sapiens
  misc_feature: GYAE6OF02GCX27.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctccaggctcctcatctatgatgcatccaacagggccactggcatcccagacaggttcagtggcagtgcgtcgtgggacagagttcactctcaccatcaacacgcctgcagtctagaagtattttgctagtttattacttgtcagcagtatcataacgtgccgtctcctaccgttcggaccgaacggacacgacgtaggagtaacgtaaacggaacttggtacggtctgacacactctcgtacttctac

SEQ ID NO: 248511 - DNA, 587 bp, Homo sapiens
  misc_feature: GYAE6OF02HDF3T.47.64.F09.1.454.CMB.1.raw
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtcccctcacttgcattgtctctggtgctccatcacctagttttaatattggtgggctggatccgcagccccaggagggctggatggattgggagtatattttataatggggacacgtctttacaacccatccctcaagagtcgagtttcatatccgcagacacgtcgagaatcacttctccctagaactgacgtctctcgtagacccgccgcagacgacggtcttgtttattactgttcgagactatcggaccgaccgagacgtactattacgtccggtactagggtttacggttttgaatttaggtttacgggggaccgtaaaggggtaacgaacggggttccaaccggttccgtacccggaccgacgtccccgtacccgaaaccccggg

SEQ ID NO: 248512 - DNA, 771 bp, Homo sapiens
  misc_feature: GYAE6OF02ITZ9B.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccgagggaaagagccaccctctcctgcagggtcagtcagagtgttgacagctacttagtctggtaaccaagagaaacctggaccaggcctaccccgaggcctccgtacacttcgtcggggatcgactaactacccgaaacgacggggcccgtcgtgggaccctacgtcccccaaggtccccgtagggtttccaaggtcgggaccgtagggttcggggtacccgttgggggaacctaacgggtacctttaccgaacgttccgttaccaacccgtaacgtccaacggcgaaccggtaccgtaacggacggtacccgttaaggaaacggttacgtttttaggaccgttaagttttaactttaacgtcggttacaacggtaaccgtaaaacgttaaaacttccgttaacgggtccctaccggtaccttacgttaaccgggttttccgggaaccggggtaacgggtaacccggtaggggggttacaaacggtaacgtaagggaaaccgtacgttcggtacgggacgttccgaccgtaaaccttacggttaccgtagtttccgtaccttacgtcccgttacccgccctaacg

SEQ ID NO: 248513 - DNA, 537 bp, Homo sapiens
  misc_feature: GYAE6OF02HO7IV.47.64.F09.1.454.CMB.1.raw
  modified_base (196)..(196): a, c, t, g, unknown or other
  misc_feature (196)..(196): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
  modified_base (476)..(476): a, c, t, g, unknown or other
  misc_feature (476)..(476): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctattagcctggaccaacagaaacctggtcaggctccaggctcctcatctatgatgcatccaacagggccactggcatcccaagactaggttcagtggctaggtgggtctgggacagacttcgacttcncaccatcagcagcctagacnctagaagtctttagactttagttactgtcagtcagtcgtgacgttcnggccttcgctctaccgtttcnggcgggtacggaccgtaggggtganacgtacgaaacgtacgtggtagaccgttgactaccgacgttcgttacgttcttaccgtacc

SEQ ID NO: 248514 - DNA, 572 bp, Homo sapiens
  misc_feature: GYAE6OF02HT4L6.47.64.F09.1.454.CMB.1.raw
  modified_base (394)..(394): a, c, t, g, unknown or other
  misc_feature (394)..(394): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactgggtgaagccttcggagaccctgtccctcacttgcattgtctctggtgctccatcaccagttttaatattggtgggctggatccgccagcccccagggaagggctggaatggattgggagtatattttataatggggacactctttacaacccatccctcaagagtcgagtttccatatccgcagacacgtccgagaatcacttctccctagaaactganctctgtcgaccgccgcagacacggcttgtttattactgttcgagacatcgaccgaccgagagctattagtcggcgtagttacgggttttagagttagtttcgggggaccctaaaggggtaccgaaaggggtcctaacccggttcctacccggccaacggtcccctacccgaacccggg

SEQ ID NO: 248515 - DNA, 662 bp, Homo sapiens
  misc_feature: GYAE6OF02IQZ7W.47.64.F09.1.454.CMB.1.raw
  modified_base (195)..(195): a, c, t, g, unknown or other
  misc_feature (195)..(195): n is a, c, g, or t
  modified_base (340)..(340): a, c, t, g, unknown or other
  misc_feature (340)..(340): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagaatattcactcctacttagccctggtaccaacagaaacctggtcaggctccaggctcctcatctatgatgcatccaacagggccagtggcactccagcaggttcagtgcagtgggtcngggacagtacttcactcgtaccaccatccgaacgccgaagccttacggacgtacccgtaggtaacgtaccgtttcgggtaaccttttaagtttaaccttcggtacgttaacgccgtaacggtccgttaagaccgtaaccgtcgggaccttccctaccgttaccgtttaccgggaccgggtaacgggtacccgtaaggggtacggtacggtaacgtaccgaacggtacccggtaaacggtttcggtacgggtaaccgtccggtaaccgtaacccgtacgttacccgttcgggttacccttttaccgacccgttttacccccgg

SEQ ID NO: 248516 - DNA, 826 bp, Homo sapiens
  misc_feature: GYAE6OF02JH532.47.64.F09.1.454.CMB.1.raw
  modified_base (192)..(192): a, c, t, g, unknown or other
  misc_feature (192)..(192): n is a, c, g, or t
tcagagctcacgtacacgaccggtgctcgatttagcgcgtatacaagggggaggaacgtgctcagttaggaccagagggaaccatggaagcccagctcagcttctcttcctcctgctactctggctccagattccaccggagacattgttttgactacagtctcagccaccctgtcttgtctccaggggaangccacctctcctgcagggccagtcagagtgttggcagctacttagcctggtaaccaacacggaaaacctcggccgaacgggccttaccccgaagggcctaccttacactttccgtaagtggtaacttggacctaacgttccccaaaacggacggggccccaacgttcggggacctaccgtacccccgaacgggcccgtaacgggttttaccgaacgggttcgggaccgtaaaggttcgggaacggtttccggtacgggggaaccttacgggtaccttttacccgaccgttacccgtaaccaaccgtacgtccgtaacggaacccgtaccgtaacccggtaaacggtaccggtaacccggtttaaacggtaaacggttttacgtttcggtaacctttaaacgttttacttaacgttacggttactacgtaccgtagtaccggagttaaccgtacgtaccgttaccgttaccgttccgttaaccggtttccggggtaaccgggaaaccggttacggggtacgggggtaacggtattacgggtaaccgtaaccgggtaaccggttagttacccggggttggtaaccgtaccgggtaacgttaaccgttaggttttccgtacggtttacccttaccgg

SEQ ID NO: 248517 - DNA, 611 bp, Homo sapiens
  misc_feature: GYAE6OF02HK3HH.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccacggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcaggtggtctgggacagtacttcactctcaccatcagcacgcctagacgcctaggaacgtacgtttaggtacttttattacctggtacaggtccaggtcggttagtacgtttccgtgggtcccttccgtccgttccgtacgtttccgggcgggtacgggtaccggtaggggtcggacgtaacgtaccgtaaaccggtaacgttcgggtacgggccgttacggacccgtaccgtacgttccgttacggtttaccgtttcctacgtttcccttaccccgg

SEQ ID NO: 248518 - DNA, 562 bp, Homo sapiens
  misc_feature: GYAE6OF02G3UOU.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaanagaaacctggtcaggctcccaggctcctcatctatgatgcatccaacgacgggcccactggccatccccagacaggttcaggtcggcaggtgggtctgggacaggaccttcactctacacatcagcagcctagacgcctagaacgtacgtttggactttatactgtacagcagtcgtgtacgttcgtcggccctccgtccttacgtaccggtttccgggacgggtacgggtaccgtaggggtcgaacgtacgtacgaaacgtacgtggtacggctacgcctaccgtattcctgttccttcgattcccg

SEQ ID NO: 248519 - DNA, 544 bp, Homo sapiens
  misc_feature: GYAE6OF02GK4BX.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctggggacagacttcactctcaccatcagcagcctagcgcctgaagtacgtttggtactttattactgtcagtcagtcgtgtagttcgtcggtcctccgctcgtaccgtttcgggacggtacgggaccgtaggggtcggacgtacgtacgaaacggtacgtggtcggcgtcgacacctacgtcttcgtcttcctattcccg

SEQ ID NO: 248520 - DNA, 545 bp, Homo sapiens
  misc_feature: GYAE6OF02F0KHA.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagacttcactctcaccatcagcagcctagacgcctagaacgtactttggtactttattactgtcagcagcgtgacgtttcgtcggccctccgctccgtacgtttcgggccgggtacggaccggtaggggtggagtacgtacgaaacggacgtggtcggcgtcgacaccgtactcgttacgttcttactacttcccg

SEQ ID NO: 248521 - DNA, 570 bp, Homo sapiens
  misc_feature: GYAE6OF02HLAM2.47.64.F09.1.454.CMB.1.raw
  modified_base (195)..(195): a, c, t, g, unknown or other
  misc_feature (195)..(195): n is a, c, g, or t
  modified_base (434)..(434): a, c, t, g, unknown or other
  misc_feature (434)..(434): n is a, c, g, or t
tcagagctcacgtacacgaccggtgctcgatttagcgcgtatacaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaangccaccatctcctgtagggccggtcagagtattagcatcaacttagcctggtaccagcagagacctgggcaggctcccgaggcctcctcatctatgatgcgtccatcgagggccacgtcggtttcccagcctaggttcaggtggctagtgcgttcgtagggacaggagttcactctcaccatacaacacgcctgcagtctagagtatttcgactagtttattctgtacagtctagttanctataacgtggcccgtctaccgtacccgttacggaccgaagggtacctacggaccggttagggaacgtaaacgtttaaacggaacgttcggtacgggtaccttacgaccgtaacccgtagtttccgttggttaccc

SEQ ID NO: 248522 - DNA, 543 bp, Homo sapiens
  misc_feature: GYAE6OF02HMBB7.47.64.F09.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (358)..(358): a, c, t, g, unknown or other
  misc_feature (358)..(358): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaanagaaacctggtcaggctccaggctcctcatctatgatgcatccaacagggccactggcatcccagacaggtcagtggcagtggtctgggacagacttcactcncaccatcagcagcctagacgcctagaagtactttggtactttattactgtcagcagtcgtgtacgttcgtcggcctccgctctacgtttcgggcggtacgggaccgagggtggagacgtacgaaacggtaacgtggtcggctcggacctaccgtactccgtaggttccttaccgtactttccccg

SEQ ID NO: 248523 - DNA, 562 bp, Homo sapiens
  misc_feature: GYAE6OF02JY9VW.47.64.F09.1.454.CMB.1.raw
  modified_base (197)..(197): a, c, t, g, unknown or other
  misc_feature (197)..(197): n is a, c, g, or t
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccaggggaaangccaccctctcctgcagggccagtcagaatattcactcctacttagcctggtaccaacagaaacctggtcaggcctcccaggctcctcatctatgatgcatccaacngggccacgtggcactcccagactaggttcaggtggacaggttgggtctgggacagtacttcactctcaactntcagcacgcctagcgcctaggaacgtacgtttcggtaactttatactgtacacgctagtcgtgtacgttcgcggtccctccgaccttcgtacggtttcgggacgtacgggaccgagggtgagtacgtacgtaaacggtcgttgtggtactcgaccgactagttcgtcgttacttcgtacgttcccg

SEQ ID NO: 248524 - DNA, 576 bp, Homo sapiens
  misc_feature: GYAE6OF02I9ASQ.47.64.F09.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaanagccaccctctcctgcagggccagtcagaatattcactcctacttagcctggtaccaanagaaacctggtcaggctcccaggctcctcatctatgatgcatccaacagggccagtggcatcccagacaggttcagtggcaggtgggctgggacagtacttcactctcaccatcagcagcctagacgcctagaacgtacgtttaggtaactttattactgttacagcagtcgtgtacgttcgtcggtccctccgtcctccgtacgtttcgggaccgggtacgggtaccggaggggtcggaacggtacgtaaccgaaacggtacgttaggtacggtccgtacgacctacccgtattccgttacgttccttacgtacttccccg

SEQ ID NO: 248525 - DNA, 556 bp, Homo sapiens
  misc_feature: GYAE6OF02G3M9K.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccaggggaaangccaccctctcctgcagggccagtcagaatattcactcctacttagcctggtaccaacagaaacctggtcaggctcccgaggctctcatctatgatgcatccaacagggccacgtcggcactcccagacaggttcaggtggcaggtgggtctgggacacggtacttcgacttctcaccatcaagccagcctagacgcctaggaacgtacgtttggactttattacgtgtacagcacgtcgtgtacgttcgtcgccttccgtctcgtacgtttcgggaccggtagggccgaggggtggacgacgtacgaaacggtactggtacggcgtcgactacacgttcctgtccttcgtacttcccg

SEQ ID NO: 248526 - DNA, 556 bp, Homo sapiens
  misc_feature: GYAE6OF02IH0EI.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctgtaccaacagaaacctggtcaggctcccaggcctctcatctatgatgcatccaacagggccactggcactcccgaagcaggttcagtggcagtgggtctggggacagtacttcactctcaccatcagcagcctagacgcctaggaagtagttttgacttagtttacttacgttgttactagactaaacgtaaatactacggtacctccgccttcgtaccgtttcggcggtagggaccgagggtcggacgagtacggaacgtacgtggtacggtctcgacactacgtctcgttacttctacttccctacccg

SEQ ID NO: 248527 - DNA, 794 bp, Homo sapiens
  misc_feature: GYAE6OF02J2GG9.47.64.F09.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagcccaccctgtcctttgtctaccgaggggaaancgccaccctctcctgcagggccagtcaagaatnttcactcctacttagcctggtaccaactagaaaccctggtacaggtcctccccgaggtcctacccgtcctatccttaatcggaacttcgaccacttaccccaaacgtacgggaccctaatccgggcctaaactccccgaaggaacctacgggttaccgaggtcgggacctaggttcggggtacgtacggggtaaccaacgggtccctttaccgaccgttccttaccgaaccctagttacccgaacgggtaccctaacggtacccgttaaggaacccggtacccgttaacgggtaaacgttaccgttttaacgggtaaacctttttaacgttaacgttacgtacgtaaccggtacgtaacggtcgttacgggttacgtttccggttacggtaccccgttccggtaccgttttacccgtacccggtttacggggtacccggggaacgggttaaccccggtagggggtacggtaacgtagttaaccgtaaaccgggtaacgttcggttaacggccgttacgacccgtaactccgttaccgttacggtccttacctacggttcccc

SEQ ID NO: 248528 - DNA, 653 bp, Homo sapiens
  misc_feature: GYAE6OF02JGD45.47.64.F09.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccacctgtctttgctccgaggggaaangccaccctntcctgcagggccagtcagaatattcactcctacttagcctggtaccaacagaaacctggtcaggcctccgaggctcctcatctatgatgacatccaacgacgggccctagtcggaccactaccccgaagaccgtaggttcaggtggcctaggtgggtctaggggaccaggtacgttcacgttctaccaccgaataccgaaactacgccttacgaccgtacgttcgtaagtaaacgttagttttacgacgtttaaggttttaacttcgtagttacgagtacgtaagttactacaacgttaacgtcggtaccctacctacgtacccgttcgggaaccgtaacgggaacctaacgggtactacgggtaacgtaacgttaaacggtaacggttaggtacggtacgtacgacctaaccgtacttccggttacgttaccttacgtacgttaccccg

SEQ ID NO: 248529 - DNA, 524 bp, Homo sapiens
  misc_feature: GYAE6OF02IX3T0.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagacttcactctacaccatcagcagcctagacgcctgagtactttggactttattactgtcagcagcgtgtagttctcggcctccgtctctacgtttcggcggtacggaccgtagggtggagatacgaaacgtaacgttgtcggcgtgaccaccgattcgtgtcttcacttcccg

SEQ ID NO: 248530 - DNA, 520 bp, Homo sapiens
  misc_feature: GYAE6OF02FFWEI.47.64.F09.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (360)..(360): a, c, t, g, unknown or other
  misc_feature (360)..(360): n is a, c, g, or t
  modified_base (459)..(459): a, c, t, g, unknown or other
  misc_feature (459)..(459): n is a, c, g, or t
  modified_base (514)..(514): a, c, t, g, unknown or other
  misc_feature (514)..(514): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagaatattcactcctattagcctggtaccaanagaaacctggtcaggctcccaggcctcctcatctatgatgcatccaacgaggccactggcactcccagacaggttcagtggcagtgggtctgggacagacttcactcncaccatcagcagcctagacgacctgaacgtacttgtactttatactgtcagctagcgtgtagttctggcctccgctcgtactttcggcggtacggacgngggtgagatacgaacgtaacgtgtcggtctgccaccacgtacttcgtccttactnttcccg

SEQ ID NO: 248531 - DNA, 731 bp, Homo sapiens
  misc_feature: GYAE6OF02IS94W.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaagggggagggaactgctcagttaggacccagagggaaccatggaagccccagctcagcttctcttcctcctgctactctggctcccagataccatcggagacagttgttttgacacagtctccagccaccctgtctttgtctccgaggggaaagngccaccctctcctgcgacgggccagtcagagtgttggcacgcctacttacgtccttaggtacccaacacgaaacctggaccaaggcctcccaggcctccgtcatctatgatcgcactacccgaacgcgggccactcggactacgtccccgagtacctagggttccgaggtcggaccgtacgtaggaacggttccgttaggggaaccgtaggtacctttacgaccgttcctaccgaaccctatccgacggtacctacggtaccctaaggacgtacccttaggaaacgttacgttttcgaaccttaccgtttttaagtttaaccgttggttaaccgtaggtaccgttaacggtccggttaacgaccgttaaaccggttcggtaacccttcgttaccttaaccggttttccgggaccgggttaacgggtacccggtacggggttacgggacgtaacgtcggtaaacggtaaccggtaacggtcggttaggcccgttaacggtacccgtaaccgtacggttccgttaggttaccc

SEQ ID NO: 248532 - DNA, 524 bp, Homo sapiens
  misc_feature: GYAE6OF02HM4Z8.47.64.F09.1.454.CMB.1.raw
  modified_base (351)..(351): a, c, t, g, unknown or other
  misc_feature (351)..(351): n is a, c, g, or t
  modified_base (425)..(425): a, c, t, g, unknown or other
  misc_feature (425)..(425): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactctacttagcctggtaccaacagaaacctggtcaggctcccaggcctcctcatctatgatgcatccaacagggccactggccatcccagacaggttcagtggcagtgggtctgggacngacttcactctcaccatcagcagcctagagcctagaagtactttggactttatactgtcagcagcgtgagttcnggcccttcgctctaccgtttcgggaccggtgggaccaggggtgagacgtacgaaacggtactggtcggctggccaccgtattctggttcttcattcccg

SEQ ID NO: 248533 - DNA, 532 bp, Homo sapiens
  misc_feature: GYAE6OF02GAEU0.47.64.F09.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (361)..(361): a, c, t, g, unknown or other
  misc_feature (361)..(361): n is a, c, g, or t
  modified_base (421)..(421): a, c, t, g, unknown or other
  misc_feature (421)..(421): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaanagaaacctggtcaggctcccaggctcctcatctatgatgcatccaacagggccactggcatcccagacaggttcagtggcagtgggtctgggacagacttcactcncacatcagcagcctagacgcctagaagtactttggtactttattactgtcagcagcgtgngttcgtgcctcgctctacgtttcggcggtacggaccgagggtggacgtatacgaaacggacgtggtcggctaggacctacctacgtccgttcggtaccttcgtacttcccg

SEQ ID NO: 248534 - DNA, 548 bp, Homo sapiens
  misc_feature: GYAE6OF02H8M15.47.64.F09.1.454.CMB.1.raw
  modified_base (198)..(198): a, c, t, g, unknown or other
  misc_feature (198)..(198): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (528)..(528): a, c, t, g, unknown or other
  misc_feature (528)..(528): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgagggggaaangccaccctctcctgcagggccagtcagaatattcactcctacttacgcctggtaaccaacaagaaacctggtacaggcctcccgaggctcctcatctatgatgcatccaacgagggcccacgtggccactcccagaccgaggttcaggtggctaggtgggtctggggacagtacttcacgttcacgaccatccagcagcctaagcgcctaggaagtactttggactttattactgtnacgnagtcgtgtgtctcggccctcgctcgtccgttcgggcggacgggacgaggggtgagtacgtacgaaacgtacgtggtcgctcgcctacgnttccgttgtcttcattcccg

SEQ ID NO: 248535 - DNA, 568 bp, Homo sapiens
  misc_feature: GYAE6OF02HGMDQ.47.64.F09.1.454.CMB.1.raw
  modified_base (196)..(196): a, c, t, g, unknown or other
  misc_feature (196)..(196): n is a, c, g, or t
  modified_base (359)..(359): a, c, t, g, unknown or other
  misc_feature (359)..(359): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggctcccagataccatcggagaagttgtgttgacacagtctccagccaccctgtctttgtctccaggggaaangcccaccctctcctgcagggccagtcagaatattcactcctacttagcctggtaccagcagaaacctgggcaggctcccaggctcctcatctatggtgcatcccaccgaggggcccacgtggtaactccccgagccctaggttccaggtcggcaggtgggtcnggggacaggtagttcactctcaccatcagcagcctgcagtctagaagtatttgactaatttatactgtctagtactagttaataataacgtcggtacctacgtcttaccgggaccgtaagggtaccacgacgtaggtagtaacttaacgtactcggtagtacgtcgaccgtacctagttcgtcgttaccttacacgttcctacccgtac

SEQ ID NO: 248536 - DNA, 700 bp, Homo sapiens
  misc_feature: GYAE6OF02FMS18.47.64.F09.1.454.CMB.1.raw
  modified_base (328)..(328): a, c, t, g, unknown or other
  misc_feature (328)..(328): n is a, c, g, or t
tcagagctcacgtacacgaccggtgctcgatttagcgcgtatacaagggtaggaactgctcagttaggacccagagggaaccatggaagccccagctcagctctctcctcctgctactctggctcccagatacccatcggagaagttgtgttgacacagtctccagcccacccctgtccttgtcctccgaaggggtaaaacgacgccccacccctctcccgtgccgaacgggtcccagtccagactacttccacctcctcttacgcctggtacccaccacgaacccgtgtcacggcctccccgaggcctcctcatctatgatcgcacncaacaggcacgtgccactccccaagtaccaggttcaggtcgggacgtaggttcgggtcgtgggaaccaggtacccttaccaccttccgtaccaccctactaccgacgtaccgacggtaccctacggtaccggcctaaggaacgttaacgtttcggtaaactttacgttacctcggtaccacgaccgtacgtccgttagtaccgtttccggtcggtcccctaccggtaccttaccgtaaccggtttaccgggaccgggtaaccgtaaaccgggtgggttaccggtaacgtacgtaaccgaaaccgtaacgttcggtaccggtcgtacgaccctaccgtaccgttccgtcgtacccgttcctaccgtttccccg

SEQ ID NO: 248537 - DNA, 617 bp, Homo sapiens
  misc_feature: GYAE6OF02JISOE.47.64.F09.1.454.CMB.1.raw
  modified_base (202)..(202): a, c, t, g, unknown or other
  misc_feature (202)..(202): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctnacttgcattgtctctggtgctccatcacctagttttaatattggtggggctggatccgccacgcccccagggaagggctggaatggattgggagtatattttataatggggacactctttacaacccatccctnaagagtcgagtttccatatccgacagacacgtccganaatcacttctcctagaactganctntgtcgaccgcgcagaccacggcttagtttacttacgttgtcgagacctatcgacccgaccgagacggtactaagtttacgtaccggctaacggtttaccggttttagtaacgttacgggttttacgggggaaccgtaaagggggaacccgtaaacggggttcccaacccgggttcccttacccggaccgtacggtaccccgttaccccgaaaccccggg

SEQ ID NO: 248538 - DNA, 560 bp, Homo sapiens
  misc_feature: GYAE6OF02GU1VD.47.64.F09.1.454.CMB.1.raw
tcagagctcacgtacacgaccggtgctcgatttagcgcgtatacaagggggaggaactgctcagttaggacccagagggaaccatggaagccccagcgcagcttctcttcctcctgctactctggctcccagataccactggagaaatagagatgacgcagtctccagccaccctgtctgtgtctccagggggaaagagccaccctctcctgcagggccagtcagagtattagcagcaacttagcctggtaccagcagaaacctgggcaggctcccaggctcctcatctagtggtgcatccacgagggccactggtactcccagcctaggttcaggtggctaggtcgggtctggggacaggtagttccacttctaccaccataccaacacgcctgcagtctagaagtatttgacttagtttattacgtgtacagtctagtatactatacgtcggccgtctccaccgttccggaccgtaacgggaccacggtacgtaggaacgtaacgttaaaacgtaacgtggtacggtcgtacgctaacctagtcgttacgtcttaccg

SEQ ID NO: 248539 - DNA, 503 bp, Homo sapiens
  misc_feature: GYAE6OF02FIW06.47.64.F09.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctattagcctggtaccaacagaaacctggtcaggctcccaggctcctcatctatgatgcatccaacagggccnctggcatcccagccaggttcagtggcaggtgggtctgggacagacttcactctcaccatcagcagcctagagcctagaagtattttgactaattttatacttgtcagctaagtataaataactcggtcctgtcttcggaccgaaggacacgactggagattaacgatgtggctgcacntctgtctcnctcctccnc

SEQ ID NO: 248540 - DNA, 761 bp, Homo sapiens
  misc_feature: GYAE6OF02JLN0M.47.64.F09.1.454.CMB.1.raw
  modified_base (274)..(274): a, c, t, g, unknown or other
  misc_feature (274)..(274): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcaggccagtcagatattcactctactagcctggtaccacagaacctggtcagctccagctccnatctatgatgcataccaacgacgggccctacgtcggacctactaccccgaagtaccgaggtttccgaacggttcgggacgtaaggttcggggtacgtaggggtaccgaacgggttaacttaccgaaccgttccttaacccgaaccctagttacccgaacgtccgtaacggaccgttaacggacgtaccccggttaacgaaacggttaccgttttacggttaacctttttaagtttacccttagtttaccgaacgtccgtacggtacggttacgttacggtttaccgttcggtccccgttacccgtaccgtccgttaccggttttaccgggaccgggttaacggggtaccggtaaccgggggtaggttaacggtaccgtaacgtaaaccggttaaccggttacgggtcgggtaaccggttacccggaacgtaacccccggttacgtcccggtttaccgtttaccgttaccgttacccgttacccccgg

SEQ ID NO: 248541 - DNA, 516 bp, Homo sapiens
  misc_feature: GYAE6OF02G3D56.47.64.F09.1.454.CMB.1.raw
  modified_base (442)..(442): a, c, t, g, unknown or other
  misc_feature (442)..(442): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagagtgttgacagctacttagtctggtaccaagagaaacctggtcaggctcccaggctcctcatctatgatgcatccaacagggccactggcatcccagacaggttcagtggcagtgggtctggggacagacttcactctcaccatcagcagcctagagcctagaacgtacgtttaggacttttattactgttcagcagcgtgagttctggcctcgctcncgtttcggcggaggaccagggtggagatacgaaacggacgtggtggctgaccaccgtatcgtcgttccttctac

SEQ ID NO: 248542 - DNA, 539 bp, Homo sapiens
  misc_feature: GYAE6OF02FY1JY.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggagaaatagtgatgacgcagtctccagccaccctgtctgtctctccaggggaaagngccaccatctcctgtagggccggtcagagtattagcatcaacttagcctggtaccagcagagacctgggcaggctcccaggctcctcatctatgatgccgtccaccagggccactcggtttcccagccaggttcaggtggcagtgcgtcgtggggacagagttcactctcaccatcaacagcctgcagtctagaagtatttgctagttttattactgtcagcagtatctaataacgtggcctctcctaccgttcggaccgaagggaccacggacgtaggaagtaacgttaaaccgaacgttggtacggcgttacgcctaccgtatccttacgttccttaccg

SEQ ID NO: 248543 - DNA, 558 bp, Homo sapiens
  misc_feature: GYAE6OF02HZDLN.47.64.F09.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (319)..(319): a, c, t, g, unknown or other
  misc_feature (319)..(319): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccaggggaanagccaccctntcctgcagggccagtcagaatatcactctactagcctggtaccaacagaaacctggtcaggctccaggctcctcatctatgatgcatccaacagggccactgcatcccagacnggttcaggtggcagtgggtctgggacagacttcacgtctacaccatccagcagacctagacgcctagaagtacgtttggactttacttactgtcagtcagtcgtgtagttctcggcctccgtctcgtacgtttccgggcggtacgggaccgtaggggtaggacgtagtaaccgtaaacggtaacgttggtacggtcgtcgaccgaccgtacttccgttcgtcttaccgtacgttccccg

SEQ ID NO: 248544 - DNA, 545 bp, Homo sapiens
  misc_feature: GYAE6OF02H2DBW.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggcccactggcatcccagacaggttcaggtgcaggtgggtctgggacagacttcactctcaccatcagcagcctagacgcctagaacgtacgtttaggtactttattacttgtcagtcagtcgtgtagttctggcctccgctcgtacgtttcggcgggtacgggaccgagggtcggagagttacgtaagtcggtaacgtggtacggtcgtggaccaccgtacttcgttgttccttctaccg

SEQ ID NO: 248545 - DNA, 703 bp, Homo sapiens
  misc_feature: GYAE6OF02GJQ0L.47.64.F09.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctcccaggctccncatctatgatgcactaccaacgacgggcccaacgtggacactccccgaagaccgtagggtttccaggttcgggcctaaggttcggggtcgttaggggacctaaggtacctttaccaacctcgttaccacccgtaagttccaacggccacggaccttaacggacgtccctaaggtaaacgtaccgttttagggtaacttttacgtttacttggttacctacggtccgtaggtccgttggtaccggtttccgtcgggtccccttcccggtccgttaccgttaccggttttccggggaccggggtaaccgggtaccggtagggggtacggaacggtacgttaaccggaaaccggtacggttggtacgggccttaggacccgtaaccgtacgttccgttacgttccgtttacgtacgttccccg

SEQ ID NO: 248546 - DNA, 615 bp, Homo sapiens
  misc_feature: GYAE6OF02G8DL7.47.64.F09.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaanagccaccctctcctgcagggccagtcagaatattcactcctactagcctggtaccaanagaaacctggtcaggctcccaggctcctcatctatgatgcatccaacacgggccacgtggcatcccagacaggttcagtggcaggtgggtctgggacagtacttcactctacaccatcagcagcctagacgtcctagaacgtacgtttacggtaacttttagttaccttgttactaggtacgaagtcggttgtaagtttccgtacggtcccttcccggcttccgtaccgttttcggggccgggtaacggggtacccgtaaggggtacggaacgtacgtaaccgaaaaccggtaacgtcggttacgggtccgtacggaccaaccgtacgttccgttacggttccctttacgtacgttaccccg

SEQ ID NO: 248547 - DNA, 564 bp, Homo sapiens
  misc_feature: GYAE6OF02IWSPL.47.64.F09.1.454.CMB.1.raw
  modified_base (246)..(246): a, c, t, g, unknown or other
  misc_feature (246)..(246): n is a, c, g, or t
  modified_base (421)..(421): a, c, t, g, unknown or other
  misc_feature (421)..(421): n is a, c, g, or t
  modified_base (447)..(447): a, c, t, g, unknown or other
  misc_feature (447)..(447): n is a, c, g, or t
  modified_base (491)..(491): a, c, t, g, unknown or other
  misc_feature (491)..(491): n is a, c, g, or t
  modified_base (545)..(545): a, c, t, g, unknown or other
  misc_feature (545)..(545): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtgctccatcaccagttttaatattggnggggctggatccgccagcccccagggaaggggctggaatgggattggggagtatattttataagtggggacacttctttacaaccactccctcaagagtcgagtttccatatccgcacgacacgtccgagaatcacttctcctagaactgagctctgtcgaccgtccgcacgacnccggcttgtttacttacgtgttcganacagtgccgaccgagagctattaactcggtcagttacggttttnagttgtttcggggaccaaggggtaaccgaacggtacgtaccggtcgtacccgtnacgcccgtacccaacccgg

SEQ ID NO: 248548 - DNA, 603 bp, Homo sapiens
  misc_feature: GYAE6OF02I8NAK.47.64.F09.1.454.CMB.1.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (288)..(288): a, c, t, g, unknown or other
  misc_feature (288)..(288): n is a, c, g, or t
  modified_base (382)..(382): a, c, t, g, unknown or other
  misc_feature (382)..(382): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccaggggaaagngccaccctctcctgcagggccagtcagaatnttcactcctacttagcctggtaccaanacgaaacctggtcaggctcccgaggcctcctnatctatgatgcatccaacacgggccaacgtggccacgtaccccagactaggttcaggtggcaggtcgggtctgggaccaggtaccttcacttcncaccatccagcaacgccgtaagcggtacctaggtaacgtacgtttaggtacttttatacgttcgtactaagccgtagtccgtagtacgttcgtcggtacccgttccgtccgttacctaccgtttcggggaccggtacggggtaccgaggggttggagtactaacgaaccggtacgtggtcggtacgtcgacaccgtatccgtgttccttacgtacttaccg

SEQ ID NO: 248549 - DNA, 739 bp, Homo sapiens
  misc_feature: GYAE6OF02ILROC.47.64.F09.1.454.CMB.1.raw
  modified_base (517)..(517): a, c, t, g, unknown or other
  misc_feature (517)..(517): n is a, c, g, or t
  modified_base (669)..(669): a, c, t, g, unknown or other
  misc_feature (669)..(669): n is a, c, g, or t
  modified_base (701)..(701): a, c, t, g, unknown or other
  misc_feature (701)..(701): n is a, c, g, or t
tcagagctcacgtacacgaccggtgctcgatttagcgcgtatacaagggggaggaactgctcagttaggacccagagggaaccatggaagccccagctcagcttctcttccctctgctactcgtgtcctccagtactactagtacggaagtagttggttgtacgaacacgtacgtcctaccgacgacccctaccgttgtttctttcgtcctaccgggaaaggggaaagccaccctacccttccttccgtcgacggaccgggcctacgtacgaaagtaatttactacctacccttaccttaacgttaccgtaccgttaccggtaaaccaacgtaaccgtaaccgtcggtacgacggtcccctaccggacgtcctcctatacttacttagtcgtagtcactacctaaccgaaacgggtccggaccctaggtcgacctacctaccgaagaacgttcggtacagggtccgagttcggttacgggtcgaggactacgttacctcgtacctcgtaaccactanacggacaccgtacgtacgtaaggacctcggtaaagtaacgtttcggtttacgttaactttaacgttcgtagtacgcgtacgtggtcgttagtaccgttcgtcccgtccgtcgttcgtaccgtttccgggtacggggacggtaccgggtacgngggtactacgtacgaaacgtaacgtggttcgngtcacgactactcgttccgcgtttactacgtcctcccg

SEQ ID NO: 248550 - DNA, 556 bp, Homo sapiens
  misc_feature: GYAE6OF02GD5ED.47.64.F09.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaccaanagaaacctggtcaggctcccaggctcctcatctatgatgcatccaacagggccacgtggaccatcccagacaggttcagtggcaggtgggtctgggacagtacttcactctacaccatcagcagcctaagacgcctagaacgtacgtttgtaactttattactgtactagcagcgtgtcgttcgtcggtcctccgctcgtacgtttcgggacggtacgggaccggtagggtaggagagtaccgaaacggaacgttaggtacggtcgtagaccgtactacgtcgtgtccttctacttcccg

SEQ ID NO: 248551 - DNA, 516 bp, Homo sapiens
  misc_feature: GYAE6OF02HLTT0.47.64.F09.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccanagaaacctggtcaggctcccaggctcctcatctatgatgcatccaacaggccactggcatcccagacaggttcagtggcagtgggtctgggacagacttcactctcacatcagcagcctagacgcctagaagtactttggtactttatactgtcagcagcgtgacgttctggcctcgctcgtacgtttcggcgtagggaccagggttcgagacgtacgaacggtactggtggtctgaccgacctatcttcgtcttcattcccg

SEQ ID NO: 248552 - DNA, 592 bp, Homo sapiens
  misc_feature: GYAE6OF02F01PJ.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccactggagaaatagagatgacgcagtctccagccaccctgtctgtgtctccgaggggaaagngcccaccctctcctgcagggccagtcagagtattagcagcaacttagcctggtaccagcaagaacctcgggcaggcctcccgaggctcctcatctatggtgcatcccaccgagggcccacgtggtactccccagcctaggttcaggtggcaggtgggtcgtgggacaggacgttcactctccacatcgagcacgcctgcagtctagtaagttatttcgacttaatttattacgttgtacagtactagttaataagtaacgtcgtccgtcgtccgttccggaccgtaaacggtacgaaccggtacgtaggtaacgtaagttaaaccggtaacgttagggtacggtacgtacggtaccgtacccgttacgttcgttacgttaccttaccgtaaccg

SEQ ID NO: 248553 - DNA, 563 bp, Homo sapiens
  misc_feature: GYAE6OF02GXV3J.47.64.F09.1.454.CMB.1.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (447)..(447): a, c, t, g, unknown or other
  misc_feature (447)..(447): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctccagctcnatctatgatgcactaccaacgagggcccagtcggacactcccaagactagggttcaggtggcaggtgggtactggggacaggtacttcaacttctacaccatcagcagcctagacgcctagaacgtactttaggactttatactgtacagacagtctagtagttcgngccctccgtctccgtacgtttcgggacggacgggactaggggtagagactacgaaacgtaacgttggtacgggtctacggaccaccgtattcgtacggttccttacgacttccccg

SEQ ID NO: 248554 - DNA, 578 bp, Homo sapiens
  misc_feature: GYAE6OF02HC39W.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaccaacagaaacctggtcaggctcccaggctcctcatctatgatgcatccaacgagggccactcggcactccccagacaggttcaggtggcaggtgggtctgggacagtacttcacctctcaccatcagccagacctagacgcctagaagttctttaggactttatactgtacagcagcgtgtagttctcggtcctccggtctccgtaccgtttcgggaccgggtaacgggaccgtaggggtacggaacgacgtaacgaaacggtaccgttaggtcggaccgttcggaccctaccgtacttccgttgttacctttaccgacttccccg

SEQ ID NO: 248555 - DNA, 579 bp, Homo sapiens
  misc_feature: GYAE6OF02IVAQU.47.64.F09.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaanagggccacgtggcatcccagacaggttcagtggcaggtgggctgggacagtacttcactctcaccatcagcagcctagacgcctgaagtatttgacttagttttaacttactgttcaagtacctaaacgttaaattactcggtaccttccgaccttactaccgtttaccgggacggtaacggggaccgtaggggtacggactagtacgaaacggtaaccgtggtacggcgtacgaccgtaaccgtacttcgttcgttcttactacttccgttaccccg

SEQ ID NO: 248556 - DNA, 917 bp, Homo sapiens
  misc_feature: GYAE6OF02IAQND.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccaccggagaagttattttgacacagtctccagccaccctgtctttgtctccaggggaaanagccacctctcctgcagggtcagtcagagtgttgacagctacttagtctggtaccaagacgaaacctggccaggctcccgaggcctcctcatcgtgggatgacatcccgaaacgacgggggcccgcgtaggccctaacgtcccccgaaggtccccgtaaggggtttcctaagggttcggggacctaaggggtttcgggggttccttacgggggggaaacctaacgggtaacccttttcccgaaacccgtttcccgttacccaaaccccgtaattcccggaaacggcccgtaaacggtacccccgtttaagggaacccgggtacccgttagggtaaaacgggtttaacgttttttcggtaaccttttaaacgggtttttaactttaacgtttacggtttaccggtaaacggttaacccgttaaaaaccgggtttaaaaacgttaccggttaccggggtacccccttacccggtaccgtttaacccgttaacccgggttttttcccgggggaacggggggtaaaccgggggtaaccccgggttaacgggggggtttaaccggggaaaccgttaaaacgggtttaaccgggaaaaacccggttaaccgtttacgggttaaccgggtccgttaacggacccgttaaacccgtacgtttaccggtttaccgtttaccgttacccgtttaaaccgtttccccggttttaccccccggcctttaacccg

SEQ ID NO: 248557 - DNA, 535 bp, Homo sapiens
  misc_feature: GYAE6OF02FQCV6.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaanagaaacctggtcaggctcccaggctcctcatctatgatgcatccaacagggccacgtggcactcccagacaggttcagtggcaggtgggtctgggacaggacttcactctcacatcacgcagcctagacgcctagaagtcgttaggtactttattactgtctagcagcgtagcaacgtcggcctctctacgtttcgggacggtacgggacgagggtggagagtcgaaggaccgtaacgtggtcggtcgtgaccaccgtattcgtacgtcttcgacttcccg

SEQ ID NO: 248558 - DNA, 528 bp, Homo sapiens
  misc_feature: GYAE6OF02FQAOO.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctagaagtactttggtactttattactgtcagcagcgtgtagttctggtcctccgctctacgtttcggacggtacgggaccgtaggggtgagagtaccgaaacgtaacgtgtacggctgaccacctatcgttcgtcttcacttcccg

SEQ ID NO: 248559 - DNA, 587 bp, Homo sapiens
  misc_feature: GYAE6OF02IIITD.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagccaccctctcctgcagggccagtcagaatattcactcctacttagcctggtaccaacagaaacctggtcaggctcccaggctcctcatctatgatgacatccaaacgagggcccacgtggcatcccagacaggttcaggtgcaggtgggtctgggacagtacttcactctcacatcagcagcctagacgcctaggaagtattttcgacttaagttttattactgttactagtacaaacgttaaatacgtacggtcctccgtactacgtaccgtttacgggaccggtaacggggtaaccgtagggtcggaacgtagtacggaaacgtaacgtggtacggtctacggaccaccgtacttcgttcgttacctttactacttcccttacccg

SEQ ID NO: 248560 - DNA, 526 bp, Homo sapiens
  misc_feature: GYAE6OF02IQ8OV.47.64.F09.1.454.CMB.1.raw
  modified_base (196)..(196): a, c, t, g, unknown or other
  misc_feature (196)..(196): n is a, c, g, or t
  modified_base (427)..(427): a, c, t, g, unknown or other
  misc_feature (427)..(427): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccacgtggcactcccagacaggttcagtggcaggtgggtctgggacagacttcactctcaccatcagcagcctagacgcctagagtactttggactttattactgtcagcagcgtgagttcnggcctccgctctcgtttcgggcggtaacgggccgagggtgaagatacgaaaccggataggtggactcgaccaccgtattccgtagtccttcacttcccg

SEQ ID NO: 248561 - DNA, 593 bp, Homo sapiens
  misc_feature: GYAE6OF02GQK7D.47.64.F09.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (428)..(428): a, c, t, g, unknown or other
  misc_feature (428)..(428): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagccttggaccagccaacaaacctggcccaggcctcccgaggccttcctnactctatggtcncatcccaaccgagggcctacgtggtactccccgagccctaggttccaggtggctaggtcgggtctggggacaggtacgtttcacgttcaccacgtatccagccagcctgctagtctagtaagttntttgacttaatttactactgtacagactagtacgtagactaacgtcgaccgttccgcgttaccggaccgtaaagggcctaacggtacgtgggaactacgttaaacgacgtggtacgtcgtacgacgaacgttacgtcgttcgtacttcgtacgttcccttacccg

SEQ ID NO: 248562 - DNA, 540 bp, Homo sapiens
  misc_feature: GYAE6OF02HZK1A.47.64.F09.1.454.CMB.1.raw
  modified_base (196)..(196): a, c, t, g, unknown or other
  misc_feature (196)..(196): n is a, c, g, or t
  modified_base (421)..(421): a, c, t, g, unknown or other
  misc_feature (421)..(421): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggcctcctcatctatgatgcatccaagacgggccacgtggccatcccagacaggttcaggtggctaggtgggtctgggacagtacttcactctacaccatcagcagctagagcctagaagtacgtttagtacttattactgtcagnacgtcgtagtacgttcgtcggcctcgctcgtacgttcggcggtacgggaccgagggtggagagtacgaacggtaactggtcggcgtacgcgacctactcgttcgtcttcgtacttcccg

SEQ ID NO: 248563 - DNA, 591 bp, Homo sapiens
  misc_feature: GYAE6OF02FPDT7.47.64.F09.1.454.CMB.1.raw
  modified_base (151)..(151): a, c, t, g, unknown or other
  misc_feature (151)..(151): n is a, c, g, or t
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgngttgacacagtctccagccaccctgtctttgtctccaggggaaanagccaccctntcctgcagggccagtcagaatattcactcctacttagcctggtaccaacagaaacctggtcaggctccaggctcctcatctatgatcgcatccaacgacgggccaacgtcggcactccccagaccagggttcagtcggctaggtgggtactgggacagtacttcactctcacatcagcagcctagacgcctaggtaagtacgtttacggtacttttaagttacctggttacagcctaggcgttgacgtttcgtcgggtccctccgcttactacggtttcgggcggtacgggccctaggggtcggagtacgtacgaaaccggtacgttcggtaggtacctgaccgtaccgtagttccgttaggttcccttacgttacgttaccccg

SEQ ID NO: 248564 - DNA, 591 bp, Homo sapiens
  misc_feature: GYAE6OF02IRSCX.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtcttgtctccgaggggaagngccacctctcctgcagggccagtcagatatcactcctacttagcctggtaaccaacacgaaacctggtcacggcctcccgaggcctcctcatctatgatgcactccaacgacgggccacgtggccactcccgaagtaccgtaggttcaggtggactaggtgggtctgggacagtacttcgactctaccacatcacgcacgtacctacgacgccgtagaacgtacgtttaggtactttaacttactcgtactacgctaggtcgtgtagttcgtcgtcctccgctcgtacgttcgggacggtacggtaccggagggtaggacgtactacgtaaaccggtaagttcggtcggtacgtcgaccgtaccgtagttccgtcgttacctttcgacttccccg

SEQ ID NO: 248565 - DNA, 630 bp, Homo sapiens
  misc_feature: GYAE6OF02I3FYO.47.64.F09.1.454.CMB.1.raw
  modified_base (199)..(199): a, c, t, g, unknown or other
  misc_feature (199)..(199): n is a, c, g, or t
  modified_base (254)..(254): a, c, t, g, unknown or other
  misc_feature (254)..(254): n is a, c, g, or t
  modified_base (407)..(407): a, c, t, g, unknown or other
  misc_feature (407)..(407): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacagtctccagccaccctgtctttgtctccgaggggaaagngccacctctcctgcagggccagtcagagtattagcatcaacttagcctggtaccngcagagacctgggcaggctacccaggcctcctcattctagtgatgccgtccaccgacgggccacgtcggtttacccacggccgtaggttacacggtggccaggtcgcggtcgtcgggacaggtcggttacaccttcgtcaactacgtacaacncggtccctgcctaagtcgtagaagttaatttcgacgtttaagtttacgttacttcgtacaaggtctaagtactacgttaactaaccggtacgtccctacttaccgtaccgtaccgggacctaaagggaaccacggtaacgtaggtaacgttaaacgttaacggaacttcggacgtaccgtacgtaccgtaaccgacgttacctaggtttacctccgttaaccg

SEQ ID NO: 248566 - DNA, 584 bp, Homo sapiens
  misc_feature: GYAE6OF02H426K.47.64.F09.1.454.CMB.1.raw
  modified_base (283)..(283): a, c, t, g, unknown or other
  misc_feature (283)..(283): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaagagccaccctctcctgcagggccagtcagaatattcactcctacttagcctggtaccaacagaaacctggtcaggctccaggctcctnatctatgatgcatccaacgaggccacgtggcactcccagactaggttcaggtggcaggtgggtctgggacagtacttcactctcacatcagcacgctagacgtccgtagaacgtacgtttcggtaactttacgtagttcgtactagtcctagtcgttagtacgttctcggtccctccgtcttccgtacggtttccgggacgggacgggacgtaggggttgaacgtacgtaccgaaacggtcgttggtcggacgttacgacctaccgtacttccggttacgttacctttccacgtttccccg

SEQ ID NO: 248567 - DNA, 610 bp, Homo sapiens
  misc_feature: GYAE6OF02G0IDI.47.64.F09.1.454.CMB.1.raw
  modified_base (394)..(394): a, c, t, g, unknown or other
  misc_feature (394)..(394): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcacctagttttaatattgggtggggcgtggactccgccacgcccccgaggggaagggctaggaatggagttgggagtattattttagtaagtggggactacgtactttacaacccactccctacaagtagtcgtacgttccatactccgacagacacgtaccgaanactactaccttcttaccctagaactgtacgtctctcgtcgacccggtccgacgacgaccgacggtacttgttttacttaaccgtgttacgagtacagttcgacccgacgagagctagttacgtcgtacgtagttagtttcgaatttaggttcgggaccgtaagggaccgtaagggtacctaccggtctaccgaccgtacgaccctaccgtaaccgg

SEQ ID NO: 248568 - DNA, 766 bp, Homo sapiens
  misc_feature: GYAE6OF02I18XI.47.64.F09.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (556)..(556): a, c, t, g, unknown or other
  misc_feature (556)..(556): n is a, c, g, or t
tcagagctcacgtacacgaccggtgctcgatttagcgcgtatacaaggggaggaactgctcagttaggacccagagggaaccatggaagccccagctcagcttctcttcctcctgctactctggctcccagataccatcggagaagttattttgacacagtctccagccaccctgtctttgtctccaggggaaanagccacctctcctgcagggtcagtcangtagtgtagactagtcttacgttagtcgtacggtaaccaaggctaaaccgtggaccgtaggccctaccggacgcttacccgtactacgttcgtagggactcggactacgtaccgaacggcgggcccgtcgtacggcctaaccgtcccgaggtccgtaaggttcgaggtcggacgtacggtgggtacgtacggtaactacggtacttaccgaccttcaaccctacgtactaccgacgtcctaacgtaccgtaacgtacgtaccgtacggtaacgttagtttacgttacgtttaacgtttacttacgttacgttaacgtaacgtaaacgttaaacngggttaaacctaccgttacggtacccttaccggttaccgttccggaaccggtttaccgggacctgggggtacgggtaacccgaacgggtttacgggaaaccgtaacgtttggaaccgggtaacccgtttagggtaccggtaacccgttaggttcccgtaaccggttaacccgtttacccgttaacggtttcccgttttacccccggtacg

SEQ ID NO: 248569 - DNA, 524 bp, Homo sapiens
  misc_feature: GYAE6OF02GO2KT.47.64.F09.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
  modified_base (394)..(394): a, c, t, g, unknown or other
  misc_feature (394)..(394): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaanacgggccacgtggcactcccagccaggttcagtgcagtgagtcgnggacagacttcactcacacctatcagcacgcctagacgcctagaagtntttcgactactttattacttgtacagcagcgtagctaacgtcggtcctcgtctacgtttcgggcggacggaccgtagggtcggagtactacgagaacgtaacgtggtcgctcgcacctatctcgtcttac

SEQ ID NO: 248570 - DNA, 586 bp, Homo sapiens
  misc_feature: GYAE6OF02GW6P3.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaaggggaaagngccaccctctcctgcagggccagtcaagaatattcactcctacttacgcctggtaaccaacagaaacctggtacaggcctccgaggcctcctcatctatgatgcactaccgaacgcgggcccacgtggaccactcccagactaggttcagtggctaggtcgggtctagggacagtaccttcacttcaccaccgatcgacacacgcctacgacgtactagtaacgtacgtttaggtactttacgtacgtcgtcagtacgacgtcgtgtcgttcgtcggtccctcgtctacgtcggttcggacggtacgggaccgagggtcgagtacgtaacgaacggtacgtcggtcggctacgacctacgtcgttccgtcgttcttactcttcccg

SEQ ID NO: 248571 - DNA, 588 bp, Homo sapiens
  misc_feature: GYAE6OF02H2X7J.47.64.F09.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
  modified_base (377)..(377): a, c, t, g, unknown or other
  misc_feature (377)..(377): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangccaccctctcctgcagggccagtcagaatattcactcctacttagcctggtaccaacagaaacctggtcaggctcccaggcctcctcatctatgatgcatccaacgngggccacgtggcagtcccagactaggttcaggtcggctaggtcgggtctgggacaggtacttcactctcaccntcagcagcctagacgcctaggtaacgtacgtttagtactttaattacgtgttacagctagcgttgacgtttcgtcgtcctccgtccttccgtacgtttcgggcgggtacggggtacgtacggggtaggacgtagtaccgtaaacggtacgtaggtcggtacgtcgtaccgtaccgtacgttccgttcgttacctttaccgtacttaccccg

SEQ ID NO: 248572 - DNA, 591 bp, Homo sapiens
  misc_feature: GYAE6OF02HK039.47.64.F09.1.454.CMB.1.raw
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtgctcatcacctagttttaatattggtgggctggatccgccagcccccagggaagggctggaatggattgggagtattattttanaatggggacacttctttacaacccatccctanaagagtcgtagtttccatactccgcagacacgtcgaagaatcacttcctccctagaaactgacgtctcgtgtcgacccgccgacagaccgacggcttaggtttattacgtcgttcgagtacatcgcccgacgagagctattacgtcggacttaggttacggttttgagtttaggtttcggggaccgtaaaggggtaccgtaagggtaccctacccggtaccgtcccggactaccggtaccctcccgaaaccccgg

SEQ ID NO: 248573 - DNA, 560 bp, Homo sapiens
  misc_feature: GYAE6OF02IL4NN.47.64.F09.1.454.CMB.1.raw
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (406)..(406): a, c, t, g, unknown or other
  misc_feature (406)..(406): n is a, c, g, or t
tcagagctcacgtacacgaccggtgctcgatttagcgcgtatacaagggggaggaactgctcagttaggacccagagggaaccatggaagccccagctccagcttctcttcctcctgctactctggctcccagataccatcggagaagttgtgttgacacagtctccagccaccctgtctttgctccaggggaaagngccaccctctcctgcagggccagtcagatattcactctactagcctggtaccanagaactggtcaggctccaggctccgtcatctatgatgcanccaacagggccacgtgcatcccagactaggtcagtggcaggtggtcgtgggaccagacttcgactctcacatcagcagctagacgcctagaacgtactttaggactttaattacngttacgagtacagtcgttagtaacggttcttcgggtcccttacgccttccgtaccgtttccgggacggtaacgggtacgagggttacgagtagaaccgaacgtaacgtggtacgctaggcctactacgttccgttcggtctttcgactttcccg

SEQ ID NO: 248574 - DNA, 531 bp, Homo sapiens
  misc_feature: GYAE6OF02FSQER.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaaaccccagcgcagcttctcttcctcctgctactctggctcccagataccatcggagaagttgtgttgacacagtctccagccaccctgtctttgtctccaggggaaanagccaccctctcctgcagggccagtcagagtgtggcagctacttagcctggtaccaanagaaacctggccaggctcccaggctcctcatctatgatgcatccaacagggccacgtggcactcccagccaggttcagtggcagtgagtctgggacagacttcactctcaccatccagcagcctagacgcctagaagtattttgacttactttacttacttgtcagcagtcgtagctaacgtcggccctcgtcctacgtttcggcggacgggaccgtaggggtggagtagtcgaaggaccgtaacgtgtggcgtacgccaccgagtcgtcgtcttac

SEQ ID NO: 248575 - DNA, 580 bp, Homo sapiens
  misc_feature: GYAE6OF02GAE2C.47.64.F09.1.454.CMB.1.raw
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagagctcacgtacacgaccggtgctcgatttagcgcgtatacaagggggaggaactgctcagttaggacccagagggaaccacggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccacgtggcatcccagacaggttcaggtggcaggtggtctgggacngacttcactcncaccatcagcagcctagacgcctagaacgtacgtttaggtacttttattactgtctagtcagtcgtgtagtttcgtcgggtcccttccggccttcgtaccgtttcgggcgggtaacgggtaccgtaggggtcggagtacgtaccgaaacgtaacgtgggtacggcgtcggacctaaccgagttccgttagttacctttctacgttcccgttaccccg

SEQ ID NO: 248576 - DNA, 502 bp, Homo sapiens
  misc_feature: GYAE6OF02IASZK.47.64.F09.1.454.CMB.1.raw
  modified_base (195)..(195): a, c, t, g, unknown or other
  misc_feature (195)..(195): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaanagccaccctctcctgcagggccagtcagaatattcactcctacttagctggtaccaacagaaacctggtcaggctccaggctcctcatctatgatgcatccaacgagggccatggcatcccagacaggttcagtgcagtggtctgggacagcttcactctcacntcagcagctagcncctgaagtacgtttgactttatactgtacagcagcgtagcgtcgtcgcctccgtctcgtacgtttcgggcggagggacaggggtgagatacgaacgctggtggctgcctacatccgtatcttcattcccg

SEQ ID NO: 248577 - DNA, 542 bp, Homo sapiens
  misc_feature: GYAE6OF02FE6EW.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagatacccatcggagaagtttgtgttgacacagtctccagccaccctgtctttgtctccaaggggaaangccaccctctcctgcagggccagtcagaatattcactcctacttagcctggtaccaacagaaacctggtcagctcccaggctcctcatctatgatgcatccaacagggccactggcatcccagacaggttcagtggcagtgggtctgggacagacttcactctcaccatcagcagcctagacgcctagaagtacgtttggtacttttatactgtcagcagcgtgagtttctggccctcgtctctacgtttcgggcggacggaccgaggggtagaggtactacgaaacggtaacgtggtacggtctgaccaccgtacttccgtgttccttacgtacgttcccg

SEQ ID NO: 248578 - DNA, 534 bp, Homo sapiens
  misc_feature: GYAE6OF02FF8D7.47.64.F09.1.454.CMB.1.raw
  modified_base (197)..(197): a, c, t, g, unknown or other
  misc_feature (197)..(197): n is a, c, g, or t
  modified_base (382)..(382): a, c, t, g, unknown or other
  misc_feature (382)..(382): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtacccaacagaaacctggtcaggctcccaggctcctcatctatgatgcatccaacagggccactggcactcccagacaggttcagtggcagtgggtctgggacaggacttcactctcaccatcagcagcctagngcctgaagtactttggtactttatactgtcagcagcgtgtagttctggcctccgcttctactttcgggcgggacggacgaggggtggagtagtacaaacggtaacgtggtacgggtctcggcaccgtactccttggtccttcgtattccccg

SEQ ID NO: 248579 - DNA, 583 bp, Homo sapiens
  misc_feature: GYAE6OF02G6IAF.47.64.F09.1.454.CMB.1.raw
  modified_base (197)..(197): a, c, t, g, unknown or other
  misc_feature (197)..(197): n is a, c, g, or t
  modified_base (368)..(368): a, c, t, g, unknown or other
  misc_feature (368)..(368): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctcccaggcctcctcatctatgatgcatccaacgacgggccaactggccagtaccccagacctagggttcaggttggactaggtgggtctaggggacngtacttcgactctcaccatacagacagacctagacgcctagaacgtactttaggactttattactgtcacgtacaggtcgtgtacgtttcgcggtcctccgtctcgtaccggtttccgggcggtacgggaccggagggtacggagtacgtacgaaacggtaacggttgtacggactcgaccaacgtcttccgtacgttccttacctagttccccg

SEQ ID NO: 248580 - DNA, 783 bp, Homo sapiens
  misc_feature: GYAE6OF02FEAXG.47.64.F09.1.454.CMB.1.raw
  modified_base (211)..(211): a, c, t, g, unknown or other
  misc_feature (211)..(211): n is a, c, g, or t
  modified_base (387)..(387): a, c, t, g, unknown or other
  misc_feature (387)..(387): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccatcggagaagttgtgttgacacagtcctccacgccctacccttgttctttggtcctaccggaaggggtaaacncgtcccaccctctccgtgccgacgggtccagtaccaagtaacttcttaccaccttaccttacgttacgccgttacggtaacccaacgaaccgtaaccgtcgtacacggtcctccccgagcctttcctacacttactatcgactcgaacctaccgtaaccgaaccggaccggtaccncggtacgaccttacccgacgtacggtacggtacgttacggaggtccggtaggtcgggttcggtaccggtagaccgtaacgttcccttaacctctaccgtaacctaacctacgtacgtaccgacgtaccgtaccgtaacggtaccgttaacgtaaggtttaaccgtttaggtttaacctttaacttaccgtacgttcgacggttaactcgggttacgtacgtcgtttccggttaccgccgttacccgtccgttaccgttacggttccgggtaccggggtaaccgggtaaggtacggtgggtaaacgacgttaccaaccggtaacggttcggtaggtacccgttacaccggaccttagttccgttaaccgtttcctacccgttcctacccgttccccg

SEQ ID NO: 248581 - DNA, 691 bp, Homo sapiens
  misc_feature: GYAE6OF02GRLLF.47.64.F09.1.454.CMB.1.raw
  modified_base (287)..(287): a, c, t, g, unknown or other
  misc_feature (287)..(287): n is a, c, g, or t
tcagagctcacgtacacgaccggtgctcgatttagcgcgtatacaagggggagggaactgctcagttaggaccctaggacgggaaccagtacggaagccccgaacgctcagcttctcttcctcctgctactctggctcccagataccatacggaacgaaggttgtagtttgactacagtcctccagcccacccgtgtccttttggtccttccgaggggaaacgaggacccaccctctccctgccagggccagtccagatacttcaccttctactagcctgtaccaanagaacctggtacagcctaccgaggctccacgactcgatcgattcgactactccgaacgcgggaccctacggtcggcctacgtcccgagtaccgacggtttaccacggtacggcgtagggttcgggtactgggggacctaggtaccgttcacgtcctacacctgtacacgcctagtccgtagacgtcctaaggtaaccgtacggttttagaacctttaagttacgtcgttacgacgtcgtaggttcgttagtacggttccgtcggtccctacggtcttacgttcgtttccgggacgggttacgggtccgtaagggggttcgaacgttacggtaaccgtaaacgtggtacggtacggccttaggacctaacccgtgttacccgagtttacctacgtccgttacccg

SEQ ID NO: 248582 - DNA, 512 bp, Homo sapiens
  misc_feature: GYAE6OF02IO6QV.47.64.F09.1.454.CMB.1.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (463)..(463): a, c, t, g, unknown or other
  misc_feature (463)..(463): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccgaggggaaangccaccctctcctgcagggccagtcagaatattcactctacttagcctgtaccaacagaacctggtcaggcctccaggcctcctcatctatgatgcataccaacgngggccacgtggcactcccagcctaggttcaggtcgcagtgagtcgngggacagtactcactcacacatcancancagngctagatatttgacttactttatactgtacagctagcgtagcaacgtcgcctctctacgttcggcggtacggacgtagggngagtagtacgaagacgagtggngtcgtgacctacctntcctgtactccg

SEQ ID NO: 248583 - DNA, 570 bp, Homo sapiens
  misc_feature: GYAE6OF02JFY8Q.47.64.F09.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (330)..(330): a, c, t, g, unknown or other
  misc_feature (330)..(330): n is a, c, g, or t
  modified_base (549)..(549): a, c, t, g, unknown or other
  misc_feature (549)..(549): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctattagcctggtaccaacagaaacctggtcaggctcccaggcctcctnatctatgattgcactccaacgacgggccacgtggcactcccagacgnggttcaggtgcaggtgggtctgggacagtacttcactctcaccatcagcagcctagacgtcctaggaagtacgttttaggaccttttaattaccgtgttcgagtaccgaggtcgttgtacgtttccgtcggccgttccgtcttcgtacggtttccgggacgggtacggaccgtagggtgacgtagtacgaaacggtcgttggtcggctcgacgtacctnttccgtgtcttacacttcccg

SEQ ID NO: 248584 - DNA, 570 bp, Homo sapiens
  misc_feature: GYAE6OF02G18U7.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggctcctcatctatgatgcatccaacgagggccacgtggcatccccagacaggttcaggtggcaggtgggtctgggacagtacttcactctacaccatcagcacgcctagacgcctagaacgtactttggaactttattacctgttacagcagcgtgacgttcgtggccctccgctcctacgtttcgggacggtacgggaccgaggggtcgaggtacgtaccgaaaacggtactgggttacggtccgtacgaccaaccgtacgttccgttcggttacctttccgactttccccg

SEQ ID NO: 248585 - DNA, 519 bp, Homo sapiens
  misc_feature: GYAE6OF02GTLO8.47.64.F09.1.454.CMB.1.raw
  modified_base (362)..(362): a, c, t, g, unknown or other
  misc_feature (362)..(362): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctccaggctcctcatctatgatgcatccaacagggccacgtggcatcccagacaggttcagtggcaggtgggtctgggacagacttcactcncacatcagcagcctagacgcctagaacgtactttggactttatactgtcagcagcgtgagttctggcctcgctcgtacgtttcgggcggagggaccgtagggtcgagactacgaaacggattggcgtcgcgacaccgtatcgtagtcttcattcccg

SEQ ID NO: 248586 - DNA, 561 bp, Homo sapiens
  misc_feature: GYAE6OF02G63F6.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctccaggctcctcatctatgatgcatccaacgacgggccacgtggaccatccccagacaggttcagtggcaggtgggtctgggacaggacttcactctacacatcgagcacgcctagacgcctagaacgtacgtttaggactttagttactgtacagctagcgtgagttcgtcgcctccgctctacgtttcgggacgggtacgggacctaggggtcgagtacgtacgtaaacggaacgttggtcggtcctacggaccaacctcgttccgtgttccttaccgactttccccg

SEQ ID NO: 248587 - DNA, 601 bp, Homo sapiens
  misc_feature: GYAE6OF02ITUAY.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctaggtaccaagacgaaacctggaccaggcctcccgaggcctcctcatcgtgggatgcatcccaacgcgggccgctggccactcccgagcccgtaagggttccaggtcggctagggttggggtcgtggggaacacggtacctttacacttctcaacctatccagcacgccgtaagacgccgtagtaagtagtttgcttagtttattacgtgtacagtactaaacgttaactacgtcgacctcgctacgtacgttcggacgggtacggacgagggtacggacgagtacgaacgtagtggtcggtcgtgaccacgtacgttccgttacgttccttactacgttcccttacccgacctacg

SEQ ID NO: 248588 - DNA, 501 bp, Homo sapiens
  misc_feature: GYAE6OF02FMIAP.47.64.F09.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
  modified_base (393)..(393): a, c, t, g, unknown or other
  misc_feature (393)..(393): n is a, c, g, or t
  modified_base (460)..(460): a, c, t, g, unknown or other
  misc_feature (460)..(460): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctntcctgcagggccagtcagaatattcactcctattagcctggtaccaanagaaacctggccaggctcccaggctcctcatctatgatgcatccaacgacgggccacgtggcatccccaagccaggttcaggtggcagtgagtctgggacagacttcactctcaccatcagcagcctagagcctgaagtntttgctactttattacttgtcagcagtcgtagcaactggcctctctacgtttcggcggacgggacgngggtggagatcgaagacgacgtgtgcgtgcacatctgtctc

SEQ ID NO: 248589 - DNA, 588 bp, Homo sapiens
  misc_feature: GYAE6OF02HXAPM.47.64.F09.1.454.CMB.1.raw
  modified_base (198)..(198): a, c, t, g, unknown or other
  misc_feature (198)..(198): n is a, c, g, or t
  modified_base (425)..(425): a, c, t, g, unknown or other
  misc_feature (425)..(425): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaccaacagaaacctggtcaggctcccaggctcctcatctatgatgcatccaacagggccacgtggcatcccagacaggttcaggtggcaggtgggtctggggacagtacttcactctcacatacagacacgtacgagacgtacgagtacgttacgttagtttacttacttacgtntacgacgacgtacgtcgtagtcgttccggtcgtcccgtccttaccgtccgttaccggttcgggaccgggtaacgggtacgggtaggggtagtaacgtagtaaccgaacggtcggtcgggcgtacgccgaccacgttcgttcgttcttcttacgtccttccccg

SEQ ID NO: 248590 - DNA, 641 bp, Homo sapiens
  misc_feature: GYAE6OF02HC7TD.47.64.F09.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctcccaggctcctnatctatgatcgcactccaacgcggccacgtcggccactcccgagccgtaggttcaggtcggctaggtgacgtcgtaggggactacggtacttcactctaccacactcgagcacgtcctagacgtcgtagtaagttacgttttagaccttaacttttacttacttgtaccgtagcgtacgtcgtaacgaccgtaacgttcggtcccttacgttaccttaccggtttccggggaccgggtacggaaccgggttaggggtacgtacggtacgtaccggaacggtaaccggtaacggttggtaccggtcggtacccgtaccgtaacccgttaacgttccgtttaccgttaccgtttacccg

SEQ ID NO: 248591 - DNA, 539 bp, Homo sapiens
  misc_feature: GYAE6OF02GYO2K.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctccaggctcctcatctatgatgcatccaacagggccactggcatcccagacaggttcagtggctaggtgggtctgggacaggtacttcactctcaccatcagcagcctagagcctgaagtactttggactttattactgtcagtcagtcgtgtagttcgtcggtcctccgccttctaccgtttcgggcgggtacgggaccgtaggggtgacgagtacgaaacggtacgtaggtggtcgtcgctaccgattcgtgttcttctattcccg

SEQ ID NO: 248592 - DNA, 560 bp, Homo sapiens
  misc_feature: GYAE6OF02GJ0BE.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcgagggccagtcagaatattcactcctacttagcctggtaccaacagaaacctggtcaggctccaggctcctcatctatgatgcatccaacgacgggccaacgtggacactcccaagacacggttcaggtcgcaggtgggtccgtgggacaggtacttcactctcaccagtcagcacgcctagacgcctagaagtacgtttaggtactttagttactgttcagcacggcgttagtacgttcgtcggtcctccgtcttcgtaccgtttcgggcggtacgggaccggagggtggagtactacgaaacgtacgtggtcggctcggcaccgtatcgttgtcttactagttccc

SEQ ID NO: 248593 - DNA, 799 bp, Homo sapiens
  misc_feature: GYAE6OF02GAFVQ.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaagagccaccctctcctgcgagggccagtcagaatattcactcctacttagcctggtaccaacagaaacctggtcaggctcccaggcctcctcatctatgatgccatccaacgacgggccacgtcggacactccccgaagaccgtaggtttaccaggtcggactaagggttcgggttcgtagggggaacctacggttaaaccctttcgtaaacccgttcctacccgtaaaccctaacgttaccgacggtaccgtaaccggtacccgttaaacgggaccggtacccgttaacgggtaaaacgtttaaccggtttttacgggttaaacctttttaacggttaaccggtttcggtttaacccggtaacgtccgttaacgggttccgggttacgggtttacgttttcccgggaccgggtttccccgttacccggttaccgtttacccggtttaccggttttacccgggggaccggggttaaaccggggtacccggttaaggggggtacggtaacgggtaccgttaacccggaaaaccgggtaccggtttgggtaaccggtccgttacgacccgtaccgtattccgttcgtacctttaccacgttccccg

SEQ ID NO: 248594 - DNA, 579 bp, Homo sapiens
  misc_feature: GYAE6OF02GSVJY.47.64.F09.1.454.CMB.1.raw
  modified_base (459)..(459): a, c, t, g, unknown or other
  misc_feature (459)..(459): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaagagccaccctctcctgcagggccagtcagaatattcactcctacttagcctggtaccaacagaacctggtcaggctccagcctctcatctatgatgacatcccgaacgacgggccaacgtggaccactccccagacgtaggttcaggtggcgaggtcgggtcgtgggactagtcttacactctcacatcagcagtcctagcgcctagaacgtacgtttcgtaactttataccgtgtacgagtcgagtcggtagtacgtttccnggtccctccgtcctactacggtttccgggacggtacgggtaccagggggtacgagtactaccggaaacggtagtgtcggactcggctaccgtgttaccgtgtacctttcgactttccccg

SEQ ID NO: 248595 - DNA, 625 bp, Homo sapiens
  misc_feature: GYAE6OF02JVWOY.47.64.F09.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (283)..(283): a, c, t, g, unknown or other
  misc_feature (283)..(283): n is a, c, g, or t
  modified_base (564)..(564): a, c, t, g, unknown or other
  misc_feature (564)..(564): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctcccagataccatcggagaagttgtgttgacacagtctccagccaccctgtctttgctccaggggaaangccaccctntcctgcagggccagtcagaatatcactcctattacgcctggtaccaanacgtaaacctggtacaggcctccaggctcctnatcctatcgatacgcatccaacgcgggccacgtcggaccacgttccccaaggtaacctagggttaccaaggttcggacgaggtttcggggtactggggaccacggtacgtttaccaccttctaccaaccctacgtcaacggccgtaagcccgttaagacgtcccttaggaacgttcgtttacggtactttaacttacgtgttaccgagtacgttacgcgttcgtacgttcgtacggcccttcggtacctccgtaccgtttcgggaccgtacggtaaccggngggtacgagactacggaacgtagtggacgtcgtacgctacgctccgtgtacttcacgttcc

SEQ ID NO: 248596 - DNA, 594 bp, Homo sapiens
  misc_feature: GYAE6OF02IVCJF.47.64.F09.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (305)..(305): a, c, t, g, unknown or other
  misc_feature (305)..(305): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaccaanagaaacctggtcaggctcccaggcctcctcatctatgatgcatccaacgngggccactggcactcccaagacaggttcaggtcggcaggttggggtcgtagggacagtactttcactctccaacctatccagcacgcctagacgcctaggaacgtacgtttaggtaactttatacgtgtacgagtcagtcgttgtacgtcgtcggccctcgctcgtacgtttcgggacgggtacgggtaccgtaggggtacgaagtacgtaacgtaaacggtacggttcggtaggtacctggaccctaaccgtagttccgtaccggtttcttaccgtaccgtttccccg

SEQ ID NO: 248597 - DNA, 669 bp, Homo sapiens
  misc_feature: GYAE6OF02HH9WQ.47.64.F09.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
tcagagctcacgtacacgaccggtgctcgatttagcgcgtatacaagggggagggaactgctcagttaggacccagagggaaccatggaagccccagctcaggcttctcttcctcctgctactctggctcccagataccatcggagaagttgtgttgacacagtctccagccacctgtcttgctccaggggaaangccaccctntcctgcagggccagtcagaatattcactcctacttagcctggtaccaanagaaacctggtcaggctccaggcctcctcatctatgatgcatccgaactagggccacgtggccaactcccgaagtaccagggtttccaaggttcggcctaggtcggggtactggggaacctaggtacttcaacgttcctaccaaccgtattccgaacgtccgaacggtaccctaaggacgtacccttagggtaaacgtaccgttttacgggaaaccttttaagttaaccgtcggttaccgtaggtaccgtaacggttcggttagttaaccggtttcccgtacgggtccccttaccggtctacccggttacgttttcggggaccgggtacggggaccgtagggggttacgagacgtaccggtaaacgaacgttggtcggacttggacctaccgtatcgtacgtacttcgattccccg

SEQ ID NO: 248598 - DNA, 545 bp, Homo sapiens
  misc_feature: GYAE6OF02IH0ZM.47.64.F09.1.454.CMB.1.raw
  modified_base (194)..(194): a, c, t, g, unknown or other
  misc_feature (194)..(194): n is a, c, g, or t
  modified_base (387)..(387): a, c, t, g, unknown or other
  misc_feature (387)..(387): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaanagccaccctctcctgcagggccagtcagaatattcactctacttagcctggtaccaacagaaacctggtacaggctcccaggctcctcatctatgatgcatccaacgagggccacgtggcactcccagacaggttcagtggtcaggtgggtctggggacaggacttcgactctacacatcagcagcctagacnccgtagaacgtacgttttgactttattacgtcgtacgtagcagtcgtgtagttctcggtccctcgctcgtacgtttcgggcggtacgggaccgaggggtgacgtagtaccaaacggtctgtcgggctcgacacctagtcgttacgtcttcctatcccg

SEQ ID NO: 248599 - DNA, 547 bp, Homo sapiens
  misc_feature: GYAE6OF02IKUD2.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatatcactcctacttagcctggtaccaacagaaacctggtcaggctccaggctcctcatctatgatgcatccaacgacgggccactggcatcccagacaggttcagtggcaggtgggtctgggacagtacttcacgtctcacatcagcagcctagcgctagaacgtctttagactttaattactgtctaagcagcgtgtacgttctggtccctcgtctctaccgtttcgggcgggtagggaccgtaggggtgacgactacgaaacggtacgttcggacgtcgtaggacctaccgtattccgtggtttccttacgacttcccg

SEQ ID NO: 248600 - DNA, 659 bp, Homo sapiens
  misc_feature: GYAE6OF02I9PS5.47.64.F09.1.454.CMB.1.raw
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
tcagagctcacgtacacgaccggtgctcgatttagcgcgtatacaagggggaggaactgctcagttaggacccagagggaaccatggaagcccagctcagcttctcttcctctgctactctggctccagataccatcggagaagttgtgttgacacagtctcagccacctgtcttgctccgaggggaaangccacctctcctgcagggccagtcaagatattcactcctacttagcctaggtaccaanacgaaacctggtcaggctcccaggctcctcatctatgatgctactaccaacgacggcccaacgtggaccactccccgaagacgtaggttccaaggtcggacgtaggtcggggtctaggggaactaggtacttcgaactcctacgaacctatacgagtaccaacgtcctaaggacgtccgtaggtaaacgtcgtttagggactttaataccgtgtaccagtcaggtcgttgtacgttacgtcgggtacccttccgtccgtacgtaccggtttacgggaacgggtacggggtaccctaagggggtacgaacggtacgttaaccggaaaacggttacggtacggttacgggaccttacgggtacctaaccgttcgttacggttaccggtacctttaaccgtcccgtttccccgg

SEQ ID NO: 248601 - DNA, 546 bp, Homo sapiens
  misc_feature: GYAE6OF02JEB8O.47.64.F09.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (432)..(432): a, c, t, g, unknown or other
  misc_feature (432)..(432): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctntcctgcagggccagtcagatattcactcctacttagcctggtaccaacagaaacctggtcaggctcccaggcctcctcatctatgatgcatccaacngggccacgtggcactcccaagacaggttccagtcggcaggtgggtctagggacagtcttcactctacaccatcagcagcctgcagcctaganatgttnactaacttattactagtaactaaaatataacncgtacgcccgtactccgtacgtttcgggacggtacgggactaagggtgagtacgtacgaaacgtacgtggtcgacgtcgacaccgtagttcctagtcttctacttccttacccg

SEQ ID NO: 248602 - DNA, 697 bp, Homo sapiens
  misc_feature: GYAE6OF02GJ0JH.47.64.F09.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaaccaacagaaacctggtacaggcctcccgaggcttccncatctatgatgacactaccaacgacgggcccacgtcggacacgtcccgaagacctaggttccgaggtcggacgtaggttcggggtacgtaggggactaggtacctttcaccgttactaccaacctactacgacgaccgacgtaccctaaggaccgtcccgttaaggaaacgttaccgttttacggtaacctttttaagtttaaccgtcgttacgtaacgtacgttaacggtcggttagttacggtttccgtcggtccctccggtccttaccggttacggtttcccggggacgggtaaccgggtaccggtaggggttacggaacgtacgttaaccggaaacggtacgttaggtcgggtaccgttacgaccgtaaccgtcgttaccgttcgttcctttaccactttccccg

SEQ ID NO: 248603 - DNA, 588 bp, Homo sapiens
  misc_feature: GYAE6OF02HKFXE.47.64.F09.1.454.CMB.1.raw
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (536)..(536): a, c, t, g, unknown or other
  misc_feature (536)..(536): n is a, c, g, or t
  modified_base (560)..(560): a, c, t, g, unknown or other
  misc_feature (560)..(560): n is a, c, g, or t
  modified_base (583)..(583): a, c, t, g, unknown or other
  misc_feature (583)..(583): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgcctccgaggggaaancgccaccctctcctgcagggccagtcagatattcactctactagcctggtaccaacagaacctggtacaggctaccgnggctcctnatctatgatgacataccaacgacgggcccagtcggacactcccgagaccgtggttcaggtcggacaggttcgggtcacggggactacggtaccttacaccgtctactaaccgtctaccgagccgaaccgtcgtaacgacggtacctaggtaacgttacggtttacgttaacttttaccttacgtcgttacgacggtcacggtcgttgtacgttctcggtcctccgtctccgtacgttcggcgggtacggcgnggtgagtacacgaagtactggcgntcggacactgtcctcttctactnttccc

SEQ ID NO: 248604 - DNA, 634 bp, Homo sapiens
  misc_feature: GYAE6OF02HQYBW.47.64.F09.1.454.CMB.1.raw
  modified_base (194)..(194): a, c, t, g, unknown or other
  misc_feature (194)..(194): n is a, c, g, or t
  modified_base (403)..(403): a, c, t, g, unknown or other
  misc_feature (403)..(403): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctcagccacctgtcttgtctccgaggggaanacgccaccctctcctgcgagggccagtcagaatattcactcctacttagcctcggtaccaacagaaacctggtacaggcctcccgaggcctcctcatctatgatgcactccaaacgcgggaccacgtggaccatccccagacgtaggttcaggtggctaggtgggtcgtagggactagtacttcactctaccacatcagcagctagacncgtagaagtacgtttaggtactttattactgtacgagtcgagtcggtagtacgtttcgtcgtcccgttccgcttaccgtacggtttccgggacgggtaacgggtaccggtaagggggttacggaacggtacgtaacgtaaaccggtacggttaccgggtaggtaccgtcggtaacccgaacccgttcgtttaccgttccggtttacctttaccgtacccgtttacccccgg

SEQ ID NO: 248605 - DNA, 591 bp, Homo sapiens
  misc_feature: GYAE6OF02HMTOS.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagaatattcaactcctacttagcctggtaccaacagaaacctggtacaggcctccaggcctctcatctatgatgacatccaaacgacgggcccaacgtcgggctaactccccgagcccgtaagggtttccaggtcggcaggtggagtcgtggggactaggaacttcacttcctccaacctatccgagccacgcctaagacgtacgtacggaagttacttttagactacttttaattacttgtacagtcacgtacgtagcctaacgtcgcctcgtctaccgtttcgggacgggacggaccgtagggtcggacgtagtacgaaggacgtaacgtggtacggtctagaccaccgtacgtcttacgtcttaccg

SEQ ID NO: 248606 - DNA, 649 bp, Homo sapiens
  misc_feature: GYAE6OF02IH4H1.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacccttgtctttgtctccgaggggaagagcccaccctctcctgcgagggccagtcagagtgttggcagctacttagctggtaccaacagaacctggcaggctcccgagcctccgtcactctatgatcgacatcccgaacgacgggcctacgtggacactccccgagacccgtaggttacgaggtcggaccgagggtgtaacggttcggacggggtaacacgggtaccctttcgtaccttaccgtaccacccgtaattcccgaacggtaccgaacgtcccgtaagaccgtaccgttagtaaacgttattttcggactttaacgtttacttacgttgtacagtacgtaaacgtaatacgtcgccttcgcttccgtacgtttcggcggtaacggaccggtgggtacgacgagtaccggtaaacggacgttacggtacggtcctaggacctaccgtacgttcgtttacgttccgttactaccg

SEQ ID NO: 248607 - DNA, 703 bp, Homo sapiens
  misc_feature: GYAE6OF02IGJ99.47.64.F09.1.454.CMB.1.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagagctcacgtacacgaccggtgctcgatttagcgcgtatacaagggggagggaactgctcagttaggacccagagggaaccatggaagcccagctcagcttctcttcctcctgctactctgctcccagataccatcggagaagttgtgttagacacagtctccagccacctgtctttgactccgaggggaanacgcctaccctntcctgcagggccagtnaagaattatcactctactaggccaggtacaacagaactggcaggcctaccaggcctccacatactagtgatcgcttanccggaanacggcacgtttggaccatacccaaggcaaacgggtttcaaggtggccaaggtcggggtaactggggaacataaccttcgaacctttctacgggaaccaatccgaaggacgttacgaccgtacgacgtacttaacggtaaacgttacgttacgttaaattttaacgtaacgtttacgttaacgaacgtacgtaaggtacgttaagtacgttacgtcggttacccgttaccgtccgttaccgttacggtttaccggtaaccggggtaacgggtaaccgggtaagggtaacgggtagttaacgtaaacggtaaaccgtaaacgtacggttaaggtaccgtacgtaacctaccgttacgttaccgtttaacggtaccgttttaccgttaacgttacccg

SEQ ID NO: 248608 - DNA, 559 bp, Homo sapiens
  misc_feature: GYAE6OF02H4HE8.47.64.F09.1.454.CMB.1.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
  modified_base (343)..(343): a, c, t, g, unknown or other
  misc_feature (343)..(343): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaanagccaccctctcctgcagggccagtcagatattcactcctactgcctggtaccaacagaaacctggtcaggcctccaggctcctnatctatgatgcatccaagcgggccacgtggccatcccagacaggttcaggtgcaggtgggtcngggacagtacttcactctcaccatcagcacgactagcgacctaggaactacgtttaggtactttagttactgtactagtcacgtgtagtacgtcgtcggtcctccgtcctctacggtttcgggacgggtacgggacgtaggggtaggacgacgtacgaacggtacgtggtcggacttacgccgtacctcgttccgtgtaccttctaccgttacccg

SEQ ID NO: 248609 - DNA, 637 bp, Homo sapiens
  misc_feature: GYAE6OF02I7BS5.47.64.F09.1.454.CMB.1.raw
  modified_base (196)..(196): a, c, t, g, unknown or other
  misc_feature (196)..(196): n is a, c, g, or t
  modified_base (249)..(249): a, c, t, g, unknown or other
  misc_feature (249)..(249): n is a, c, g, or t
  modified_base (368)..(368): a, c, t, g, unknown or other
  misc_feature (368)..(368): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangccacctctcctgcaggccagtcagatatcactcctattagcctggtaccaanagaacctggtcaggctccaggctctcatctatgatgcatccaacacgggccactcggccatcccagtacaggttcagtggctagtgggtctagggacagtacttcgacttccgcaaccnttacacgtcacgccgtaagacgtactagaacgtacgtttaggtaactttagttaccgtacgtactaagtccgtaggtacgtgtacgttccgtcggcccgttccggacttaccgtaacccgttttcggggaccgggtaaacggggtacccggtaagggggtacgggtaacgtacgttaaccgaaaccggtaaaccgttagggtaccgggtacgttaccgaccgaacccgtacgttaccgttcggtaccttaggtaacccttttcccccgg

SEQ ID NO: 248610 - DNA, 751 bp, Homo sapiens
  misc_feature: GYAE6OF02JF0SX.47.64.F09.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
tcagagctcacgtacacgaccggtgctcgatttagcgcgtatacaaggggaggaactgctcagttaggacccagagggaaccatggaagccccagctcagcttctctcctcctgctactctgcctcccagataccatcggagaagttgtgttgacacagtctccagtcccaccctgtctttgctccgaagggaancgccacctcncctgcaggcctagtccagtagtgttaganagtcctattagtctcgggtaaccaagacgaaaccctggtaccaggcctcccgaacggccttacccgtcaacgttcgtacggggtactcggccaacgtacccaaacggcgggtacccggacgttacggaccaaccgttccccgaacgggcccgtaacgggttccgaacggtcgggtacccgtaagggttccgggggtaccgtacgggggtaccgaaacggttaccgttccgtaaaccgtccttaacccgtaacgtaccttacggaccgtcctaacggtacccgtaacgtaccggacccgttacggtaaacgttacgttttaacgacgtttaaggtttacttacgtacgttacgtaacgtacgtaaacggttaacttacgtaccgtacctaccggtacctacgtacgttcggaccgggtacgggtaccggtaggcggacgtagacgtaacgtaccgtaggtccgtagtccggaacctacgtacgttcgtaccgttactccgtacgttacccttacccgg

SEQ ID NO: 248611 - DNA, 729 bp, Homo sapiens
  misc_feature: GYAE6OF02IUCLY.47.64.F09.1.454.CMB.1.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccacctgtctttgctccgagggaaangccaccctctcctgcgagggccagtcaagaatattcactcctactacgcctaggtaaccaacgtaacgaaacctggtaccaggtccctccgaggtcctaccctnattctaagtgatcgactactacccaacgtacgggaccccaagttcgggacctaaccgttaccccgaaggtaaccgttaacggggtttccaagggttcggacccgtaagggttcggggtaccggtttacgggggaacctaacgggttaccctttccgaaccgttaccttaccggaaaccctagttacccgaacggttcgaaccgtaccgttaaacggcgtaccgtaggtaaacgtaccggtttaggtaactttatacgttctacgagtacgatcggtagtagtttccgcgtccgtccgtcttaccgtccgttcgggacggtacgggtaccgaaggggttacagggtactaccggtaaaacggtccgttagggtacggccgttacgacgtacccgtacgtttccgttacgtccgtttactacccgttccccg

SEQ ID NO: 248612 - DNA, 596 bp, Homo sapiens
  misc_feature: GYAE6OF02G0E8V.47.64.F09.1.454.CMB.1.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (357)..(357): a, c, t, g, unknown or other
  misc_feature (357)..(357): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaanagccaccctctcctgcaggccagtcagaatatcactctatagctgaccaanagaacctggtcaggctcccggntcctcatctangatgcatccaaacgacgggccactggcacgtcccagacaggttccagtcggcaggtcggtctgggacagacttcactcncaccgatcagtcagcctagacgtcctagaacgtacgtttaggtaactttagttactcgtaccaagtccgagtcgttacgtagtttccgtcgggcccttccggaccgttccgtaaccggtttccggggacgggtaacgggtacccgtaaggggtagacggacttaccgaaaacggtacgtacgggttgaccgtacgaccgaaccgtagtcgttaggcctttacacgtttcccgtaccccg

SEQ ID NO: 248613 - DNA, 571 bp, Homo sapiens
  misc_feature: GYAE6OF02G41VA.47.64.F09.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagngtgttggcagctacttagcctggtaccaacagaaacctggccaggcctcccgaggcctcctcatctatgatgcatccaacgngggccacgtggcactcccagcctaggttcagtggcagtgagtcgtgggacagtacttcacttctacacctatcagacacgacctagacgcctagaagtacgttaggtactttacgttacttgtactacgcgagtcgtgtagttcgtggtccctccgtctcgtaccgtttcgggacggtacgggaccgagggtggacgacgtaacgtaaacggtaccgtgggtacggtacgtcggaccgtacctacgttacgttcgttcttaccg

SEQ ID NO: 248614 - DNA, 650 bp, Homo sapiens
  misc_feature: GYAE6OF02FMARR.47.64.F09.1.454.CMB.1.raw
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcgggagaccctgtccctcacttgcattgtctcgtggtcggctccatccacctagtttttaattattgggtggggctggtactccgccacggcccccgaggggaggggctaggaagtggagttgggagttattagtttataagtgggactacttactttaacacctactccctagaacgngtcgtagttcatactcncanctagtcgtacgaagactctacttcctcctagtaaactgagtaccttgtcgtccgaccgcccgacacggacgtaccggtctttaggttttacttacgtggttaccgagtaacctagtcgacccggacgtaagacgtccgtaattcgcggtacgttacggtttacggttttaggagtttaacgggttggggtaaccgtaaggggtaaccgggtaacgggttaccctacccggttccggtacccgacggtaccgtcccgtaacccccgg

SEQ ID NO: 248615 - DNA, 548 bp, Homo sapiens
  misc_feature: GYAE6OF02FTZSZ.47.64.F09.1.454.CMB.1.raw
  modified_base (198)..(198): a, c, t, g, unknown or other
  misc_feature (198)..(198): n is a, c, g, or t
  modified_base (486)..(486): a, c, t, g, unknown or other
  misc_feature (486)..(486): n is a, c, g, or t
  modified_base (542)..(542): a, c, t, g, unknown or other
  misc_feature (542)..(542): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagatattcactcctacttagtctggtaccaacagaaacctggtcaggctcccaggctcctcatctatgatgcatcccaacgacggggccacgtggccactccccgagacaggttcaggtggcaggtggtcgtgggactagacttcactctcaccatcacgcacgtcctagcgcctagtaacgtactttcggtaactttacttactgttctagcagtcgtgtcgttcgtcggtcctcgctcgtacgttcggcggtacggtacgngggtaggagactacgaacgtacgtgtcggtcgtgcgactacgttctcgtcttacgnttcccg

SEQ ID NO: 248616 - DNA, 622 bp, Homo sapiens
  misc_feature: GYAE6OF02G878W.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaagagcccacccttctcctgcgagggccagtcagaatattcactcctacttagcctggtaaccaacgagaaaccctgggtcaggcctcccaggtcctcctcatctatgatgcatcccaccgacgggcccacgtcggtactcccaggtcccaggttcaggtcggcgtaggtgggtcgtggggacaggtacgttcacctctaccaccatccacggtacacgtcccgtgcctagttctaggtaagttattttgacttattttaacttactgttacagtactagttaactaatacgtcggtaccgttcgtacgttccggaccgaaggggtaccaaccggacgtaggtaagtaagttaaccgaacggttacggtaggtcggtacgtaccaactcgttactccgttacttccgtaacgttccgttacccgtacc

SEQ ID NO: 248617 - DNA, 714 bp, Homo sapiens
  misc_feature: GYAE6OF02JLC9J.47.64.F09.1.454.CMB.1.raw
tcagagctcacgtacacgaccggtgctcgatttagcgcgtatacaaggggcgtttctgagagtcatggatctcatgtgcaagaaaatagaagcacctgtggttcttcctcctgctggtggcggctcccagatgggtcctgtcccagctgcaactgcaggagtcgggcccaggactggtgaagccttcggagaccctgtcccctcacttgctattgtctcgtggtgctccatccacctagttttaatgttggtgggctggactccgccacgccccgagggagggctggaatggagttgggagtatattttagtaagtgggtacatactttaacaaccctactaccctacgaagagtcgtacgtttccagtactccgcagtacacgtacgagtaactctacttcctacctagaaacgtgaacgtcctacgttcgtcgacccgccgacgaacgtaccgacgggttcttaacgttttaacttaccgttggtttaccgaacgtaccgtaacgtcggtaaccccggtaaccggaacggtaacgacctttaaacgtttaacggtcgggttaacgtacgggttttaaaccgggttttgtaacgtttacggggttttaccgggggaacccgtaaaggggggtaacccgtaaaccggggttaccgtacccgggttacccgttaccggacccgttaacccggtccccgttaacccgaaacccggg

SEQ ID NO: 248618 - DNA, 655 bp, Homo sapiens
  misc_feature: GYAE6OF02GS9N5.47.64.F09.1.454.CMB.1.raw
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctattagcctggtaccaanagaacctggcaggctccaggctcctcatctatgatgcatcccaaacgcgggcccacgtcgggcccaccccgagacccgtaggttccaaggtcggacgaggtggacgttcggtagggaacacggtacttcgaccttctaccacctaagtcaacgcacgcccttaaggccgtacccgttaggaacgtttagttttacgacttaacgttttattaccgttgttactacgtacgtacggtaccgtaggtacctaacgttcgggtacccttaccgtaccgttaccggtttcggggaccgggtaacggggtaaccggaggggttacggacgtacgttacgaacggtaacggtaacgtcgggtacggtccgtacggcctacgtacgttccgtacgttccttactaccg

SEQ ID NO: 248619 - DNA, 810 bp, Homo sapiens
  misc_feature: GYAE6OF02GY75L.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcgggagaagttgtgttgacacagtctccagccaccctgtctttgtctccaggggaaagngccaccctctcctgcagggccagtcagaatattcactcctacttagcctggtaccaacagaaacctggtcaggcctcccaggctcctcatctatgatgcatacccaacgacggggcccaacgtcggaccactaccccgaagtaccgtagggttaccaagggttcgggaccgtaagggttcgggggtacctaggggggtaacctaacggtacccgtttacccgaaaccgtttccttaccccgaaaccccgtaacgttaccgaaacgggtacccgtaaaccggtaccccgttaaacgggtaaccgggtaccccgtttaacgggtaaaacggtttaccggtttttaacggggttaaccttttttaaaccggtttaccgtttacggttaccgttaacggccgttaacgggttacgttacgggttacgttttccggtccgggtaccccgttcccggtcctttaccgtaccgggttttcccggggaccggggtaaccggggtaacccggtagggggttacggaacgtacgttaaccggaaacggtacgttacggtacggggtaccttacggacctaacccgtacttaccggttacgttaccgttactccgttaccccg

SEQ ID NO: 248620 - DNA, 594 bp, Homo sapiens
  misc_feature: GYAE6OF02GJ5JZ.47.64.F09.1.454.CMB.1.raw
  modified_base (195)..(195): a, c, t, g, unknown or other
  misc_feature (195)..(195): n is a, c, g, or t
  modified_base (377)..(377): a, c, t, g, unknown or other
  misc_feature (377)..(377): n is a, c, g, or t
  modified_base (411)..(411): a, c, t, g, unknown or other
  misc_feature (411)..(411): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagagtgttggcagctacttagcctaggtaaccaacagaaaccctggaccaggctcccgaggcctcctcattctatggcgcatccagcgacgggcccagtggccactcccaagactacgttcagtcggcgtagtgggtctgggacaggacttcactcncacctatcagcagtactggactccgtagaagttntttgactagtagtaattacgtgtactaagtcgagttacgtaggaactcctaccctattccctacggtttccgacccgtacgggtaacccgtaaggttcggtacgtacggtaaccgtaaaccggtaacgttggaacggttcgtacggaccgtaacctacgttcgttcgttaccgttcgtacccg

SEQ ID NO: 248621 - DNA, 595 bp, Homo sapiens
  misc_feature: GYAE6OF02GRFL9.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagngccaccctctcctgcagggccagtcagaatattcactcctacttagcctggtaccaacagaaacctggtcaggctcccaggcctcctcatctatgatgcatccaaacgacgggccacgtggcactccccaagacagggttcaggtggctaggtggggtctaggggactaaggtacttcactctacacctatcagcacgcctagacgcctagaagtactttgaactttatactgtcagcgagtcgtgtacgttcgtcggtccctccgtctaccgttaccgtttccggggaccgggtaacggggacccgtaagggggtcggaacgtacgtaaccgtaaacggtacgttaggtacggtccgttcgacctaccgtagttccgttcgttctttctacttcccg

SEQ ID NO: 248622 - DNA, 678 bp, Homo sapiens
  misc_feature: GYAE6OF02IVT8Z.47.64.F09.1.454.CMB.1.raw
  modified_base (194)..(194): a, c, t, g, unknown or other
  misc_feature (194)..(194): n is a, c, g, or t
  modified_base (257)..(257): a, c, t, g, unknown or other
  misc_feature (257)..(257): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctccagataccatcggagaagttgtgttgacacagtctccagccacctgtctttgcctcgaaggggaaancgccaccctctcctgcgacgggccagtcaagaatattcactcctaacttagcctggaaccaanacgaacctgtcaggcctccaggtctacctcatctatgatcgacataccaagacggccacgtcgctactcccaagactaggttcaggtcggcaggtcgggtactgggaacacggtacttcgactcctacgaaacctagtacgagaccgtagtacctaaggacgtacgtaggaacgtttaccgttagtaacttttaacgtacgtgtacgacggtactacggacggttggtacgttccgtcgggtacccttcccgtaccgttacccggtacggtttacccggggagggtaaccggggtacgaaggggggttacgaaacgtccgttaaaccggaaaacggttacccggttgggacggttaccgttacggacccgtaaccgttacggttccgtttaccggttaccttacgttacccgtttccccgg

SEQ ID NO: 248623 - DNA, 810 bp, Homo sapiens
  misc_feature: GYAE6OF02I3GI1.47.64.F09.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttattttgacacagtctccagccaccctgtctttgtctccgaggggaaangccaccctctcctgcaggtcagtcagngtgtgacagctacttagtctggtaccaagacgaaacctggaccagggcctcccgagggtcctacctcacgtcggtgggtactcggcctaacgtcccgaaacggacggggtcccacgtcgggaccctacgtcccccgaaggtccccgtaagggtttccgaacggggttcgggacgtacgggttacgggggttaccgtacgggggaaccgtaacggtaccctttacccaaccggtttccctacccggaaccctagttaacccgaaccgggtaccgaaccgggtaacccgttaaccgggtaccgtaccgttaacgggtaaacgtttacggtttttaccgacgttttaaacctttaacgttttaaccgtacggttaccggtacgtaccgtacggtacggttaaccgaccgtaacgtccgggtcccttacgttacccgtaccggtttaccggggacgggtaccggggtaccgtacgggggtacgacggtacgtaccggtaacggtaaccggtaacggttacgggtacggtaccgtcggacccgtaccggtacgttccggttacgtttaccgttaccgtaccgtttccccgg

SEQ ID NO: 248624 - DNA, 593 bp, Homo sapiens
  misc_feature: GYAE6OF02IU7JP.47.64.F09.1.454.CMB.1.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagccctggtacccaanacgaaacctggtcaggcctcccaggcctcctnatctatgatgcatccaacgcgggccacgtggccactccccagaccagggttcaggtggcaggtggggtctgggacaggtacttcgactctcacctatcagccagcctagacgcctagaacgtacgtttaggtactttattactcgttcagcgacggtcgtagtacgttcgtcggccctccgtctccgtacgtttcgggccgggtacgggaccgtaggggtcgaagtacgtaccgaaacggtacgttacgggtacggtacgtcggaccgtacctacgttaccgtggttaccttcgtaccttcccg

SEQ ID NO: 248625 - DNA, 558 bp, Homo sapiens
  misc_feature: GYAE6OF02HIN69.47.64.F09.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccaggggaaanagccaccctctcctgcagggccagtcagaatattcactcctacttagcctggtaaccaanagaaacctggtcaggctcccgaggcctcctcatctatgatgcatccaacgacgggcccactggccactcccagactaggttcaggtgcgaggtgggtctgggacagtcttcactctccaccatccagcagcctagcgctgaacgtctttaggactttattactgtacgagctaggtcgtgtacgttcgtcggtccctccgtctaccgtaccgtttcgggaccggtacgggaccgaggggtcgagagtacgaaacggtactggtagcgtgaccgacgtatccgtacgttcttctacttcccg

SEQ ID NO: 248626 - DNA, 698 bp, Homo sapiens
  misc_feature: GYAE6OF02G6RA9.47.64.F09.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaangccaccctntcctgcagggccagtcagaatatcactcctacttagcctggtaccaanacgaaacctggtacaggcctcccgaggtcctcctcattcctaatcgaattcgctaactacccaacgacgggacccaacgtcggcctacgtaccccgaagaaccgttagggttaccgaaggttcgggacctagggttcggggtaccgtcggggaactacggtaacctttccaacgttcctaccgaacccgtatccgaacggtaccacgaccgtacggacgtacccgtaaggtaaacggttaccgtttagggtaaccttttaagttaccgtagttacacggttacgacgtcggtacgtacggtttcgcgtcccgttccgtcttacgttaccggttcgggacggtacgggtacgacggggtaggaactacgtaaccgaaacggtaacgtacgggtgaacgttccgaaccgtactacgttcgttccgttaccgtttcgaccgtttccccg

SEQ ID NO: 248627 - DNA, 677 bp, Homo sapiens
  misc_feature: GYAE6OF02GZREN.47.64.F09.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (283)..(283): a, c, t, g, unknown or other
  misc_feature (283)..(283): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggagaaatagtgatgacgcagtctccagccacctgtctgtctctcgaggggaangccacatctcctggtagggccgtnaggtagtattagcatcaacttgcctggtaccagcagagacctgggcaggctcccgaggtcctccncatctatgatgcactccaacgagggccagtggctacgtccccaggcctaggtttcaggttcggactagtgacgtcgtaggggactagacttcgacctcctacaccactcgacgacacgtcctagacgtcctaggaacgttacgttttacggactttaacgttttaactttacgttacgttaccgtaaggtacccgtagggtacccggttaacgtacgtaaaccgtttaccggtccctttaccgttaccgttaccgtttttaaccggggccggggtacggggtaaccggtaacggggggtttacgggaacggttaacggtaaccggtacggtaaaccggtaaccggttacggggttaccgggttaccggtaacggttacccgaacccgtttacgg

SEQ ID NO: 248628 - DNA, 568 bp, Homo sapiens
  misc_feature: GYAE6OF02HF5YN.47.64.F09.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggctcccagataccactggagaaatgtgatgacgcagtctccagccaccctgtctgtctctccgaggggaangccaccatctcctgtagggccgtnagagtatagcatcaacttagcctggtaccagcagagacctgggcaggctccaggctcctcatctatgatgcgtccacgagggccacgtcggttcccagcctaggttcagtggacaggtggtctgggacagagttcactcacaccatccagcagtcctagcagtctacgaagtatttgacttaatttattaacgttgttcaagtctagtaacttaataacgtcgtcctcgtcttccggaccgtaacgggacctaacgtacgtacgggagtaacgttaaaccgtaacgttaggtacggtaccgtacgtaccgtacctacgtccgttacggtacctttaccgtacttccccg

SEQ ID NO: 248629 - DNA, 614 bp, Homo sapiens
  misc_feature: GYAE6OF02HN3SU.47.64.F09.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctntccngcagggccagtcagaatattcactcctacttagccttggtaccaacagaaacctggtacaggcctccaggcctcctnatctatgatgcatccaaacgngggccagtcggccactcccagactaggttcaggtcggcaggtcgggtctgggactagtacttcactctacacatcagcagctagacgctagaacgtacttgtactttattacgtgtacacgtcaggtcgtagtacgttccgtacggtcccttccggccttaccgtacggtttccgggaccgggtacgggtaaccggtaggggttacggacggtacgtaacggtaaaccggtaacggttagggtacgggtaccgtaccggaccgtacctacgttccgttacgtttaccctttacctaccgtttccccg

SEQ ID NO: 248630 - DNA, 525 bp, Homo sapiens
  misc_feature: GYAE6OF02G8TMH.47.64.F09.1.454.CMB.1.raw
  modified_base (195)..(195): a, c, t, g, unknown or other
  misc_feature (195)..(195): n is a, c, g, or t
  modified_base (374)..(374): a, c, t, g, unknown or other
  misc_feature (374)..(374): n is a, c, g, or t
  modified_base (441)..(441): a, c, t, g, unknown or other
  misc_feature (441)..(441): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcagggccagtcagagtattagcatcaacttagcctggtaccagcagagacctgggcaggctcccaggcctcctcatctatgatgccgtccaccagggccactggtttcccagccaggttccagtggcagtgcgtctgggacagagttcactctcaccatccaacncgcctgcagtctagaagtattttgacttagtttattacttgtcagtcaaacgtaatactgccctccnctctacgtttcggcggacggccgagggtcgacgagtagaacgacgtgtcggcttgacaccgtatcctggtccttcgacttcccg

SEQ ID NO: 248631 - DNA, 606 bp, Homo sapiens
  misc_feature: GYAE6OF02G9Q1J.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatatcactcctacttagcctggtaccaacagaaacctggtcaggcctccaggcctcctcatctatgatgcatccaacgcgggccacgtggacactcccagactaggttcaggtcggcgtaggtgggtctgggacagtacttcactctacaccagtcagcacgaccgtagacgtcctaggaacgttacgtttaggtaacttttacgttacgtgttacgtacggtctaacggtccgttaggtacgtttccgtcgggtcccttaccggtccgtacgttaccggtttcgggaccgggtacgggtaccgtaggggtacgagtacgtacgaaacggtcgtcggtaggctcggactaccgttgtaccgtcgttaccttcgccttacccg

SEQ ID NO: 248632 - DNA, 524 bp, Homo sapiens
  misc_feature: GYAE6OF02JCZLC.47.64.F09.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (514)..(514): a, c, t, g, unknown or other
  misc_feature (514)..(514): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagagtgttggcagctacttagcctggtaccaacagaacctggccaggctcccgaggcctcctnatctatgatgcntccaacgcggccactggcactcccagccaggttcaggtggcagtcgagtcgtgggacaggtacttcgactctacaccatcagcacgcctagacgccgtagtaatatttcgctacgtttattacttagtcacgcagcgttacgcgtactcgcctctcgtacgttcggcggtacgggaccgtagggtgacgagtcgagacgtaacgtgtggcgtgaccncgactctgtc

SEQ ID NO: 248633 - DNA, 627 bp, Homo sapiens
  misc_feature: GYAE6OF02IY6EM.47.64.F09.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactctacttagccttggtaccaacagaaacctggtcaggctccaggctcctnatctatcgatgacctataccaaacgacggcccaacgttcgggaccaacttccccaaagaccgtaggtttaccaaggttcggcctaaggtcggggttactgggggaccaaggtaccttacgacttctacgaccattcgaagctaagcctagagcccgtagaagtacgtttgaactttatacgtgtactagctacgcgttagagttccgtggtccctcggtacctcgtaccgtttcgggacggacgggaactacggggtacgtagtacgtaccggaaacgtaacgtcgggtacggtccttacggaccgtaaccagttccgttcggttacctttactacgttaccccg

SEQ ID NO: 248634 - DNA, 702 bp, Homo sapiens
  misc_feature: GYAE6OF02HZ2MM.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccacctgtctttgtctccgaggggaaanagccaccctctcctgcagggccagtcagaatattcactctacttagcctggtaccaacagaacctggtacaggcctccgaggctcctcatctaatgatgctactaccaaacgacgggcctacgtcggcaacgtccccaaggaccgtagggttacaggttcggcgaaggttcgggtcgtaaggggactaggtacctttcaaccgttctacaacccattccgaagcctaacgcgtacgacgcctaggaacgttactttacgggtaactttattacgtgttacgtaggtacgtacggtcgttacggtacggtttaccgttcggggttccccttaccggttacccgtttaccgttaacccgggttttcggggaccggggtaaccggggtaaccgggtagggggttacgacggttaacgtacccgggtaaaacgtaaccggtttcgggtacggtccgttaccgaccgtacccgttgttaccggttacgttcgttaaccgtcccgtttccccg

SEQ ID NO: 248635 - DNA, 708 bp, Homo sapiens
  misc_feature: GYAE6OF02HNYB1.47.64.F09.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagagctcacgtacacgaccggtgctcgatttagcgcgtatacaagggggaggaactgctcagttaggacccagagggaaccatggaagccccagctcagcttctctcctcctgctactctggctcccagataccatcggagaagttgtgttgacacagtctccagccaccctgtctttgtcctccgaggggaaancgcccaccctctcctgcgacgggccagtcagngtgttggcagctacgttacgcccgttagtaaccaagacgaaaccgtggacccgaggcctcccgaggcctcctacgattcctatgatcgacctaactaccgaacgacggccctaagtcggcctaacctccccgagtcccgaaggttccgaggtcggacgtagtgtacgtcgtagggactacgtacttacgtacctcgtaaccaccgtagtccgaacgccgaacgtaccgtaacggacgtaccctagtaacgttacgtttcggaaccttttaactttacgttaacgttcgtacgtacgtacgtaacggtaccgtaacggtaacctacggttaccggtcccttccgttaccgttaccgggtttccggggaccggtaacggggtaccggtaggggtacggaacggttacgacggaacgggtaccggttaacgtcgggttaccgcggtacggaccctaaccggttcgtacccttagtttacccg

SEQ ID NO: 248636 - DNA, 799 bp, Homo sapiens
  misc_feature: GYAE6OF02I30F1.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggagaaatagtgatgacgcagtctccacgccacctgtctgtctctccgaggggaacncgccaccatcctcctggtacgggccgtagagagtattacgctactcaacttcgcctaggtaccagcaagacgaccgtgggaccacggtcctccccgagggtccttccgtactacgtactagtacggcttcggccccgttacccaaccggtggggacccctccgtttaccggtttccccacggtcccttaaggttccgacgggttcggacgtacggttcggtccgggttacggcgggggtaactacggggtacctttccgaacccgttttcgacccgaccttaacgttacccgaacgtaccgtcccgttacggacccgtaaaggtttccggtaaacggttaggttttacgttttacggaaccttttagggttttaaacctttcggttacgttactaagtccgtaagttacgttaactaacgttaccggtccggtaccttcccgttaccttaacccgggtttccggaaacccggttaacggaccgtaaccgggtagttaaccggggtaacgttaaaccggttaaacggttaaccggtggtttaccggtaacgtcccggtaacccttaacccggtaattcccggttttacggttacccttaaccg

SEQ ID NO: 248637 - DNA, 733 bp, Homo sapiens
  misc_feature: GYAE6OF02HB2L9.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaangcccaccctctcctgcagggccagtcagatatcactcctactagcctggtaccaacagaaacctggtacaggcctacccgaggcctcctcatctatgatgacactaccaacgcgggacccacgtggacctactccccgaagaccgtagggtttccaagggttcgggacctagggttcgggggtacctagggggaacctaaggtaaccctttcaaaccttcctacccgaaccctaagttaccgaacgtaccgaacggtacccgtaaggaccgtaccgttaggtaaacgttacgttttagggtaaccttttagttacgtcgtacgacggtctacggtcgttacgtcgttaccggtcggtcccttaccgtccttacgtaccggttttcggggaccgggtacgggtaaccggtaggggttacggtacggtacgttaaccggaaaacgggttaccggttacgggttacgggtaccgttaccggtacccgtaaccgttacgtttaccggttccgtttacccgtttacgtacccgtttaccccgg

SEQ ID NO: 248638 - DNA, 557 bp, Homo sapiens
  misc_feature: GYAE6OF02FPH93.47.64.F09.1.454.CMB.1.raw
  modified_base (378)..(378): a, c, t, g, unknown or other
  misc_feature (378)..(378): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttatttttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcaggtggtctgggacagacttcatctcacatcagcagcctagnctgagactttggtactttatactgtcagtcagcgtgtagttctcggcctccgtctcgtactttcgggcggagggtacccgagggttacggagtacgtacgaaacggtacgtaggttcggacttacgcctaaccgtacttcggttacgttccttaccgtacttcccgttccccgtacccg

SEQ ID NO: 248639 - DNA, 627 bp, Homo sapiens
  misc_feature: GYAE6OF02H59ZQ.47.64.F09.1.454.CMB.1.raw
  modified_base (388)..(388): a, c, t, g, unknown or other
  misc_feature (388)..(388): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcacctagttttaatagttggtggggctggatccgcacgcccccgagggaagggctggaatggattgggagtatattttataagtggggactactctttacaacccatccctcaagacgtcgagtttccatactccgcagacacgtccgagaatcacttcnccctagaaactgatctctgtcgaccgccgacacgacacggtcttagttttacttacgttcggtttacgacgtactagtcggacccggacgaacggacgcgtaagtttacgtccgggtactaagggtttacggtttttggaagttttaggtttcgggggaaccgtaaaggggtaaccgtaacggggttaccgaacccggttcgtaccccggacgtacggtacccctccgtaaaccccggg

SEQ ID NO: 248640 - DNA, 584 bp, Homo sapiens
  misc_feature: GYAE6OF02F17E2.47.64.F09.1.454.CMB.1.raw
  modified_base (198)..(198): a, c, t, g, unknown or other
  misc_feature (198)..(198): n is a, c, g, or t
  modified_base (452)..(452): a, c, t, g, unknown or other
  misc_feature (452)..(452): n is a, c, g, or t
  modified_base (528)..(528): a, c, t, g, unknown or other
  misc_feature (528)..(528): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaccaacagaaacctgggacaggcctccaggctcctcatctagtggtgcactcccaccgacgggccacgtcggtactcccgagcccgtaggttcaggtcggacgtaggtggggtacgtggggacaggtacgttcactctacacatcagcacgcctgctacgtcgtagtaagttatttgacttaatttattacgtgttacagtntaagttaataaacttaccgtcggtaccttcgtcgtaccggaccgaaggacctaacggcgtagagtaacgttaacgngtaggtcggtctacgactacctatctacgttcttactactcccgttaccgcctacg

SEQ ID NO: 248641 - DNA, 722 bp, Homo sapiens
  misc_feature: GYAE6OF02G1G0J.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccaccctgtctttgtctccgaaggggaaagcgccacctctcctcgcacgggccagtcaagaatatcactctacttacgcctggtaaccaacacgaaacctggtcacggcctccgaggtcctcctcattcatgatgtcactaccaacgacggccagtgacacgtcccaaggactacggttcaggtcggcgtaggtcgggtacgtacgggactacggtacttaccacgtaccttacacgtataccgacgcgacgaccgtaggaccgtcgttacggaacgttacgtttacgttacgttttaactacggttcgtacgtaccggtattaacggtcgttacgttaacggtttccgtccgggttaccccttacccggttacctttacccggttaacggttttacccggggaccgggggtaacggtaccgggttaacgggggtcggttaaaccggtttaaccggaaaccggttaacgggttcggttaccgggtaccgtccggttaaccgtaacccggttattccgtttacgggtacctttcccggtacttaccccttccccgg

SEQ ID NO: 248642 - DNA, 577 bp, Homo sapiens
  misc_feature: GYAE6OF02HJL7F.47.64.F09.1.454.CMB.1.raw
  modified_base (349)..(349): a, c, t, g, unknown or other
  misc_feature (349)..(349): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (435)..(435): a, c, t, g, unknown or other
  misc_feature (435)..(435): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggacgaccctgtccctcacttgcattgtctctggtgctcatcactagttttaattagttgggtgggctggatccgccgacgcccccgaggggaacgggctaggaatgggattggggaagttattatttataagtgggacacttctttacaaccctatccctanaagagttcgagtttccatactccgcagctacgaccgagaactcncttccncctagaactgatctctgtcgacccgtcgacagaccncgcttagttttacttcgtgttacgagctagtcgccgacgaganctaatcgtcggntaggttacgtttagagtttacggttcggggaccaaggggtacgaacgggttccgaccgttccgccgcgacgtccctaccgaacccgg

SEQ ID NO: 248643 - DNA, 646 bp, Homo sapiens
  misc_feature: GYAE6OF02J0K8B.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggctcccagatacccaccggagaagttattttgacacagtctccagccaccctgtctttgtctccaggggaaanagccaccctctcctgcagggtcagtcagagtgttgacagctacttagtctggtaccaagacgaaacctggcctaggcctcccaggcctcctgatcgtgggactgcatcccgaagagggcccgctcgggacctacctcccccaaggcccgtaagggtttccaggtcggccaggttcggggtctaggggaccaggtaacctttcaacctctacaaccctatccaggccagtccctagacgcctaggaaagttactttgcgttaagtttacttaaccgtgttaccaagtacctaaacggttaaataccgtgtccctaccgtacttaccgtacgtttccggacgggtaacggacgtcgggtacgacgtagtacgaaacgtacgtagtcggtacgtacgacctaccgtagtaccgttcgtaccgttaccgagtttcccttacccggcttaaccg

SEQ ID NO: 248644 - DNA, 612 bp, Homo sapiens
  misc_feature: GYAE6OF02GNM24.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccaggggaaangccaccctctcctgcagggccagtcagaatattcactcctattagcctggtaccaacagaacctggtcaggctccaggctctcatctatgatcgcataccaactagggccacgtggacactccccagactagggttcaggtcggacaggtcgggtctaggggacacggtacttccaactctaccgaacctagtccaacgtcacgacctaaggacgccgtagaaacgttaccgtttagggtaactttaagttaccgtgtacagctagtcgtagtacgttcgtcggtcctccggtcttcgtacgtttccgggaccgggtacgggtaccgaggggtcggacgtacgttacgaaaccggtacgtcggtacggtacgtcggacctaccgtactccgtagttaccttaccgtacgttaccccg

SEQ ID NO: 248645 - DNA, 602 bp, Homo sapiens
  misc_feature: GYAE6OF02F2HB6.47.64.F09.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (391)..(391): a, c, t, g, unknown or other
  misc_feature (391)..(391): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccatctcctggtagggccgtnagagtattagcatcaacttagcctggtaccagcagacgacctgggcacggctcccgaggcctcctcatctatgatcgcactaccaacgcgggccacgtcggactactcccgagccgtaggttcaggtcggactaggtgagtcgtagggacagtactcactctacaccntcagcacgcctagacgtctagtaagttactttgacttactttaacttacttcgttacacgtcgaggtacggttacgacgtaaccgtcggtacccttcgttaccgttaccggttccgggtacgggtaccgggtacgggagggtaggacgtacgtacgaacggaaccgtaacgttcgggcggtcgtccggtacctaccgttacgttcgttccg

SEQ ID NO: 248646 - DNA, 554 bp, Homo sapiens
  misc_feature: GYAE6OF02GWMSR.47.64.F09.1.454.CMB.1.raw
  modified_base (196)..(196): a, c, t, g, unknown or other
  misc_feature (196)..(196): n is a, c, g, or t
  modified_base (324)..(324): a, c, t, g, unknown or other
  misc_feature (324)..(324): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatgcatccaacagggccagtggcactcccagacnggttcagtggcagtgggtcngggacagtcttcnctctcacatcagcacgcctagcgtcctagaagtatttgcttagtttactacgtgttcagacaacgttaatcgtggccctccgctcgtaccgtttcgggcggtaacgggaccgtagggtacgacgtagtacgaaacgtacgtggtaggactcggtaccaccgtattccgttacgttcttcgtacttcccgttaccccg

SEQ ID NO: 248647 - DNA, 828 bp, Homo sapiens
  misc_feature: GYAE6OF02I1U91.47.64.F09.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtcctccgaaggggaaanagccacctctcctgcagggtcagtcagtagtgtnacagtcttacgttagtctacggtaaccaaagacgaaaccgtggacccacggccctcccgaacgggtcccttccctataacttccgttaatgtaagttcgacctaacgttaccccgaaaacggacggggtcccctaaccggttcgggaaccctaaccgtaccccccgaagggtacccccgtttaaggggttacctacgggggttcgggtaaccggtacgggtttacggtaaccgggttacccggtttaaggggggaaacccttaacggtttaaccctttaccggaaccgtttaccctaccgaaacccttaacgtaccgaaccggacgtaacgtacccgtaacgtaccgtaccgttaacgtaaagtttacgtttacgtacgtttaaccgttttacttacgttacgttacgtacgtacgtagtaccgtacgacctacgttacgtcccttaccgttacgttaccgtttaccgggacgggtacgggtaaccgggtaaggggtacggtaacggtacgtacggtaacgggtaaccggtaacgttcgggttacggtccgttacggtacctaccgtacgtacgttcgttaccttaccgtacccg

SEQ ID NO: 248648 - DNA, 674 bp, Homo sapiens
  misc_feature: GYAE6OF02H2BVQ.47.64.F09.1.454.CMB.1.raw
  modified_base (194)..(194): a, c, t, g, unknown or other
  misc_feature (194)..(194): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccaggggaanagccaccctctcctgcagggccagtcagaatattcactcctacttagcctggtaccaacagaaacctggtacaggctccaggctcctcatctatgatgctactaccaacgacgggaccacgtggaccacgtaccccgaagacctagggttcaggttcggctaggtcggggtcgtgggacagtacttcaactcgtacacctatcgacgccgacgccgtagacgtcctaggaaacgttacgttttagggtaacttttaacgttacgttagttaccgaacggtctaacggtccggttagtacggtttccgtcgggttccccttacccggtccttccgttaccggttttccgggaccgggttaacggggaccgtaagggggtacggacgtaacgttaccgtaaaacgggtacgtcggttcggtaccgttacgtacccgaacctaacgttccgttacgtttacccgtttacgaccgttttccccg

SEQ ID NO: 248649 - DNA, 599 bp, Homo sapiens
  misc_feature: GYAE6OF02HA7JL.47.64.F09.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaancgccaccctctcctgcagggccagtcagagtgtggcagctacttagctagtaccaanagaacctgcagcctccagcctctnatctatgatgactactaccaacgcggtccacgtcggcctactccccgagtcccgtaggttcaggtcggactaggtcgaggtcgtagggaactacgtaccttacacgtcctaccactacgtcgacgtccacgtacctaagctaccgtaggtaacgttacgtttcgacttacttttagttaccgtgtacgacgcgtacgtacgtacgacctacgtcgtcctacgtcgtacgttcgggacggtacgggaccgagggtgaagtcgtacggaacgtaccggtagtcgggtacgccgttacgaccctacgtacgttaccgtcgttaccg

SEQ ID NO: 248650 - DNA, 550 bp, Homo sapiens
  misc_feature: GYAE6OF02HPQQW.47.64.F09.1.454.CMB.1.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccaggggaaanagccaccctctcctgcagggccagtcagaatattcactcctacttagcctggtaccaacagaacctggtacaggctcccaggctcctcatctatgatgcatccaacngggccagtggcactcccgagactacggttcaggtcggctaggtgggtctgggacaggtacttcactctacactatcagtcgacgcctagacgcctagaagtagtttgacttagtttatactgtacagactaacgtaatacgtcgcctccgctactacgttcggacggacgtacgaggtcgacgtagacgtaacgtacgtggtcggactggacctacgtacgttctacgtcttactactcccttacccg

SEQ ID NO: 248651 - DNA, 634 bp, Homo sapiens
  misc_feature: GYAE6OF02F3KC1.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangccaccctctcctgcagggccagtcagaatattcactcctacttagcctggtaccaanagaaacctggtcaggctcccaggctcctcatctatgatgacactcccgaaacgacgggcccacgttcgggacctacgtccccaaggtaccgtagggtttacaggtgggacctagggttacggggttcgtaggggaaccacggttaccttcaccgttcctccaacctacgtacacggtcacgtccgtaggacgtcctaaggaacgttacgtttcggtaacttttattacgtagtcagctaggtcgtagtacgttcgcgtcctccgcttcgtaccggtttcgggacggacggtacggagggtacgagtacgtaacgaaaccggtacgtcgggtcggacttcgaccgtactacgttccttacggttcctttacacgttccccg

SEQ ID NO: 248652 - DNA, 671 bp, Homo sapiens
  misc_feature: GYAE6OF02GVEEO.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaaggggagggaactgctccagttaggacccagagggaaccatggaagcccagcgtcagcttctcttcctcctggctactctggctccagataccatcggagaagttattttgacacagtctccagccacctgtccttgtctccgagggaacncgcctacctctcctgcaggccagtcagatgtgcagctacgtacgcctggtaccaagagtaaacctggacctaggcctcccgaggacctccgtacactcgtatgaactggaccacttaccaacgacgggccacgtcggacctactcccaagtcccgtaaggttccaacggttggcctaaggtgtaacggtcctaggggacaacggtccgtttacaccgttctaccgaacctagtttccgaacgacgacgtaccgtagacgtcctagaacgtacgtttacggtactttaagttacgttacgttcgagtacgtacgtcgtacgtacgttcgtacggtacctccgtacttacgtaccgtttccgggacggtaccggtaccgtacggggttacgacgtaacgtaaccggaaacggttaacgtcggtacggtaccgttacggacccgtaccgtacgttccgtacgttcccgttacttaccg

SEQ ID NO: 248653 - DNA, 842 bp, Homo sapiens
  misc_feature: GYAE6OF02ILWTL.47.64.F09.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
tcagagctcacgtacacgaccggtgctcgatttagcgcgtatacaagggggaggaactcgctcagttaggaccccaggagggaaccatggaaggccccagctcacgcttctcttcctcctgctactctggcttcccagactaccgaccggagaagtttattttgaccacagtctccagccacccttgtctttgtctccaggggaanagccaccctctcctgcagggtcagtcagtagtcgttgacancttaccttaggtcttggtaccaagagtaaacccgtgggccaagggtccttccccgagggtccctccccgttcgaacttcccgttagggggaacttcggaccctaacgttaccccgaaaccggtacgggggaccccgtcgttaccggggacctaaccgttacccccgaacggttccccgtaaacggggtttctaacgggtcgggtaccgtacgggtcggggtttccgtacggggaacctaacgggtacccttttcgaacccgttccggttacccaacgtaccttccgaacggacctacggtaccctaaggacgtacccgtaggaaaccgttcgttttacgggtaactttttacgttaccgtaggttcccagtcggaagtccgggttacgtaacggttttcccggtacggtccccgtttaccggtcccgttaccggttaccggttttcccgggggtacggggtaaccgggggtaccgtaaggggggtttccgggaagtaaccggtaactaacccgggacgttacgggtcgggacccgttacggacccgacgtttacgtcggttcttaccggtttcaccgtttcccgtacccgtaccg

SEQ ID NO: 248654 - DNA, 563 bp, Homo sapiens
  misc_feature: GYAE6OF02HAXKG.47.64.F09.1.454.CMB.1.raw
  modified_base (197)..(197): a, c, t, g, unknown or other
  misc_feature (197)..(197): n is a, c, g, or t
  modified_base (439)..(439): a, c, t, g, unknown or other
  misc_feature (439)..(439): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagccaccctctcctgcagggccagtcagaatattcactcctacttagcctggtaccaacagaaacctggtcaggctcccaggctcctcatctatgatgcactccaacgacgggccacgtggccactccccgagactaggttcaggtggcaggtgggtctgggacagacttcactctcacatcagcacgacctagacgcctagaagtatttcgacttactttactactgtacagcagtcgtanacaacgtcggtacctctacgtacgtttcgggacgggtacgggacgtagggtacgagtagtacgaacggaacggtacgtcggtggtaccgtacgaccacgtacttacgtcgtttacttactaccg

SEQ ID NO: 248655 - DNA, 722 bp, Homo sapiens
  misc_feature: GYAE6OF02GM7K0.47.64.F09.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaaggggaaangcccaccctctcctgcagggccagtcagaatattcactcctattagcctggtaccaanacgaaacctggtcaggcctccgaggcctcctcatctatgatgcactaccaacacgggccacgtgcctactcccaagactacggttcaggttcggacgtaggtcggggttcgtggggaactacggtacttcacgttcctacaaccctataccgagacctacggtacccgtaagaccgtacccgttaagaaacgttaaccgttttacgggttaacttttacgttacgttcgtacgtacggtacgtacggtcgtacggtacgtttcggtccggtcccgttacccgtccgtttaccggttaccggttttaccgggggaccggggtaacggggtacccggtaaggggggttacggaaccggttaaccgttaaaccgggtaaaaccggttaacggggttacggtaccgggtacgtacccgtaaccgtacgtaccttacggttccgtttacctttaccgtcccgtttaccccg

SEQ ID NO: 248656 - DNA, 702 bp, Homo sapiens
  misc_feature: GYAE6OF02HI6ZJ.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgcctccgaggggaangccaccctctcctgcagggccagtcagaatattcactcctacttagcctggtaccaanagaaacctggtcaggctcccaggctcctcatctatgatgccatacccgaacgtacgggccctaacgtcggaccacgtccccaggaccgtagggttcaggtcggacgtacggttggggtcgtagggacctaacggtaccttcaccttccgtaccaacccgtatccgaacggcctaacgtacccgtaggaacgtcccgttaaggtaaacgttacccgttttagggttaacctttttaacgttacgttacgttcgaacgtccgaggttaccgtagtacggtttccggttacggtccccgttccgaccgtttaccgttaccggttttccggggaccgggtaacggggtacccggtagggggtacggtacgtacgtaaccgtaaacggtaccgttagggtccgtacgtcgaccgtacgttacgtcgttaccggttcttaccgtactttccccg

SEQ ID NO: 248657 - DNA, 745 bp, Homo sapiens
  misc_feature: GYAE6OF02JY2H1.47.64.F09.1.454.CMB.1.raw
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
  modified_base (488)..(488): a, c, t, g, unknown or other
  misc_feature (488)..(488): n is a, c, g, or t
  modified_base (657)..(657): a, c, t, g, unknown or other
  misc_feature (657)..(657): n is a, c, g, or t
tcagagctcacgtacacgaccggtgctcgatttagcgcgtatacaaggggaggaactgctcagttaggacccagaggaaccatggaagccccagctcagcttctcttcctcctcgctactctggctcccagataccatcggagaagttgtgttgacacagtctccagccaccctgtcttgtctccaggggaaanagccacccctctcctgacgacggccacgtacaagtaacttacttacacctttacccttaagttaccgtcccggtttacggaaacccaaacgtaacggtaaccgttcggtacctaacgggtccctaccggagtccctcctatacttctagtagtacncggtacctactacccgaaccggtaacggccctacggtacggaccttaaccgcccaaacggtacgtacggttagaccggttggaccgtggtttcggtaccggagattaccgtactctattcccgaccacgtactcgganccctaacgtcgtaacgccgtacgttacggtaagtttcttacggtacctttaacgtttactacgacgttaccgagtaccgagttaccgacaaccgttaaccgcggttaccctagttacccgttacgggttacgggaccgggtaacggaaaccgggtggtgtaaacccgtntaaccgggtaacggaacggtttacgtccggtacggtaccgtacggaccttacggttactttccggttagttacccgttacctacccgg

SEQ ID NO: 248658 - DNA, 556 bp, Homo sapiens
  misc_feature: GYAE6OF02GAJF2.47.64.F09.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (315)..(315): a, c, t, g, unknown or other
  misc_feature (315)..(315): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccaggggaangccaccctctcctgcagggccagtcagngtgttgacagctacttagtctggtaccaagagaaacctggaccaggcctccccgaggcctcctcatcgtgggatgcagtcccaacgacgggccncgtggccacgtcccaggcctaggttcaggtggcaggtgggtctgggacagtacttcactctcaccatcagcacgcctagacgctagaagtatttgacttactttatacgtgtcagcagtacgtacgactacgtcggtctctctacgtttcgggacggacgggtaccggaggggtagacgagtacgaacggtaacgtacgtggtcggacgtcgaccgtacctacgtcctcgttccttctacc

SEQ ID NO: 248659 - DNA, 692 bp, Homo sapiens
  misc_feature: GYAE6OF02JKFUD.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccacctgtctttgctccgaaggggaaancgcccacccttctcctgcgacgggccagtcaagtaatacttcacctcctacttacgcctggtaaccaacagaacctggtacaggcctcccgaggcctcctcatctatcgatcgacactccaacgacgggcctaacgtcggcctactacccgagtacgtacggttacgaggtcggactaacggtcggggtactcggggaacacggttaccttacgaccttaccgtacctaaccgtactacgacggtacaccggtacgtaacgacgtaccgtaacgtaacggttacgtttacggtaactttaagttaccgtagtacgtacgacgtaggtcgtgttacgttcgtacggtcctccggtactcgtaccggtttcgggaccgggtaacgggtaccgtacggggtaggtaacgtacgtaaccgtaaaccggtcgttacgggtacggtaccgtacggacgtaacccgttacgtcgtttcgtacccgttacgtaccgttacccg

SEQ ID NO: 248660 - DNA, 570 bp, Homo sapiens
  misc_feature: GYAE6OF02F36J7.47.64.F09.1.454.CMB.1.raw
  modified_base (196)..(196): a, c, t, g, unknown or other
  misc_feature (196)..(196): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
tcagagctcacgtacacgaccggtgctcgatttagcgcgtatacaagggggaggaactgctcagttaggacccagagggaaccatggaagcccagctcagcttctcttcctcctgctactctggctcccagataccatcggagaagttgtgttgacacagtctccagccaccctgtctttgtctccgaggggaaancgccaccctctcctgcagggccagtcagactgttaactcaactacttagcctggtaccagcaacaactggaccaggcctccaggctcctcatctagtcgcgcactccagcgagggccacgtggcactcccgagaccacgttcgagtcggactaggtcgggtcgtggggactaggtacttcgactctacacctatccagccgacgtacgtcggacgcctagtaagttagttttacgacttactttattacgtcgtacacgactagtcgtagactaacgtcggtcctctcgtaccgtttacgggcggtacggacgagggtaggagtcgtacgacgacgtaagtcggtacggtntcgcacgtntcgttcgtacttcg

SEQ ID NO: 248661 - DNA, 616 bp, Homo sapiens
  misc_feature: GYAE6OF02IBSGP.47.64.F09.1.454.CMB.1.raw
  modified_base (200)..(200): a, c, t, g, unknown or other
  misc_feature (200)..(200): n is a, c, g, or t
  modified_base (272)..(272): a, c, t, g, unknown or other
  misc_feature (272)..(272): n is a, c, g, or t
  modified_base (582)..(582): a, c, t, g, unknown or other
  misc_feature (582)..(582): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtcctccgaaggggaaancgccaccctctcctgcacgggccagtcagaatattcactcctattagcctgaccaacagaacctgtcaggcnccagctcctcatctatgatgcactccaacgcggccagtggcactcccagacagttcaggtgcaggtgggtctagggacagtacttcacgtctacgacctatcagaccacgacctaggacgtccgtaggtaaacgttaccgttttagggtacttttaaacgttcgttcgtaccgagtacaacggtcgtaggttacgttccggttcgacccgttccggtaccttccgtaaccggtttcgggaccgggtacgggaccggtaggggtgactacgttaaccgaaacgtacggttcggacggtctacggacctacncgttaccgtcggttaccttacgtaccgttccccg

SEQ ID NO: 248662 - DNA, 595 bp, Homo sapiens
  misc_feature: GYAE6OF02H3YSW.47.64.F09.1.454.CMB.1.raw
  modified_base (450)..(450): a, c, t, g, unknown or other
  misc_feature (450)..(450): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
tcagagctcacgtacacgaccggtgctcgatttagcgcgtatacaagggggctttctgagagtcatggatctcatgtgcaaagaaaatgaagcacctgtggttcttcctcctgctggtggcggctcccagatgggtcctgtcccagctgcaactgcaggagtcgggcccaggactgggtgaacgccttcggacgacccctgtcccctcacttgctattgtctctggtcgctccatcacttagttttaatagttgggtgggctggactccgccacgccccgaggggacgggctaggatggagttgggagttattatttagtagtgggtactacttactttacaacctactccctagaagtacgtcgtacgtttccatactccgacacgtacacgtacgaagtaactctacttcctcctagtaactgactctcgtgcgaccgcgacacgacncgtcttgtttactcgttgtacgngacagtcgaccgacgngagctatcgcggactagttcgtttagaagttcggttaacgggaccgtaagggtaaccgtacggtacctaccggtccgtacccggcgtaccgccctaccgaacccgg

SEQ ID NO: 248663 - DNA, 649 bp, Homo sapiens
  misc_feature: GYAE6OF02JCSNB.47.64.F09.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccgaggggaaangccaccctntcctgcagggccagtcagaatnttcactctatagcctggtaccaanagaacctggtcaggctccaggcctcctnatctatgatgctatccaacgacggccaagtggacacgtcccaggacctaggttaccagtggctaggtcgggtctaggggaccacgtacttcgaacttcaccgaacctatcccgaaggacctaacgtcccgtaaggaaccgtccgttaagtaaacggttaccgttttagggtaaccttttaagttaccgtagttaccgaacgtaccgaaggtcgttcgtaacgttccgtcggaccttccgtacgttccgtacgtttccgggacggtacgggaccgtaggggtcgtaacgtacgtaaccgaaacggtcggtacggtcggtacgtacggtacctaccgttacgttccgtacgttccttaccgactttaccccgg

SEQ ID NO: 248664 - DNA, 788 bp, Homo sapiens
  misc_feature: GYAE6OF02HN2BF.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaacctggtcaggctccagctcctcatctatgatgactactacccgaaacgacggggcctaacgtcggggaccctaacgttaccccccgaaggtaacccgtagggttttaccaaggggttcgggacgtagggtttcggggggttaccgttacggggggtaacctaaggttaacccgttttaccaaaccgtttccttaaccgaacccctaagttaaccgacggtaccctaacggtacctaacggtaccggacccgttagggtaaaccgttaccgttttacgggttaaacttttaacgtttaccgttacgtacgtaacgtcacgggttacgtagttacggtttccgttaccgggtcccttcccgtacgttacccgtaccggttttccgggaccgggtaaccgggtaccgggtaagggggttcgaacgggtaacgtaacccggtaaaaccggtaacggttacggtcgggtaaccgttacggtaccgtaccgttacgttccgttaccggtttcctttaccgtacctttacccccgg

SEQ ID NO: 248665 - DNA, 677 bp, Homo sapiens
  misc_feature: GYAE6OF02GXWSO.47.64.F09.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangccaccctntcctgcagggccagtcagaatnttcactcctattagcctggtaccaacagaaacctggtcaggctcccaggctcctcatcatgatgcactccaacgacgggccaacgtgggaccacgtccccaagacctaggtttcaggttggctaggtgggtcgtagggactaggtacttcaccgtctaccgacacgtacgacggactacgaccgttaagccgtaccgtaagaacggttacgttttagggtaaccttttattaaccttcgtaccgtaggtacgtaacgtggttaacaccgttaaccggtcggtacccctttacgtaccggttacccgttttacggggaccggggttaacggggtacccggtaggggtagggtaaccgtaggtaccgaggtaacccgtaaggtcgggttacgcgttacgacccgtaaccgtacgttaccggtcgttttaccgttcgtaccgtttaccccccg

SEQ ID NO: 248666 - DNA, 704 bp, Homo sapiens
  misc_feature: GYAE6OF02FVPAA.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatattcactcctacttagcctggtaaccaacacgaaacctggtacaggcctcccgaggccttcctcatctatgatgcatccaacgacgggcccacgtcggacacgtcccaagtacctaggttcaggtggactaggtcgggtctaggggactaagtaccctttcaaccttcctaccgaaccctataccgaacggtcctaaccggtacccgttaaaggaccgtacccgttaagggtaaacggttaaccgttttacgggtttaacttttaacgtttaccgtacgttaccgaacgtccgtaacggtcggttacgtacggttttaccggtccgggtccctccgtccgttaccgttaccggtttccgggaccgggtaacgggtaccggtaggggttacggaacgtacgtaaccgaaacggtacggttacggtcgggtacgtccgaccgtaccgtagttccgttcggttccttacgtacttccccg

SEQ ID NO: 248667 - DNA, 790 bp, Homo sapiens
  misc_feature: GYAE6OF02GG41P.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgttctttgtctccgaggggaaangccaccctctcctgcagggccagtcagaattattcactcctacttagcctggtaacccaacacgaaacctggtacacggcctcccgaggcctcctcattctaatgactcggactacgtacccaacgacggggaccctacggtacggaccaactaccccgaaggtaacccgtagggtttaccgaagggttcgggaccgttaagggttcgggggttaccgttaggggggaacctaacggttacctttaccgaaaccctttccgttaccctaaaccctacgttacccgaaggtacccgtaacgtacccgtttaaacggaccggttacccgttaagggtaaacggtttaaccgtttttaggtaaaccctttttaagttaacgttcgttaccaggtaccgtagggtccgtgggtttacggttccgttacgggtaccccttccggtaccttccggttacggtttccggggaacggggtaccgggtaccgggtaggggtacggaacgttaacgtaaccggtaaaccgggttacgtacgggttacggaaccttggaacctaacgtcgttcgtaccggtttctttacccgtacgttccccg

SEQ ID NO: 248668 - DNA, 730 bp, Homo sapiens
  misc_feature: GYAE6OF02GM7DM.47.64.F09.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (294)..(294): a, c, t, g, unknown or other
  misc_feature (294)..(294): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtcctccagccaccctgtctttgtctccgaggggaaancgccaccctctcctgcagggccagtcagaatntcactcctacttgcctggtaccaacagaaacctggtcacggtcctccaggtcctcctcatctancgtatgcactccaacgacgggacccacgtggacctacgtccccgaaggaccgtagggtttaccagggtcggtacgtagggttcggggtacgtacggggactagggtaaccttctaaccggttctccgaacctacgtcgaaccgctacggtcctaaaggcctaccgtaacggtaaacgttaccgttttcggtaaaccttttagttacctacggttaccgacgtaaccgtcggtcggtttacggtacggtttccgtccggtccgttacccgtccggtttccttaacccgggttcggggtaccgggtaacggggtacccgttagggggtacggtaacggtacgttaacggtaacggttaacgggtaacgttcgggtaacggtaccgttacgggtaccctaaccggtagtttcccttacggttttaccgcgtttaccccg

SEQ ID NO: 248669 - DNA, 567 bp, Homo sapiens
  misc_feature: GYAE6OF02FORMJ.47.64.F09.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctgtcctgcagggccagtcagaatnttcactcctattgcctggtaccaangaaacctggtcaggctcccaggcctccnatctatgatgcatccaacgngggccacgtggcactcccagtaccagggttcaggtcggcaggttcggggtctggggacctaggtacttcgaacttctacacctatccgagccagcctagacgcctagaacgtactttaggactttattactgtacagacagtcgtgtagttctggtcctccgtctccgtacgtttcggacgggtacggtaccgagggtcgagtacgtacgaaacggtaacgtggtacggctacgaccgtactacgttccgtagttcttacacttcccg

SEQ ID NO: 248670 - DNA, 629 bp, Homo sapiens
  misc_feature: GYAE6OF02H5P1E.47.64.F09.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (314)..(314): a, c, t, g, unknown or other
  misc_feature (314)..(314): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccacctgtcttgtctaccgaggggaanacgccaccctntcctgcagggccagtcagaatattcactcctatagcctggtaccaacagaacctggtcaggcctcccaggcctcctcattctatgatgaccataccaagcgggaccncgtgccactcccagacgtaggtaccaggtcggcgtaggtcggggttacaggggtacaggtacccttcgaacctctaccgacctacgtacacggtaccacggtacctaggaccgaccgttaaggaaacgtttactttgggtaacttttagtacctagttacgagtacaggtccgttagtacgttccggtcgtcccgtaccgtcgtttccgtacgttcgggaccgggtcgggaccggtaggggttacgattaccggaaccgtaagtcgttaggtcgacgttacgcctagtaccttccgtgttacttctacgttcccg

SEQ ID NO: 248671 - DNA, 738 bp, Homo sapiens
  misc_feature: GYAE6OF02IZN6V.47.64.F09.1.454.CMB.1.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (389)..(389): a, c, t, g, unknown or other
  misc_feature (389)..(389): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccgaggggaangcccaccctctcctgcagggccagtcagaatattcactcctattagcctggtaaccaatagaacctggtcaggcctacccgagcctccncatctatgatcgacactccaacgacgggtccacgtggaccactacccgaagaccgtagggttccaggtacggccaggttggggtacctagggactacgacccttanacccttcgtaccaccgtactacgacgcaacggtccgtaacgtacggacccttaaggaaccggtttacgttttacgggtaacttttaacgttacctacggttactaacgtaccgtaaggttccggttaacggtacggtttcccgttacgggttacccgttacccggttaccgttacccgtttaacccggtttaccggggacccggggttaaacggggtaacccggtaacggggtaacggtacggtaaacggtaccgtaaaaccgggtaacgttaccgggacgggttacctaccgggtacctaaccgttacgttaccgtcgggttaccctttcggtaaccctttcccccgg

SEQ ID NO: 248672 - DNA, 524 bp, Homo sapiens
  misc_feature: GYAE6OF02G1F5A.47.64.F09.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaaggggaaangccaccctctcctgcagggccagtcagaatatcactcctacttagcctggtaccaanagaaacctggtcaggctccaggctcctcatctatgatgcatccaacgagggccactggcactcccagacaggttcagtcggctaggtgggtctgggacaggacttcgactctcacatcagcagctagcncgtgaagtacgttagactttattactgtacngcagtcgtgtgttcgnggcctcgctcgtacgttcggcggtacggacgagggtagagactacgaacggtactgggtacgctgtccacgtgttcctgttcttacacttcccg

SEQ ID NO: 248673 - DNA, 745 bp, Homo sapiens
  misc_feature: GYAE6OF02JRV0G.47.64.F09.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgttctttgtctccgaaggggaaangccaccctctcctgcagggccagtcagaatactcactcctacttagcctggtaaccaacagaaacctggcaggcctcccgagtcctcctcatctangtatcgcaatccaacggacgggccacgtcggccaactcccagtacgtaggttaccgaggtacggcctagggtcggtacgtagggggacctaagggtaacccttcgaacccttcaccgtaaaccccgtagtccctaaacgggaccgaaccgtacccgtaaggaaccggtaccgtaaagggtaaaccggttacgttttacggttaaaccctttttaagtaaccgttagtaccgtagttacgtacggtcggttaacgtacgtttccggtaccggtccctacgtaccgtttaccgtacggtttcccgggaacgggggtaccggtaccggtagggggtacgtaacggtaccgtaaccggtaaaaccggtaccgggttggtaccgggttacaccgggtacccgtaaccgttcggttaccggttccgtttaccgtttacctaacccggtttccccg

SEQ ID NO: 248674 - DNA, 639 bp, Homo sapiens
  misc_feature: GYAE6OF02FLCGF.47.64.F09.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccgaggggaaangccaccctctcctgcagggccagtcagaatattcactcctacttagcctggtaccaanagaaacctggtcaggctcccgaggcctcctcatctatgatgacataccaacgaggggcccaacgtgggaccacgtaccccaaggtaccagggtttcaaggtggcgtaggttcgggtctaggggactacgtactttcgacttcgtccaaccatccgagcacggtacctaaggacgtcctagaacgttactttaggtactttatactgtacagctaggccgttgacgtttcgcggtccctccgtcttaccgtaccggtttcggaccgggtaacgggtaccgtaggggttacgagtacgtaccgaaaaccggtacgtcggtacgggtaccttcggacccgtaacctacgttaccgttcggtttaccctttaccgacttttacccccgg

SEQ ID NO: 248675 - DNA, 638 bp, Homo sapiens
  misc_feature: GYAE6OF02IBKRM.47.64.F09.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctccagataccatcggagaagttgtgttgacacgagtctccagccaccctgttcctttgtcctccgaaggggaaancgccaccctctccgngccgagggtccagtacgagtaattattcaacttcctacttagcctcggtaacaacagaaactgtacaggactaccgaggcctcctataactcagttgacgttcgactaataccgaaacgacgggcctaactcggacactcccgaagtacgtacggttcaggtcgcgtaggtcggggtacggaacagtactacacgtacacacacgtccagacacgtccgtaagacgaccgtagtaaccgtaacgtttaggtacctttaagtacgtagtactacgtcgagtcgtactacgtcgtccgtacttccggactccgtaagttcgggacggtacgggccgagggtacgtacgagaacgtaacggtcgtaacggtacgtcggtacaccgacttaggtccttagttacctcgtaccttcccgttacccg

SEQ ID NO: 248676 - DNA, 721 bp, Homo sapiens
  misc_feature: GYAE6OF02G5NLF.47.64.F09.1.454.CMB.1.raw
  modified_base (201)..(201): a, c, t, g, unknown or other
  misc_feature (201)..(201): n is a, c, g, or t
  modified_base (481)..(481): a, c, t, g, unknown or other
  misc_feature (481)..(481): n is a, c, g, or t
tcagagctcacgtacacgaccggtgctcgatttagcgcgtatacaagggggaggaactgctcagttaggacccagagggaaccatggaagccccagcctcagcttctcttcctcctgctactctggctcccagataccatcggagaagttgtgttgaacacaggtctccgagccaccctgtctttgtctccgaggggaaanagccaccctcgtcctgcacggccagtcaagaatagttcactcctacttacgtccgtaggtaccaacacgaaacctggtcacggcctacccgaggcctcctcatcgtactgatgacatccaaacgcgggcctaacgtcggacctacgtaccccgaagacgtacggttccgaggtcggcgtagggtcggggtcgtacggggaacacgtaccgttactaccgttacctaccaccgtaactacgacggtaccgacgtacccgtaagacgtccgtagtaacgttntttacgacttaagtttactacgtcgttacgtacgtaaactaacggttaaacttccggtcggtaccctaccgtaccgttaccgtaaccgggtttcgggaaccgggttaaccgggaccggttaacggggtacgtaacgtaacggttaacggtaaaccggttacggtcgggtaacggtaccgtacgaccctacgttacgttccggttaccgtttaccgttacctacgttaccccgttaccccg

SEQ ID NO: 248677 - DNA, 767 bp, Homo sapiens
  misc_feature: GYAE6OF02JIABR.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagatatcgccggagaattgtgttgacgcagtctccaggccaccctgtctttgctccgaggggaaancgccaccgtctcctgcgagggccagtcagtgtgttggcagcaactcttagcctggtaccagcagaaactcgtcggccaaggcctcccgaggctccgtactattttacgtggtaacattaaccgaaccgacggggaccctaacgttcgggacctaacgtacccccgaaggaacctacggttaactttccgaagggtacccggaccgtaagggtttcggaacggtttccgtagggggaacctaacgggttaacccgttttaccgaaccctttccgttaacccgtaacccgtaacttaccgtaaccggaccgtaaccggacccgttaaagggaccgtaccgttaagtaaacggttaccgttttacggtaacttttttaacgttaaccgttcgtttaaccgacggtactaggtcgtacggttaacgtttcgtacggtcccgttccgtacgtttccgtaccggtttacgggaccgggtaacgggtaccggtacgggtagggtacgaacgttaaccgaaacggtacgttcgggtaccggtcgttacggacccgtactaccgttcgttaccgtttaccg

SEQ ID NO: 248678 - DNA, 604 bp, Homo sapiens
  misc_feature: GYAE6OF02I0ZG3.47.64.F09.1.454.CMB.1.raw
  modified_base (203)..(203): a, c, t, g, unknown or other
  misc_feature (203)..(203): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
tcagagctcacgtacacgaccggtgctcgatttagcgcgtatacaagggggctttctgagagtcatggatctcatgtgcaagaaaaatgaagcacctgtggttcttcctcctgctggtggcggctcccagatgggtcctgtcccagctgcaactgcaggagtcgggcccaggactggtgaagccttcggagaccctgtccctnacttgcattgtctctggtggctccatcacctagttttaatattggtgggctggatccgccagccccccaggggagggctggaatggattgggagtatattttagtaagtggggacacgtctttacaaccgactccctcaagagtcgagtttccatatcccgcagacacgtccgaagaactcacttctccctagaaactgaacgctctgtcgaccgccncagacaccggnttagtttattactgttacgatacattgaccgacgagacgctaattagtccggtacaaggtttacggtttagaagtttaacgtttggggacccgtaaagggggtaaccgtaaaggggttcctaaccggtaccgttacccgaccgtaccgtaccccgtacccgtaaaccccggg

SEQ ID NO: 248679 - DNA, 680 bp, Homo sapiens
  misc_feature: GYAE6OF02FNGW9.47.64.F09.1.454.CMB.1.raw
  modified_base (197)..(197): a, c, t, g, unknown or other
  misc_feature (197)..(197): n is a, c, g, or t
  modified_base (314)..(314): a, c, t, g, unknown or other
  misc_feature (314)..(314): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagacattgttttgacacagtctccagccaccctgtctttgtctccgaggggaaanagccaccctctcctgcagggccagtcagagtgttggcagctacttagcctggtaccaacacgaaaccgtggaccaggcctcccgaggcctcctcactctatgatgacataccaacgngggccacgtcggactactcccaggtacctacgggttcaaggttggacgtacggttcggggtcgtgggggaacctaggtaccctttaccgaaccttcctaaccgtaccctaacgttccgaacgtaccgaccggtacccgtaaaggaccggtacctaacgggtaaacgtttacgttttacgggtaacttttaacgttacgtcggttacgaagtacgtaggtcgttagtacgtttccgtcggtcccttccgcttccgttacggttccggggacgggtaacggaccggtaggggtgaacgtacaaccgtaaacggtcgtggtcggacgtcgacctacgtacgtccgttacgtaccttacgtacttccccg

SEQ ID NO: 248680 - DNA, 773 bp, Homo sapiens
  misc_feature: GYAE6OF02IXSX9.47.64.F09.1.454.CMB.1.raw
  modified_base (174)..(174): a, c, t, g, unknown or other
  misc_feature (174)..(174): n is a, c, g, or t
  modified_base (469)..(469): a, c, t, g, unknown or other
  misc_feature (469)..(469): n is a, c, g, or t
tcagagctcacgtacacgaccggtgctcgatttagcgcgtatacaaggggggaggaactgctcagttaggacccagagggaaccatggaagcccagctcagcttctcttcctcctgctactcgtcggctcccagataccatcgggagtaagttgtcgttgaactacacgttccnccagcccacccttgttcctttaggtcctaccggaagggggaaagacgtcccacccttcttcctcgacgacgggcccaggtacaagtaattacttccgacttaccttaacgttacgcccgttagaaccaaacaagtaaacccgtggtacgaacggtcctaccgaggtcctacctccataccgtatcgatcacaccgtaccaacggcgggaccctacgtacggccaactacccgacgacgttacggttaccgagtcggactaagggttccggacgtcgggaactcggttacctaacnccttcactaaccctagaccagggacctaagaccgtagaccgtcgtaagtaacggttacgtttagttaacctttacttacgtacgtaacgacgtacgtacggtacgttcgtacggttaaccgtccggttacccgtccccgtaccgttaccgggtttaccggtacccgggggttaaccgggaccgggggtaaccgttagggggggtaaacctaggtaaccgtaaccggtaaacccgggttaggtaacggtcggttcgaacgtcccgtaacgtcgtttactcggtttacctacgttaccttaccccg

SEQ ID NO: 248681 - DNA, 580 bp, Homo sapiens
  misc_feature: GYAE6OF02F86BO.47.64.F09.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (514)..(514): a, c, t, g, unknown or other
  misc_feature (514)..(514): n is a, c, g, or t
  modified_base (557)..(557): a, c, t, g, unknown or other
  misc_feature (557)..(557): n is a, c, g, or t
  modified_base (565)..(565): a, c, t, g, unknown or other
  misc_feature (565)..(565): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctcgtcctgcaggccagtcagaatnttcactcctacttagcctggtaccaacagaaacctggtcaggcctcccaggctcctcatctatgtatgcatcccaacgcgggaccaacgtggacactcccagacgaggttcagtggcaggtgggtcgtgggacaggtacttcactctccaccatcacgcacgaccctaggacgtcctaggtaacgtacgtttaggtacttttaataccgtgttaacagcctaggcgttaggtacgtttccgacggtccctccggcttaccgtcgtttcggggcggtacgggtaccgnggggtacgatacgtacgaaacgtacgtggcgcgtagccacgtntcccgttnttcctactcgttccc

SEQ ID NO: 248682 - DNA, 575 bp, Homo sapiens
  misc_feature: GYAE6OF02FNZBT.47.64.F09.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (318)..(318): a, c, t, g, unknown or other
  misc_feature (318)..(318): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
tcagagctcacgtacacgaccggtgctcgatttagcgcgtatacaagggggaggaacgtgctcagttaggacccagagggaaccatggaagccccagctcagcttctcttcctcctgctactctggctcccagataccatcggagaagttgtgttgacacagtctccagcctaccctgtctttgtctaccgaggggaaangccaccctntcctgcagggccagtcgagagtgttgcagcgtacttacgcctggtaaccaacgagtaaacctggacccaggtcctcccgaaggctcctcatctatgatgcatccgaacncgggaccacgtggcactcccgagccgtagttcaggtgacagtgagtcngggacagtcttacactcncaccatcagcganctagacncctagaacgtatttggacttactttactactgtacacgtctagtcgtagcgaatcggaccttctcgttaccgttcgggacggtacgggtaccgtagggtcgaggtacgtgggaacgtacggtaacgttggtacggtacctggtaacccgtctacggtttcctacgtttccg

SEQ ID NO: 248683 - DNA, 566 bp, Homo sapiens
  misc_feature: GYAE6OF02G5E0M.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccagggggaaangccaccctctcctgcagggccagtcagaatattcactcctacttagcctggtaaccaacagaaacctggtcaggctcccaggctcctcatctatgatgcatccaacagggccatggcatcccagccaggttcagtcgcagtgagtctgggacagtacttcactctacaccatcagcagcctagacgtctagtaagtatttacgactactttattacttgtacagtcacgcgtaacgctaaccgtcggtcccttacttaccgtacgtttccgggacgggtacgggtaccgtaggggtacggacgtacgtacgacggaaccggtaacgtgggtacgcgtacggacctaccgtatccgtttacgtcttaccg

SEQ ID NO: 248684 - DNA, 688 bp, Homo sapiens
  misc_feature: GYAE6OF02IQIUN.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaagngccaccctctcctgcagggccagtcagaatatcactcctacttagcctggtaccaacacgaaacctggtcaggcctcccgaggtcctcctcatctatgatgcactaccaacgcgggccacgtcggaccactcccagtacaggttcgaggtcggcgaggttcgggtcgtaggggaacctaggtaccttcgactcctaccaacccgtatccgacgcctacgtacccgtaaggaacgtcccgttaaggtaaacggttaccgttttacggttaaacctttttaagttaaccgttcggtacgtaacggtcgtacggtccggttagggtacgtttccgtccgggtacccgttccggtcctaccgttaccgggtttcggggaccggtaacggggtaccggtagggggttacggaacgtacgtaaccgaaacggtcgtacgggtaggccgtacgaccgtacctagttcccgttaacggttcccttacgtacttccccg

SEQ ID NO: 248685 - DNA, 691 bp, Homo sapiens
  misc_feature: GYAE6OF02F6LMP.47.64.F09.1.454.CMB.1.raw
  modified_base (196)..(196): a, c, t, g, unknown or other
  misc_feature (196)..(196): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (653)..(653): a, c, t, g, unknown or other
  misc_feature (653)..(653): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagatattcactcctacttagcctggtaccaacagaaacctggtcaggctccgnggcctcctcatctatgatgactacnccgaacgacgggcccaacgttggacctacttacccccgaaggtaccgtaggttttacgaggttcgggaccgtagggttcgggggttaccgttaggggaaccaggtaacctttcgaaccttcctacccactacgtaccgacgacaaccggtcctaggaccgtcccgttaggtaaacggttacgttttacgggtaacctttttaaggtacctaggttctaacggactacgggttccgtagtacgtttccgtaccggtcccgttccgtacttccgttacggtttccggggaccgggttaacgggaccggtagggggtacgtaacggtagtaccgtaaaggccgtttaggacgggtcncggactcgtactcgtacggttccttacgcctttacccg

SEQ ID NO: 248686 - DNA, 622 bp, Homo sapiens
  misc_feature: GYAE6OF02FRDW3.47.64.F09.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaaangccaccctctcctgcaggccagtcagatntcactctatgcctgtaccaanagaactgcaggctccagctctcatctatgatgcactaccaacgacgggcccacgtcggacacgtacccgagacgtaggttcaaggtcggactaggttcggggtacgtggggacctagtaccttcacgtctaccgaccctatacgacgctacgtccctaagccgtactaggtaacgtacgtttaggtaaccttttagtaccgtagttaccaaggtctacggtcggttagtacgtttccggtcggtcccttccggtccttaccggttaccgtttcgggacgggtacggtaccggtaggggtacggacgtacgtaccgtaaaccggtcggtggtacggtctaggactacggtctacgttcgttacggttacctcgtaccg

SEQ ID NO: 248687 - DNA, 683 bp, Homo sapiens
  misc_feature: GYAE6OF02JXMEF.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggagggaactgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagatattcactctactagcctggtaccaacacgaactgtcagctccacgctcacatctatgtatgacactacacgacggtccacgtcggcactaccagacgtaggtacgtagcggtacgaggttcgggtacgtagggacgacgtacgtctaccgtactccgaacccgtactacggaccgtacgtacgtaccgtaacggaccgtaccgtaggtaaacggttacggtttcggttaaacgttttacttaaccgtacggtacctacggtacctaacgggtaccgtaacggtacctaaccggtacggttaccctaccgttaccgttaccgggttccggtaccggggtaaccggtaccgggtaggtacgggaacgtagtacgtacgaacggttaccggtaggttaccggacggttaccgacgtaccgtaacgttccgtttacgttcggttaaccttccgttacccg

SEQ ID NO: 248688 - DNA, 735 bp, Homo sapiens
  misc_feature: GYAE6OF02GUY6M.47.64.F09.1.454.CMB.1.raw
  modified_base (135)..(135): a, c, t, g, unknown or other
  misc_feature (135)..(135): n is a, c, g, or t
  modified_base (173)..(173): a, c, t, g, unknown or other
  misc_feature (173)..(173): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagagctcacgtacacgaccggtgctcgatttagcgcgtatacaagggggaggaacgtgctcagttaggaccagagggaaccatggaagccccagctcagcttctccttcctcctgcctactctggctcccagntaccatcggagaagttgagttcgacacagtcctaccanccaccctgtcctttgactccgaggggaaangcccaacccgtctccngcgagggtccagtacagaatattccaactccctagttaacgcctggaaacccctaanagtaaacctaggtcaggctcccgaggctccgtacatcctatcgatgtacacttaccaacgaggacccacgtacgcatacccngacctaacgttcgacgtcggacnggtcggtccgngggtanaccggtactacgtctaccgttcacccgttanacgacgtcgaaccgccgtaacgtacctacggttaaccgaacggttaacgtttacggttaacgtttagttaaaccgttcgttaacgttacgaccgttacgaccgttagtacgtttccgttacgtcccgtccgtacccgtaccgttaccgtttacggtacccgggtaacggtaccggtaacgggggttcgtaaccggacgttaaaccggaaaccgttaaaccgggacgttacgggtaaacgtttccggaccgtaaccggttacccttacggttaacgtttcccgttacggttaccctttaaccccggg

SEQ ID NO: 248689 - DNA, 648 bp, Homo sapiens
  misc_feature: GYAE6OF02H1162.47.64.F09.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccacctgtctttgtctccgaggggaaancgccaccctctcctgcagggccagtcagaatattcactctacttagcctggtaccaacagaacctggtcaggctcccaggctccncatctatgatgcatccaacgngggccacgtggcactcccagacnggttcaggtgctaggtggggtctagggacaggtacttcgactctacacctatcgagcacgtcctagacgtcctaggaacgttacgtttaggttaactttagttacttgtacgtagtcgtaggtcgttaggtagtttaccgtcggtacccgttccgtaccttccgttaccggtttccggggaccgggtaacggggtaacccgtaagggggttacggaacggtaccgtaccggtaaaacggtccgttacgggtcgggtacgttacggacccgtaaccttacggttcccgttaccggtttacctttaccgtaccgtttacccccg

SEQ ID NO: 248690 - DNA, 716 bp, Homo sapiens
  misc_feature: GYAE6OF02HKVER.47.64.F09.1.454.CMB.1.raw
  modified_base (144)..(144): a, c, t, g, unknown or other
  misc_feature (144)..(144): n is a, c, g, or t
  modified_base (203)..(203): a, c, t, g, unknown or other
  misc_feature (203)..(203): n is a, c, g, or t
  modified_base (419)..(419): a, c, t, g, unknown or other
  misc_feature (419)..(419): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagtatccacgganacatttgtttgacacagtcctccagccacccttgtcctttgtcctccgaagggggaaancgcccaccctcctccgtagcgacggggccagtccaagtaaattcttcacttcctacgttacgcccttaggtaacccaaacaaggtaaacccgtggtaccgaacgggtccctaccccgaggtccttcccctacgaactttcctaagtggaattcgactaactacccaaacgcggtaccacgtcggctaacctcccaaggactacgggttactacggnggaccgtaggtcgggttcgaggggaactgaaccgtttcaaccttctaccaaccngttaccgancgtttanacgtagacgtccagtaagtcttaggttacttattacgttcgactacgacgtgtacgtagtcgtcgtccggtaccttccggtaccttccggtccgttaccggacgggaacgggtacccgggagggtaacggtagaaccgtaaccgaaccggttaacgtcgggtacgtccggtcgaaccctacggtaactttccgtccggttacttccgttaaccttcgttaccccccg

SEQ ID NO: 248691 - DNA, 638 bp, Homo sapiens
  misc_feature: GYAE6OF02G8E4X.47.64.F09.1.454.CMB.1.raw
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccagggactgggtgaagccttcgggagaccccttgtcccctcacttgctattgtctctggtgctccatccactagttttaatgttgggtgggctggactccgccacgcccccgaggggagggctggaagtggagttgggagtattatttagtaagtggggactacttactttaccaacctactccctacaagagtcgtacgtttaccatacgtccgacagacacgtccgaagaactcgtaccttcctaccctagaactgacgtctcgttcgtcgacccgtccgacgacgaccgacggtcttagttttacttacgttcgttacgaggacctagtcggacccggtacgacgacgaccttagttaccgtacggacttagggtttacggtttagtacgttaggtttcggggaccgtaaggggacgtaacgggtccaccggtccgtaccgcggtaccgtcccgtaccgtaacccggg

SEQ ID NO: 248692 - DNA, 641 bp, Homo sapiens
  misc_feature: GYAE6OF02JAFUO.47.64.F09.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagatacccatcggagaagttgtgttgacacagtctccagccaccctgtctttgtctccgaggggaaangccaccctctcctgcagggccagtcagatattcactcctattagcctaggtaccaacagaaacctggtcaggctcccaggcctccncatctangatgctactccaacgacgggccactggccactcccagacaggttcagtgacagtgggctgggacagtacttcgacgttctacgacctatccgaagctaacgcctaaggactccgtagaacgtacgtttaggaaccttttaagttaccgtacggtacgtaaccgtcgtaacgtacgttagtaacgtttccgtcggtacccttacccgtccgttaccgtaaccggttttccggggaccgggtaacggtacccgtaagggggtcgaagtacgttaccgaaacggttaacgtggtacgggacttacggacgtaacccgtagttcccgtaggttaccttaccgacgtttaccccg

SEQ ID NO: 248693 - DNA, 715 bp, Homo sapiens
  misc_feature: GYAE6OF02IH28J.47.64.F09.1.454.CMB.1.raw
  modified_base (264)..(264): a, c, t, g, unknown or other
  misc_feature (264)..(264): n is a, c, g, or t
  modified_base (323)..(323): a, c, t, g, unknown or other
  misc_feature (323)..(323): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagcccaccctgttctttgtctccgaggggaaagacgccaccctctccctgccgagggccagtcagagttgttggcagctacttagcctggtaccaanagaaatctggccaggcctccaggcctctcattctatgatgcataccgaacgacggaccncgtcgggccacgtcccctaggcccctagggttccaggttcggcgtaggtcggaggttcgtacggggacaacggtacctttacgaccgttacctacccgaacctacgttaccacggactaccggacccgttaacggtaccgtaccgttaacgggtaaacgtttacgttttttaccggacctttaaaccgttttttaatttaccgttagttaccgtaacgtacgaacggtcggttaacgaccttaaacggttccggtaccttaccgttaccgttaaccgggtttcccggggacgggtaaccgggtaccgggtaggggtacgggttaccgaacggtacggaacggaaccggttaacgtgggttcgaccggtccgaaccgtacgtcgttcgtaccg

SEQ ID NO: 248694 - DNA, 614 bp, Homo sapiens
  misc_feature: GYAE6OF02FZ0NM.47.64.F09.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (370)..(370): a, c, t, g, unknown or other
  misc_feature (370)..(370): n is a, c, g, or t
tcagagctcacgtacacgaccggtgctcgatttagcgcgtatacaagggggaggaactgctcagttaggacccagagggaaccatggaagccccagcgcagcttctcttcctcctgctactctggcctcccagacgaccactggagaaatagagatcgacgcagtctccagcccaccctgtctgtgtctcgaggggaaancgcccaccctctcctgcgagggccagtcgagtagtatagcagcaattcgcctggtaccagcagaaccgtggcaggcctccaggctcgcatctatggtnctatccaccgngggacccncgtcggactcccgagcctaggttcgagttggacgtaggtcgcgtgtcgggacnggtagtccacttccgtcaacgtactccaacgtacgccgtgacgtggtactcgtaaaggttctttagaaccgtttgtttaacgtcgttagtacctagtactagttacacgtacgttacgtccgcccgttcgtacccacgtttacccggacgtaaccgggtacctacggaccgtagggaacgttaacgtaaaccggtacggtaggtttaccgacggttaccgtaaccgcttacgtcgtcgtttacc

SEQ ID NO: 248695 - DNA, 606 bp, Homo sapiens
  misc_feature: GYAE6OF02INMWQ.47.64.F09.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (344)..(344): a, c, t, g, unknown or other
  misc_feature (344)..(344): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctnacttgcattgtctctggtgctcatcactagttttatagttggngggctggactccgccacgccccgagggaacgggctaggatggagttgggagtattagttttagtaagtggggactacttcttaacaaccctactcctanaagacgtacgtagttcatactcgcagacacgtacgagtaactctacttcctacctagaactgacgtctcgtgtcgaccgtccgacacgaccgtacggtcttagtttacttaccgttgttacgagactgtacggaccgtacgagacgctaagttacgcggtacgtaggtttaccggtttagacgtttaggttcggggaaccgtaaggggtaccgtaacggtccgtaccggtcgtaccgacgtaccgtcccgtacctaacccgg

SEQ ID NO: 248696 - DNA, 771 bp, Homo sapiens
  misc_feature: GYAE6OF02J02LJ.47.64.F09.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (230)..(230): a, c, t, g, unknown or other
  misc_feature (230)..(230): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaanacgccaccctntcctgcacgggccagtcagaatnttcactcctacttacgcctcggtaccaacacgtaaacctggtcacggcctccaggtctacctcactctatgactgccacgtaccaacgacgggaccacgtcggctactaccccgaagtacccgtacggttaactacggtcgggtaaccgaggttccggggggttaccttacgggggaacccgttaagggtaacccctttacggtaaccttaccggttaacccaacccgtacgttccggaacgtccggaacgtaccgtaacggtaaccgaccgtacgtaacggttacgttttacggtaaacttttacgttaccgttacgtacgtaacggtcgtaacgttcggttaagtccggtttaccgtccggttcccgtaccggtccgtttacggttaccgttcccggggttaacgggcgggttaaacccggtggggttaacggccgttaagtaacccgttaaaccggaagggtttccggtaggtacccggttagtacccgtaccgttaacggttccgtttagttacccgtttacgtacctttcccccgg

SEQ ID NO: 248697 - DNA, 681 bp, Homo sapiens
  misc_feature: GYAE6OF02I1JXN.47.64.F09.1.454.CMB.1.raw
  modified_base (194)..(194): a, c, t, g, unknown or other
  misc_feature (194)..(194): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (636)..(636): a, c, t, g, unknown or other
  misc_feature (636)..(636): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccgagggaaancgccaccctctcctgcagggccagtcagatatcactcctactagcctgtaccaanagaacctgtcagctccagctcnatctatgatgcactccaacgcggcctacgtcggacctacgtacccgaagtaccgtaacggttcaaggttcggaccgtaggttcggggtacgtacggggacctaacgggtacctttaccgaccttccgttaccgaaaccctacgttaccgtaacggccttaacggaccgttaaggaaccgttcccgtaagtaaccgttacgtttcgggttaactttacttaacgtcggtaactacggtactacgggttacggtacgttacggttccgtcgggtaccctccggtcttacggttaccgttaccggggacgtaaacgggtccggtagggtacggtaacgacgtaaccgaaaccggtacgttggaccggntacggtaccacgttcgtcgttacggtaccttccgtacgttccccg

SEQ ID NO: 248698 - DNA, 800 bp, Homo sapiens
  misc_feature: GYAE6OF02JCHWM.47.64.F09.1.454.CMB.1.raw
tcagagctcacgtacacgaccggtgctcgatttagcgcgtatacaagggggagggaactgctcagttaggacccagagggaaccatggaagccccagctcagcttctcttcctcctgctactctggctcccagataccatcggagaagttgtgttgacacagtctccagccaccctgtctttgtctccgaggggaaagcgccaccctctcctgcgagggccagtcagtagttgtggcagctacttacgcctacggtaaccaacgtaacgaaaccgtggcccgaacgggtcctacccgagggtcctccctactacttctagtcgtattacgcctaactaccgaacggacggggccacggtcggactaaccgtcccgaacgccggttaacggttcgagggtcggtacgtaggtcggtacggtcgggtacgggaactacggtaccttccaacgttcctaccgtactacgttaccgacggtccaacggtaaccgtaggaaccggtcctaaggttaacgttagttttaaccggacttttaacgtttttaacgttaccgttagttaaccgacgggtacccgtacggttacccggtaacgtaccgttaaacccggttcggtaccccttaccgttaccgttaccgggtttaccggggacccggggttaaaccggggtaccgggtacggggttacggaacgggtaaccgttaaccgggtaaaccggtaaccggtaaccggggttcgggtacgggtacccgtacggtaacccgttaccgtaccggttttacccggttccgtttaaccccg

SEQ ID NO: 248699 - DNA, 661 bp, Homo sapiens
  misc_feature: GYAE6OF02IU92K.47.64.F09.1.454.CMB.1.raw
  modified_base (199)..(199): a, c, t, g, unknown or other
  misc_feature (199)..(199): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaaggggaaangccaccctctcctgcagggccagtcagaatatcactcctacttagcctggtaccaacacgaaacctggtcaggctcccgaggctcctcatctatgatgacactaccaacgacggggccctagtcggaccactaccccgaggccgtaggttcaggtcggactaggtgacgtcgtacgggtacacgtacttacgaccttctaccacctataccaagtccaacgtacccgtaaggaacgtccctaagggtaaagtttacgttttacggacctttaacgttttatttaaccgttacgttacgtaacggtactaacgggtccttaaacggactaaaccggttcgggtacccttcgttaccgtaccgttcggggacgggaacggtaaccggtaggggtacggagtacgtacgacggaacgtacgtggaccggagttacgaccgtaacctgtacttcggttaccttacg

SEQ ID NO: 248700 - DNA, 758 bp, Homo sapiens
  misc_feature: GYAE6OF02II2TD.47.64.F09.1.454.CMB.1.raw
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgctccaggggaaancgccaccctctcctgcagggccagtcagaatatcactctactagctggtaccanagaacctggtcagctccaggctccnatctatgatgctatccaacgacgggccacgtggctatacccagactaggttccaaggttcggactaacggtgggtacgttacggggaccacggtactttacgaacgttccgtaaccaacccgaagttacccaagggacctaacggtacccgttaacggtaacgtacccgttacggtaaacggttaacgtttttaacggggtaacctttttaacgtttaaccggttaggttacccgtaaacggtccgtaaacggttacgggttacgtaacggtttaccggtaccgggttcccgttacccggttcccgttaccgtaaccggttttacccggggaccgggtaacgggggtacccggtaagggggttacggaacggtaacgtaacccgtaaaaccgggtaacgtttacgggtacgggtaaccgttaccggtaacctaacccgtaacgtttacccgttggtttaacccgtttacctaacgtttccccg

SEQ ID NO: 248701 - DNA, 654 bp, Homo sapiens
  misc_feature: GYAE6OF02F25XV.47.64.F09.1.454.CMB.1.raw
  modified_base (199)..(199): a, c, t, g, unknown or other
  misc_feature (199)..(199): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaaggggaaangccaccctctctgcgagggccagtcagaatattcactcctactagcctggtaaccaacagaaacctggacaggctccgaggcctctcatctatgatgacataccaagcggaccagtcggtacactcccgaagacgtagggttccagggtggacgaggttgggtcgtagggactaggtacttacacgtactaccgacctaatacgacgactaccgaccgtaacgacgtaccgtaaggtaaacgttacgtttagggttaaacttttactaacgttacgttacgaacggtcgtaggtaccgttagtacgtttcgcgggttcccttacccggtcgttaccgttacgtttacggggacgggtaaccgggacggtaggggtacgacgtacaacgtaaacgtaacggtggttccgggacttcgtaacctacgtcgttcgtaggtacctttcacccgttaccg

SEQ ID NO: 248702 - DNA, 574 bp, Homo sapiens
  misc_feature: GYAE6OF02IOVCT.47.64.F09.1.454.CMB.1.raw
  modified_base (195)..(195): a, c, t, g, unknown or other
  misc_feature (195)..(195): n is a, c, g, or t
  modified_base (547)..(547): a, c, t, g, unknown or other
  misc_feature (547)..(547): n is a, c, g, or t
  modified_base (562)..(562): a, c, t, g, unknown or other
  misc_feature (562)..(562): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccaggggaaangccaccgtctcctgcagggccagtcagagtattagcagcaacttgcctggtaccagcagaaacctgggcaggcctcccaggcctcctcatctatgatgccgtccaccgacgggccacgttcggtttcccagtccgtaggtttcaggtcggctaggtcgggtctcggggacacggtactttcacttctacacctatcagccacgcctaagacgtacctagaagtatttgacttaagtttactacgttgtcaagtactaaacgttaaattacgtcggtcctccgcttaccgtacgtttcggacggacgggtacgagggtgacgtagtacgaacgtagtggtcggctacgcacgntctacgttccttacncttcctccgtcc

SEQ ID NO: 248703 - DNA, 880 bp, Homo sapiens
  misc_feature: GYAE6OF02H7GTC.47.64.F09.1.454.CMB.1.raw
  modified_base (198)..(198): a, c, t, g, unknown or other
  misc_feature (198)..(198): n is a, c, g, or t
  modified_base (240)..(240): a, c, t, g, unknown or other
  misc_feature (240)..(240): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagagttgtgttgacacagtctccagccacccttgtctttgtcctccgaaggggaanacgcccacccctctccgtgccgagggcccagtcaagtaattnttcacttcctaacttagccttggtaaccaacaggaaacctggtaccaggcctacccgaggtcctcctactagttcctaatgaacttcgaccctaactacccgaaacggtaccgggaccctaccgttacgggaccctaaccgttacccccggaagaaccggttagggtttaccgaacgggttcgggaccgtaagggttcggggttaccgtaggggaacctaacggtacccgtttacccacgtttaccccgtactaaacctacgtccgaacggtacccgtaacgtacccgtaacggtaaccggtacccgtttaacgggtaaacggtttaaccgtttttaacggttaaaccgttttttaaccgtttacgtttacggttaacccggacgttaaccgtacggttacggtttacggtaacggttttccggttaccgggttacccccgttacccggttcccggtttaacccgttaccgggttttaccggggacccggggttaaccgggggaaccggttacggggttacgggtaacgggtacgttaacccggtaaaacgggtcggttacgggttccggtacgttacccggaccgttaccgtaacgttcccgttaacgttttcccgtttacccgtactttaccccccgg

SEQ ID NO: 248704 - DNA, 666 bp, Homo sapiens
  misc_feature: GYAE6OF02IQLRI.47.64.F09.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (400)..(400): a, c, t, g, unknown or other
  misc_feature (400)..(400): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccgaggggaaangccaccctntcctgcagggccagtcagaatatcactcctacttagcctggtaccaacagaaacctggtacaggctcccaggcctcctcatctatgatgactataccgaacgacgggcccacgtcggcactcccgaagacctaggttccaggtacggctaggttgggtctacggggacagtaccttcgacttcctacaacctntccagccacgtacctagacgtccgtagtaaccgtagtttcggtaaacttttacttaacgtcgttactacgtcgtaagtccgttaggtacgttccgttcgggcccttccgtcgtacccttaccgggttccgggacgggtaccgggtacgtacgggggttagtaacgacgttaaccggtaaaccgggtaacgttaggtcgggtaaccttacgggaacccttaccgtaacgtttccggtaccgtttccgttacccgtactttcccccgg

SEQ ID NO: 248705 - DNA, 663 bp, Homo sapiens
  misc_feature: GYAE6OF02GTX3H.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggccagtcagaatattcactcctacttagcctggtaccaacagaaacctgtccaggcctccagcctcctcatctatgatgctataccaacgcgggacctacgtcggcactcccagacacggttcacggtggcaggttcggtacgtgggaactacggtaccttacgactccgtaccaccgtaacttccgaaggccaacgtacccgtaaggacgtacccgttaaggaaacgttaccgttttacgggttaacctttttaagttaaccgttgtaccgtagtaccgtacggtaccggttagtacggtttccgtcggtcccttccgtccttacggtacgtttccggggacggacggggtaccgagggggtacaagtaacgtaccgaacggtacgtggtacggtctcgaccgtaacctgtccgttcgttaccttcctacgttcccctacccgtacg

SEQ ID NO: 248706 - DNA, 366 bp, Homo sapiens
  misc_feature: GYAE6OF02H0I1A.47.64.F09.1.454.CMB.1.raw
  modified_base (199)..(200): a, c, t, g, unknown or other
  misc_feature (199)..(200): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (316)..(366): a, c, t, g, unknown or other
  misc_feature (316)..(366): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaaannccaccctntccngcagggccagtcagaatattcactccttatagcctggtaccaatagaaacctggaccaggcctcccaggtcctctcatgtaatgatgacataccaaacggtacnnnnnnnnnnnnnnnnnnnnnnnnnnnnnnnnnnnnnnnnnnnnnnnnnnn

SEQ ID NO: 248707 - DNA, 642 bp, Homo sapiens
  misc_feature: GYAE6OF02F18HC.47.64.F09.1.454.CMB.1.raw
  modified_base (201)..(201): a, c, t, g, unknown or other
  misc_feature (201)..(201): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggccaggactggtgaagccttcggagaccctgtccctnacttgcattgtctctggtgctccatcacctagttttaatagtggtgggctggatccgccacgccccgagggaacgggctggaagtggtagttgggagtattatttataagtggggactacgttactttaaccaaccgacttccctagaagtacgtcgtacgtttaccatactccgactacgacacgtcgagaactcacttcctcccgtanaacgtgacgtctntgtacgaccgcctacgacgtacgacggtcgtttactttacgttacgttaggtcgagtacgacgtacgaccgtacgagtacgtacgtagttacgtacggtactacggttacggttttagtaacgtttcggttacggggtaccgtaaacggggtaaccgtaacggggttacctacccggttccgttaccggaccgtacggtccccttaccccgaaccggg

SEQ ID NO: 248708 - DNA, 616 bp, Homo sapiens
  misc_feature: GYAE6OF02I0YNO.47.64.F09.1.454.CMB.1.raw
  modified_base (197)..(197): a, c, t, g, unknown or other
  misc_feature (197)..(197): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtcctcaggggaaagngccaccctctcctgcacgggccagtcagaatattcactcctacttagcctggtaccaacagaaacctggccaggcctccaggcctccgtcatctatgatgcactccaacgacgggcccactcggcctactccccaacgccgtacggttcaggtcggcaggtgagtcgtggacagtactcactcncacntcagcncgacctagacnctagaacgttntttacgcttaattttatttaccgttagttcagtccgagtaccgtacgacgtacgttcggtaccctcgtttaccgtaccggtttaccggggacgggtacgggtaccgggaggggttagggacgtaagttccggaaggtaaccggaaaggttcggtacgggtcttacggacctaaccgttgttaccgtttcggttaccctttccg

SEQ ID NO: 248709 - DNA, 730 bp, Homo sapiens
  misc_feature: GYAE6OF02HFSVL.47.64.F09.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagagctcacgtacacgaccggtgctcgatttagcgcgtatacaaggggggagggaactgcgtcagttaggacccagagggaaccagtggaagccccagctcagcttctcttcctcctgcctactctggctcccagataccatcggagaagttgtgttgacacagtctccagccaccctgtctttgtctccgaggggaaagngccaccctctcctgcgacgggccagtcagaatnttcactcctacttagcctaggtaccaacagtaaacctggtcaggcctcccgaggcctcctacacgtctactgtactgacctaattaccccgaaacgaacggggaccctacgtggaccgtaacgtaccccgaagtaaccgtacgggtttacccaagggttacgggacctagggttaccggggttaccgttacgggggaactaacgggttaccctttaccggaaccgtttccgtaacccaacccttagttccgaacggtcctcgtaacccgtaggaccgtcccgttaagaacggttacgtttaggtacctttaacgttaccgtgtacctagctaggtccgtggtacgttcgtcggcccttcccgacttccgtaccggtttcgggacgggtacggccggtaaggggtcggaggtacgtacgtaaaccggtacggttaggcgggtacctacgggacctacccggtattccgtccgtttacgttacctacgtttcccgg

SEQ ID NO: 248710 - DNA, 931 bp, Homo sapiens
  misc_feature: GYAE6OF02HOVJB.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtcctcacgcccaccgtgttctttgtcctaccggaaggggaaagcgaccctaccctctccgtagaccggacgggcctaagtacgaagtaaacttacttaccaccttaccttaacgttacgtaccgttacggtaaacccaaacgtaaacggtaaaacccgtgggtaccgacgggtaccccttaccccggaagggtcccttaccctaactaacttaccgttaacgtaggtaacttccggaacctaaccgttaaccccgaaaaacgggacccggggtaaccccttaacggtcgggtaaccctaaccgttaaccccggaaacggtaaccggttaacgggttaccgtaaaggggtcgggtaaccggtaacggggtttcgggggttaccggttaaacgggggaacctaacgggttttaacccgtttacgtaacccgttccgtaaccctaaaccgtaacgttaccggaacgtaacccgaaccggtaacccgttaaacgggtacccgtaccgttaaagggtaaaccgtttacggtttaaccggtttaaacttttaacgttacgttacggacctaacggtaccgacggtcgttacggttacgtttccggtaccgtccccgttaccgtccgttaaccgtttaccgggttccggggaacgggttaccgggtaacggtaaggggttacgaacggtaaccgtaaccggtaaaccggtcggttacggtacggtacgtaccgaccgtacgtacgttcgttacgttacccttagtaccctttacccg

SEQ ID NO: 248711 - DNA, 721 bp, Homo sapiens
  misc_feature: GYAE6OF02HWPXG.47.64.F09.1.454.CMB.1.raw
  modified_base (143)..(143): a, c, t, g, unknown or other
  misc_feature (143)..(143): n is a, c, g, or t
  modified_base (195)..(195): a, c, t, g, unknown or other
  misc_feature (195)..(195): n is a, c, g, or t
  modified_base (289)..(289): a, c, t, g, unknown or other
  misc_feature (289)..(289): n is a, c, g, or t
tcagagctcacgtacacgaccggtgctcgatttagcgcgtatacaagggggaggaactgctcagttaggacccagagggaaccatggaagccccagcctcagcttctcttcctctgctactctggctccagataccaccgganaagtttattttgacacagtctccagccacctgtctttgctaccgaggggaanagtccacccttctcctgcagggccagtcagaatattaccactctaactagcctggtaccaacagaaacctggtacaggcctccaggcctcctanactactatacgatcggctaactcccgaaacgtacggggaccctaacgtcgggaccctaacttcccccgaaggtaaccgtaacgggtttccgaacggttcgggacgtaacgggttggggtacctaggggggacctaggtacttactacgtctacacctatcacgactacgaccgttaagacgtacgtaggtaaacgtaccgtttaggtacttttaataccgttgtaccgtaacggtactacggttccgttacgtaggtttccgtacgggtaccctcggtacctttaccgtaccggtttacggggaccgggacgggttaccgtaagggggtcggaaacgttaacgtacgtaaacgtacgttgggtacggtacgtaccggacgtaaccctagttccgttacgtacgttacccgtacgttacccttcccggtaacc

SEQ ID NO: 248712 - DNA, 600 bp, Homo sapiens
  misc_feature: GYAE6OF02JKOYH.47.64.F09.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccacctgtcttgctccgaggggaaangccaccctctcctgcacgggccagtcagaatacttcactcctactagcctggtaccaanagaacctggtcagctccagctccnatctatgatgcatccaacgnggccagtggacactcccagactaggttcaggtcggacagggttcgggtacctaggggactaacgtccttacgacttcgactaacccgtatccgtaaggcctacgtacgtaacggacgtaccgttagaaacgttcgtttacgtaactttattacgtgtacagtaccaagtcgtagtacgttcgcgtacccgtcgtctacggtccgttacgggcggtacggtacgagggtcgaagtacgtacgaacggtactggtacggactacggacctacgtgttaccgtagtaccttacgtacccttccgg

SEQ ID NO: 248713 - DNA, 805 bp, Homo sapiens
  misc_feature: GYAE6OF02JJNEH.47.64.F09.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (332)..(332): a, c, t, g, unknown or other
  misc_feature (332)..(332): n is a, c, g, or t
tcagagctcacgtacacgaccggtgctcgatttagcgcgtatacaagggggagggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggtcagtcagngtgttgacagcttacttagctaggtaaccaagacgaaacctggaccaggcctacccgaggcctcctcattccgtagggacttcgcgactaccgaacgtacgggccncgtggccactccccgagccgtaggttcgaggtcggctaggttcggggtacgtggggaacctaggtaccttaccgacgtttccctaacccacccgtaactaccggacggtacccgtaacggtacccgtaacggtaccggtaccccgttacgggaaaccggtttaaccggttttacggggtttaaacctttttaacgtttaacggtaccgtttaaccggtacggtacccgtaacgggttccggttaacgggttaacgttttccgggttcgggttacccccggttcccgttacccggttttaccgtttacccgggtttaccgggggtaccggggttaacggggtaacccgggttaagggggttacgggtaacgtaccgttaaacgggtaaaccgttacgggttcggtacggtccgtaacggtcccgaacgttaccgttcgtttaaccggttccgtttaccgtacccgtttaccccg

SEQ ID NO: 248714 - DNA, 777 bp, Homo sapiens
  misc_feature: GYAE6OF02GIQBS.47.64.F09.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (287)..(287): a, c, t, g, unknown or other
  misc_feature (287)..(287): n is a, c, g, or t
tcagagctcacgtacacgaccggtgctcgatttagcgcgtatacaagggggaggaactgctcagttaggacccagagggaaccatggaacgcccagctcagcttctcttcctcctgctactctggctccagataccatcggagaagttgtgttgacacagtctccagccaccctgtctttgtctccgaggggaaangccacatctcctgtacgggccgtnagagtattacgcatcaacttgcctggaccaggcagacgaccgtgggcaggcctcccgaggcctcctnattctatgaatggaccatcccgaacgacgggccacgttcggctaaccgtcccgaagaccgtacggttcgacggtcggctaaggggttcgggtaccggtagggactaaggtacctttcgaacctttccgacctaaccccgtaattccgaagtacccgtaacggtacccgtaacggaccgtaccgttaacgggtaaacggtttaacccgttttacgggttaaacccgttttttacgtttaaccgttacggttacccgtaaggtccgtaaacgggttcggttaccggttaacggtttccgtaccggttaccccgttcccgtaccgttacccgtttaccggggtttccgggaccggggtaaaccgggacccgggtagggggttacgggtaacggttaaccgtaaaccggtaaaccgggttaaccggtggtacgggtacccgttcggtaacccctaacccgtttaacgttcccgtttaccgtacccgtttacccg

SEQ ID NO: 248715 - DNA, 761 bp, Homo sapiens
  misc_feature: GYAE6OF02H8I9J.47.64.F09.1.454.CMB.1.raw
  modified_base (201)..(201): a, c, t, g, unknown or other
  misc_feature (201)..(201): n is a, c, g, or t
  modified_base (731)..(731): a, c, t, g, unknown or other
  misc_feature (731)..(731): n is a, c, g, or t
  modified_base (738)..(738): a, c, t, g, unknown or other
  misc_feature (738)..(738): n is a, c, g, or t
  modified_base (747)..(747): a, c, t, g, unknown or other
  misc_feature (747)..(747): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccagtcggagaagttgttgttgacacagtctccacgccacccttgtctttgtcctccgaggggaancgcctaccctctcctgcgacgggccctagtcaagtaattacttcctaacctacccttacttacgtccttacggtaaacccaacaaccgtaaacccgttggtacgtaaccggccgtacccgacggcccttacctcctagttcttaactggtaactcgacctaacgttacccgaacggtaaccgggtaccaccgtacggccctaacccgttcccgaaacggaccgttaaccggttacgacggggtaccgggtaccggtacgggtttaacggggttggtacgggacgtaacgggtacccgtttaccgaccttcccgtaccttaaaccctcgtaaccgacgtaccgtacgtacccgttaaagggtacctcccggttaaaggtaaccttttacggtttaaccggtattttaaccgtttcgtacggtactcggagtcggtacgttagtccggttcaccgggtcctacgtccttcggtacgttcgggacgggtagacggaggttcgagtacacgtaagtcgtcggagtcaccgtacngtacctnttaccgttnttccgccttacccg

SEQ ID NO: 248716 - DNA, 814 bp, Homo sapiens
  misc_feature: GYAE6OF02IIYJ2.47.64.F09.1.454.CMB.1.raw
  modified_base (214)..(214): a, c, t, g, unknown or other
  misc_feature (214)..(214): n is a, c, g, or t
  modified_base (458)..(458): a, c, t, g, unknown or other
  misc_feature (458)..(458): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctccagactaccagtcggagtaagttgtgttgacagtagtcctaccacgaccctacccttgttctttcgtcctaccggaaggggaaanacgccctaccctctccgtgccgacgggcctagtacaagtaacttacttcctaccttaccttacttacgccttacgaaccaacaacgtaaccgtggacgacggtccctaccgcggtcctcctactagtttacgtacgtaactactaacgaacggacggacctacggtcgacctaccgtaccgaagaacgtagtacgtcgacggccggtataggtcgtacggtcggacgggaacacgttccttacnccgttactaccaactactccgacgtacgaacggtacgtacgggactaccggtaaggttaactttagtttacgaacgtttaagttaaccttacgttacgtacgttaccgtaacgtacggttaacgtttaggttacgggtaacggtaacctaacggttaccgggttaccggggttaacccgggttaccgggaaccgggtaaaccggggttaccggggtaaaggggtaaccgtaaacgttaacccgggaacggttaccgggtttaacggtcggggtccggtacggtaacccggtaactacccggtttacgttccggttaccgttttaccctttaccgtcccgtttacccccggtacccg

SEQ ID NO: 248717 - DNA, 697 bp, Homo sapiens
  misc_feature: GYAE6OF02JID2O.47.64.F09.1.454.CMB.1.raw
  modified_base (160)..(160): a, c, t, g, unknown or other
  misc_feature (160)..(160): n is a, c, g, or t
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagagttgtgttagacacngtctccagccaccctgtctttgtctccgaaggggaaancgtcccacccttctcctgcgacgggtccagtcagaattcttaccaccttacctacttagacccgttacggtaacccaaacaacgtaaacccgttggtccacggtcctcccgacggcctcctcgtactacgtattggactacgcaactaccgaacgaccgggtacctacgtggtaccctacaacccgtagtaccgtaggttccgaaggttcggacgtacgggtcggtacggtggacacgtttcttacgacctactccacctatacgtacacgtccgtacgtagacgtaccgtaagtacgttaccgttaggtactttagtactagtacgacgtcgtacggtcgtcgtaacgttccgtacggttccctacccgtcgtacccgtttcggtaccgggacgggtaacgggtcggtaacggtcggtaacgtacgtaacgtaacggtaacggtgtacgtccggcgtaccgtaccgtacgttacgttactcgttcctacccgtacccg

SEQ ID NO: 248718 - DNA, 672 bp, Homo sapiens
  misc_feature: GYAE6OF02F60PY.47.64.F09.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (257)..(257): a, c, t, g, unknown or other
  misc_feature (257)..(257): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgtctttgtctccgaggggaaagngcccaccctctccngcagggccagtcagaatattcactcctattagcctggtaccaanagaacctggtcaggcctccgaggccttcctcatctatgatgcactaccaacgacgggccacgtcggctacgtccccaagacgtagggttccaggttcgggactaggttcggggtacgtaggggacctaaggtacctttcgaacctttcctaccgaaacccctataccgaacggtccaacgaccgtaaggaccgtaccgtaggtaaacgtacgttttaggtacttttactacgttcgtacaacgtctaggtcgtgtacgtttcgcggtccctccgtctccgtacgtttccgggacgggtacgggtaccggtaggggtacggacgtacgtaacgtaaaacggtacgttaggtagggtacccgttagacccggtaacctactttccggtagtttacccgtttacgtaccgtttccccg

SEQ ID NO: 248719 - DNA, 657 bp, Homo sapiens
  misc_feature: GYAE6OF02H092D.47.64.F09.1.454.CMB.1.raw
  modified_base (490)..(490): a, c, t, g, unknown or other
  misc_feature (490)..(490): n is a, c, g, or t
  modified_base (576)..(576): a, c, t, g, unknown or other
  misc_feature (576)..(576): n is a, c, g, or t
tcagagctcacgtacacgaccggtgctcgatttagcgcgtatacaaggggggctttctgagagtcatggatctcatgtgcaaagaaaatgaagcacctgtggttcttcctcctgctggtggcggctccagatgggtcctgtcccagctgcaaactgcaggagtcggccctagactggtgaagtccttcggagtaccctgtcccctcacttgcatttgtctcgtggtggcctccatcgaaccttagttttaattagttgggttggggctggactccgccgacgaccccgagggaagggctaggatggtattggattattagttttagaacgttagggacctatccttaacaccgatccctagtaagtagtacgtacgtttacactacgtacacgacgtaaccacgtccgaagtaataccgactttccgaccttaacgaacgtagacgtactccgtacgtagaccccgcgtacgtaacgaccgtaaccggtntttacgttttaactcgttacgttacgagaccagttcccggacgaaccgagacgtctaagtccggtgaaccgttaggttacggtttntacggttagttcggggaaccggacgggtaacgaccgggttaccaccgttacgtccccgacgtacgtccccaggtaacccgg

SEQ ID NO: 248720 - DNA, 858 bp, Homo sapiens
  misc_feature: GYAE6OF02JDUHW.47.64.F09.1.454.CMB.1.raw
tcagagctcacgtacacgaccggtgctcgatttagcgcgtatacaagggggctttctgagagtcatggatctcatgtgcaagaaaatgaagcacctgtggttcttcctcctgctggtggcggctccagatgggtcctgtccagctgacaactgcaggagtccggcccaggactggtagaacgtccgttcggacgtaccctcgttccctctacttgcctattcgtctcgttcgggtcgtacctcctaacttcctaaaccgtttaagttttttaagttacggtttgggggttcgggggtcgttacgggtaacgttccccggtaccctaccgggacccccccgaaaggggggtaacgggggtccggttagggtaaaggtcgggtaaggtttaggggtaagggtttaactttaagtttttaaagtaaacggttcggggaacttaaccgtttacctttaaccgaaacccctacttccccgtactaaacgggtacgtcgtttaacgttaccctaattacgtaccggactaacgacgtaaccggtccgaagtaaacttcccgtactttccctaccgtaacgtaaccgtagtacgtaccttgtaccggtcgaccgccgtaactacggaaccgtcgtaccggttttagtttactttaccgtacggtaccggttacgaaacctcgaccggtacccggtaccgtacgtaacgacctttacgttaacggtcggtaaccgggtttaacggttttaccggttttagtaacggtttaaccgggtttcggggtaaacccgtaaggggtaaccgtaacgggttcccgtaacccggtccgttaccgaccgtaccggtccctaccccgtaacccggg

SEQ ID NO: 248721 - DNA, 698 bp, Homo sapiens
  misc_feature: GYAE6OF02JJB7C.47.64.F09.1.454.CMB.1.raw
  modified_base (343)..(343): a, c, t, g, unknown or other
  misc_feature (343)..(343): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggccaggactggtgaagccttcggagaccctgtccctcacttgcattgctctggtgctccatcacctagttttaatagttggtgggctggactccgccacgcccccgaggggaacgggctaggaacgtggtagttgggagtatattttataagtgggactactcttacaacctatcctanaagagtcgtacgttcatactcgacacgactacgtacgagaactctacttcctacccgtagtaaacgtgacgtccttcgtacggttcgacccggtccgaccgaacgtaaccgaccgggttacgtttacgtttttaaactttaacgttacggtttaccggtaacgtacgtaacgtcggaacccggtaccggaagtacgaccgttagtttaacgtacccggtacgttaacggtttacgggttttgtaacgttacgggtttaccggggaaccggttaaaggggaaccgttaacggggttaccctacccgggttacccgtccggaccggtaccgtaccccgttacccggtaaaccccggg

SEQ ID NO: 248722 - DNA, 720 bp, Homo sapiens
  misc_feature: GYAE6OF02FZV9Y.47.64.F09.1.454.CMB.1.raw
  modified_base (202)..(202): a, c, t, g, unknown or other
  misc_feature (202)..(202): n is a, c, g, or t
  modified_base (685)..(685): a, c, t, g, unknown or other
  misc_feature (685)..(685): n is a, c, g, or t
tcagagctcacgtacacgaccggtgctcgatttagcgcgtatacaagggggaggaactgctcagttaggacccagagggaaccatggaagccccagctcagcttctcttcctcctgctactctgcctccagataccatcggagaagttgtgttgacacagtctaccagcccacccttgtctttgtcctaccgaaggggaaancgccctaccctctccgtcgcgacgggccagtcaagaattattccacttccctattagcccttaggaacccaacagtaacctggtacaggcctacccgagcctcctcatcgtatgatcgacactaccaacgacgggcccaacgtcggaccacctacccgagaaacgtcggttaccaaggttcggccgttagggttccggcgttaggaaccgtagtacctttccgacttacgtaccaactcgttaccgacgcgtaacggtccttaaggccgacgttaaagtacccgttggttttaaccgtacttttaactacgtcgttacgacgtcggttaaggtccgtaggtttacgttcccgtacggttcccgtaccgttccctacgtttccggttaccggggtagggcccgggtaaagttcgggggacgtataaccggttaacgaacgggtaacccgtttgggacccgtagttaccggactaacccggtttnttaccggtttcctactttaccgtaccgttcccccg

SEQ ID NO: 248723 - DNA, 591 bp, Homo sapiens
  misc_feature: GYAE6OF02GP1LH.47.64.F09.1.454.CMB.1.raw
  modified_base (196)..(196): a, c, t, g, unknown or other
  misc_feature (196)..(196): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgagggaaangccaccctctcctgcagggcagtcagatatcactcctacttagccttggtaccaacacgaaacctggtacacggtcctcccaggcctcctcatctatgatgcagtaccaaacgcgggccaacgtcggcacgtacccagtacgtaggttccgagtcggctaggtgggtctggggactagtacttcacgtctcaccntacagcacggtccagcncgtagaacgtcgtttaggtactttaatacgtgtanacgntaggtctagacgtttcgcggtcctccgtactccgttacggtcggacgggtacgggtaccgaggggttacacgtagtaacggaaacgtcgtcggtacgggacttcgaccgtaacctagtcgttccggtcttaccggtcttacccg

SEQ ID NO: 248724 - DNA, 729 bp, Homo sapiens
  misc_feature: GYAE6OF02IZ3VH.47.64.F09.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (382)..(382): a, c, t, g, unknown or other
  misc_feature (382)..(382): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagagaccactggaagaaatagtgatgacgcagtctccagccacctgtctgtctctcgaggggaaangccacatctccgtggtacgggccgtnagagtatagcatcaacttgccgtggtaccagctagacgtaccgtggggcctaacgggcctccccgaggtcccttcctcgattccgtatcggtattcggaccgtacccaccggacggggccctaacgtttcggttcccccaaggtccgtaacggtttccgnggtacggtactacgggtcgtccggttacggtacgggaactaacgggtactttaccacgttcctaacctaaccgtaacttaaccgaaaccgaccgttaccgtgtaaccgtaaggttcgtaaacggtaacgtttagtttacggaactttaaacgttttactaacgttcgttacgtaacgtacttaaattaacgtaaacgttacgttaccgggtcctaccggtccgttacccgggaacgttaaaccggaacgtaccggtagtaccggtaacgttaaacggtaacggtcgttacggacggtacctacgtacctacgtacttccggtaccttcgttacgtcctttaccccgg

SEQ ID NO: 248725 - DNA, 725 bp, Homo sapiens
  misc_feature: GYAE6OF02JEVE5.47.64.F09.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (324)..(324): a, c, t, g, unknown or other
  misc_feature (324)..(324): n is a, c, g, or t
  modified_base (415)..(415): a, c, t, g, unknown or other
  misc_feature (415)..(415): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangccaccctctcctgcagggtcagtcagngtgttgacagtctacttgtcgtaggtaaccaagacgtaaacctggaccagggcctccaggctcctcatcgtgggatcgctacgtaccaacggacgggccncgtcggcctacgtccccgagacccgtaggtttaccgaggtcggcctaggtcggggtctacggggactaggtacttccgactcctacacctntacgaacgcgacgtccgtacgacggtccgtaggtaacttcgtttacgacgttaagtttaacgttacgttcgtacgtacgtaaccgtaacgtaaacgttacgtaccggtcccgttccggtaccttaccggttaccgtttaccggggacgggttaaccggggtaaccgggtacggggttacgtaagttaaccgttaccgtaaaacggtacggttacggggttacgggccgttaacggaccgtaaccggtttaccgttaccggtttaccggtttaacctttaccggttaaccgtttcccggtttaacccccgg

SEQ ID NO: 248726 - DNA, 664 bp, Homo sapiens
  misc_feature: GYAE6OF02GTS0F.47.64.F09.1.454.CMB.1.raw
  modified_base (420)..(420): a, c, t, g, unknown or other
  misc_feature (420)..(420): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcaggccagtcagaatattcactcctacttagcctggtaaccaacagaaacctggtcaggctcccgaggcctcctcatctatgatgccgtccaccgacgggccctacgtcggtttccccaggccctagggttccaggtggacagtcgcgtcgtgggacagtgttcactctacaccataccaacgtacgcctgactacgtctagtaagttnttttacgattaagtttacttcgtgtacaggttactagttacttacgaacgttacgtaccgggtccctacgttacccgtacccggtttaccgggaccggtaacgggacctaaccgggacgttaacggggaataaaccgggtttaaaccgacgtttacgggtacggtaccgttaccggtaaccctaccgttacgttaccgttaggtttaccccttacttacccgttccccttacccccgtaacccg

SEQ ID NO: 248727 - DNA, 729 bp, Homo sapiens
  misc_feature: GYAE6OF02IRJ26.47.64.F09.1.454.CMB.1.raw
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (570)..(570): a, c, t, g, unknown or other
  misc_feature (570)..(570): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccagtcggagaagttgtgttgacacagtctccagccctacccttgttcttttgtcctaccggaaggggaaagcgcccacccttctccgtgcgacgggccagtcaagtaattacttccaccttaccttaacttacggcccttacggtaacccaaacgtaacggtaaacccgttgggtaccgaacgggtccctaccccggaaggtccccttccctactaacttctaattgacgtcgacctaaccgttaacccgaaacggtccgggaccctaacggtcggacctaccgtacccgaaggtaccgtacggtcaggtcggacgtaggtcgggtacgtacgggactacgtaccttccacgttccncactnaccgagcgtacgacgtacgaccgtactaagtaacgttcgtttacttaacgtttactacgtacgtactacgngtacgtcgttagtacgttccgaccggttcccgtccgtccgtttaccgtaccgggttcgggaaccggggtcggaccggtgggtaggaactacggtaaccgaagtcggtcggtgaacgtcaaccgtcgtacgttccttaccgtacttccgtaccgttcccg

SEQ ID NO: 248728 - DNA, 595 bp, Homo sapiens
  misc_feature: GYAE6OF02FLQVD.47.64.F09.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacagtctccagcccaccctgtctttgtctccaggggaaangccaccctctcctgcagggccagtcagagtgttggcagctacttagcctggtaccaacagaaacctggccaggcctcccaggcctcctcatctatgatgcatccaanggccactggcatcccagccaggttcagtgcagtgagtctgggacagtacttcactctcaccatccagcagccgtagacgacccgtagtaaacgtagtttcgacctaacgttttattactgttacacgtccagtacggtacgaccaacggttcgtcccttacgttccgtaccgttttccgggaccgggtaacgggtacccggtaggggtagggaacgtacgttccgaacggtaaccggtaaccgttagggtacggtccgttcggaccgtacccgtagtccgttcgttaccc

SEQ ID NO: 248729 - DNA, 663 bp, Homo sapiens
  misc_feature: GYAE6OF02H6UZU.47.64.F09.1.454.CMB.1.raw
  modified_base (197)..(197): a, c, t, g, unknown or other
  misc_feature (197)..(197): n is a, c, g, or t
  modified_base (328)..(328): a, c, t, g, unknown or other
  misc_feature (328)..(328): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaatcggagaagttgtgttgacacagtctccagccacctgtctttgtctccgaaggggaanagccaccctctcctgccagggccagtcaagaatacttcactcctacttagctaggtaccaacagaaacctggtacaggctaccaggctcctcattctatgatgactactaccgaaacgacgggcctaacgnggctaactacccagaacagttacaggtcggtacaggtcggggtctggggacaggtacttcgactaccgtacaccctatctagctacgccttagacgtccgtagaacggtactttgtaacgttttactacgttagtacgtagtccgtagtacgtacggttaggtttccgtgggttccccgttaccgcccgttaccgtccgttttaccggggaccgggttaaccggggaccggtaaggggttacggaaggtacgttaacggaaacggtaacggttaggtcggtaacgtacggtactaccgtaacgttcgttaccgtacgtttccacgtttacccccg

SEQ ID NO: 248730 - DNA, 660 bp, Homo sapiens
  misc_feature: GYAE6OF02ISA6A.47.64.F09.1.454.CMB.1.raw
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgttctttgtctccgaggggaaagacgccaccctctccgtgccacgggccagtcagtaatacttacactccgtacttacgcctaggtaccaacacgaaccgtggtcaggcctccgagcctctcatctangatcgacatcccaagcggccaagtggccatccganacgtggtcaggtgcgtaggtcggtacgtaggggactagtacttactacttacgacctaacccagttcacgtacctaacgtaccgtacgaccgtacccgtaggtaaccgttacgttttacggttaactttaagttaccggttgtacctaggtaccgtaggttacggtggtacgtttccgaccggttccgttcccgtcccttacgtccgggttttacgggccggggtaacggggaccggttacggggtacggtagtacgaacgtaacggtacgtaggtcggactcgaccgtacgtacgtccgttacgtcttaccgtcttacccg

SEQ ID NO: 248731 - DNA, 679 bp, Homo sapiens
  misc_feature: GYAE6OF02F649U.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtcctccagccaccctgtctttgtctccgaagggggaaagagcccaccctctcctgcgagggccagtcaagaattatcactcctacttacgcctggtaccaacacgaaacctggtcaggcctcccgaggccttcctcacgtctagtgatgcactaccgaacgacgggcccagtcggcctaacctccccgtaaggaccgtagggttaccacggtcggacgtaggttcggggtcgtagggaccaggtacccttcgtaaccttcctacccgaaccctactaccgaacgtaccgtaacggtccctaacggcgttaaccgtaacggtaaacgttacggttttacgttaacgttttacgtttacctcgtaccgtacggtcgtacggtcgttgtacgtttcgtcggcctcgtcctccgtacggttcgggacgggacggccgtaggggacgagtacgaacgtaaaccgtacggtacggtcggtaccgtcgactacgtacgtcgttcgttactttcaccgtttccccg

SEQ ID NO: 248732 - DNA, 576 bp, Homo sapiens
  misc_feature: GYAE6OF02IOUS2.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgcctactctggctcccagataccatcggagaagttgtgttgacacagtctccagcccaccctgtctttgtctccaggggaaagagccaccctctcctgcagggccagtcagaatattcactcctacttagcctgtaccaacagaaacctggtcaggctccagctcctcatctatgatgcactaccgaacgagggacccacgtggccatacccagacaggtcaggtggctaggtcgggtcgtgggacagtacttcacttcaccacatcgagcacggctaagacgcctagaacgtctttaggtaacctttattactagtcagtcaggtcgtgtacgtttcgtcgcccttcgcctacgttcgttgggaccgggacggggtacaggggtacgagtacgtaacgaaccggtaagtcggtacggtcacggtacctaccgtacgttcttacggtttcctctacgttcc

SEQ ID NO: 248733 - DNA, 637 bp, Homo sapiens
  misc_feature: GYAE6OF02FY3ZP.47.64.F09.1.454.CMB.1.raw
  modified_base (198)..(198): a, c, t, g, unknown or other
  misc_feature (198)..(198): n is a, c, g, or t
  modified_base (378)..(378): a, c, t, g, unknown or other
  misc_feature (378)..(378): n is a, c, g, or t
  modified_base (422)..(422): a, c, t, g, unknown or other
  misc_feature (422)..(422): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaanagcccaccctctcctgcagggccagtcagaatattcacctcctacttagccctggtaaccaacacgaaacccgtggtacacggcctcccgaggtcctacctcattcctatgatcgccgtccaccgacgggccctacgttcgggttccccaggccctaggttcacggtggcagtgcgtcgngggacaggcttcactctcacctatccaactacgccctgcacgtntacgaattacgtttgacttaacgtttattacgtcgtactacggtaaccgtaaacgttaaacgtaccgtcgggtacccttacgaccttccgtacggtttccggacggggacgggaccgtacggggttacaaccgttagtacgggaaacgtacgtggtcggactcggaccaccgtacgttcgtcgttaccttccgacttcccgttaccccgcttacg

SEQ ID NO: 248734 - DNA, 731 bp, Homo sapiens
  misc_feature: GYAE6OF02IL00Y.47.64.F09.1.454.CMB.1.raw
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagcccaccctgttctttgtcctccgaggggaaacgacgccaccctctccgtgcgacgggccagtcagtaatatcactctacttacgcctcggtaccaacgagaaacctggtacacggcctacccgaggtcctccctcatcctatgactcgaccactacccaacggacgggccctacgtcggccactccccgaagtaaccgtacgggttacacgggtacggcgagggttcgggtacgtacggggaacctacggtaccttacgtacttaccgtaccacccgtataccgacggtcacgtaccgttaagacgtcccgtaagtaacgttatttacgacgttacttttacgtacttgctagtacgtcgtagtacgactacgtgtaccttaccgtaccgttaccggttcggggaccggtaacggggtaccgtaggggacggtaacggtacgtaaccggtaccgggtaaaccgggtaccggttaggggtacccgggttaccggttaacccgtaccggttaacccgttcggtttaccccggttacgtttttaccccgttaacccgttaccccg

SEQ ID NO: 248735 - DNA, 673 bp, Homo sapiens
  misc_feature: GYAE6OF02G7VTC.47.64.F09.1.454.CMB.1.raw
  modified_base (188)..(188): a, c, t, g, unknown or other
  misc_feature (188)..(188): n is a, c, g, or t
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
tcagagctcacgtacacgaccggtgctcgatttagcgcgtatacaagggggaggaactgctcagttaggacccagagggaaccatggaagcccagctcagcttctctcctcctgctactctgctccagataccatcggagtaagttgtgttgacacagtctccagccacctgtcttgtctcagggaangccacctntcctgcaggccatcagaatntcactctatacgcctagtaccaanagaacctggcagcctccagctccgtcatctatgatgctactccaacgtacggaccacgttcggctaacctacccgaagaccgttacggttaccgagggttcgacgttacggggtaccggttcggtacggggaacgtaacggtttacccgtacgacccgtttacccgtaaccgtaaccctaagttaccccgaacggttaccgaccggttaccgtacggtaccctaccggtacgtaaacggttacggtttacgttaaccgttttaacgtacgtttccggtaattaccggacgtaacggtgttacggtcgttacgttcggtccctaccgtccgtcgtaacggtttccgggacggtaccgggacgttaggacggacgtacgtacgtaacgacgtgtacggacgttcgacgtacgtctagtccgttctccgtgtcccg

SEQ ID NO: 248736 - DNA, 799 bp, Homo sapiens
  misc_feature: GYAE6OF02JQSXJ.47.64.F09.1.454.CMB.1.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccacctgtctttgtctccgagggaaacngccacctctcctgcacggccagtcacgaattacttacactcctacttacgcctacggtaccaacgaactaaccgtggttcgaaccggctacccgaggtcctccgtactactaccttataggtatcgactactaccgaacgtacgggacccncgttacgccacgttaccccgaggactaccggtttcgaacggttccggacggttaagttcggggtacgttaggggaccctaagggtaacctttccgaacttccctaccgtaaaccccgtagttaccggaccacggttaaccgcccgttaaacggaccggtaacccgttaacgggtaaaccggtttaacgttttaccgggtaaacgttttaacgtttaaccggttacgtttacgaacggttaccgaccggggttaccttacggggttaacgtttccggtaaccggttcccgtacccggttaccgtttccggttaaccggttttacgggaccggggttaacccgggtacgggtaacggggtacggtaaccggtacgtaaccggtaacggtaccggttaggtacggtccgtacgtaccgtaccgtacgttcttacgttaccgttccttacgttcccg

SEQ ID NO: 248737 - DNA, 702 bp, Homo sapiens
  misc_feature: GYAE6OF02JOT0M.47.64.F09.1.454.CMB.1.raw
  modified_base (195)..(195): a, c, t, g, unknown or other
  misc_feature (195)..(195): n is a, c, g, or t
  modified_base (564)..(564): a, c, t, g, unknown or other
  misc_feature (564)..(564): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggaagtagttgtgttgacacagtctccagccacctgtctttgctccgaggggaangcccaccctctcctagcgacgggtccagtacgagtaggttggttaggccagccttaacgttcgcccgtttagggaacccaaacgagttaaacccgtggttacgaacggccttacccgaggcccttacctcgagttcctagtagactacgactacctaccaaacggcggtcccaacgtggcccaacgttaccccgaggaaccgttcggtttaccgaagggttcggccgtaagggttccggggttaacacggggtaactacggtacccttacgtaccttaccggtacacccgttataccggacgtacgtccgtaccggtagaccgtcgtacgtaagttagttacgttactttagtactacgactagtacgngtagtcgtacgttcgtacggccctccgtacttcgtaccgttcgggacgggtacggaccgggtaggtagacgacttaaccggaacgtagttcggtaggccgtagacctacgttacgtcgtttacgttacctactcccgg

SEQ ID NO: 248738 - DNA, 677 bp, Homo sapiens
  misc_feature: GYAE6OF02GN703.47.64.F09.1.454.CMB.1.raw
  modified_base (310)..(310): a, c, t, g, unknown or other
  misc_feature (310)..(310): n is a, c, g, or t
tcagagctcacgtacacgaccggtgctcgatttagcgcgtatacaagggggaggaactgctcagttaggacccagagggaaccatggaagccccagctcagcttctcttcctcctgctactcgtggcctccagataccagtcggagaagttgtgttgactacagtcctccagccaccctgtctttagtctcgaagggaactcgccctaccctcgtctgcgacgggccagtccagaacttactcgtaactcctacttgccgtagtaccaacgaagtaaccgtgtaccgacgcctccgacggtcctctaccnttccgtaagtcgtatcgctagtaccaagtccggacacgtgactacgccaagctagtcgaggtcggtactacgggtggtcggtaaggacgtaactcgtttaccgaatccgttaccacggtaacttccgacggacttaccggtaccgtaacgtaccgggaacttcgggtaaacgttctttaagggttaaccttacgtttaacgtccgtaagtaacggtccgtacggttcgaacgttcgttaccgcgtccgtacgtccgtcgttacgtcgggtacgggaccgtaggtcggtaacgacgttacgaaccgaaccggtgttacggcgttacgaccgtccgacgtcgttccgtagtttcctacgttcctccccg

SEQ ID NO: 248739 - DNA, 797 bp, Homo sapiens
  misc_feature: GYAE6OF02GYAV4.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaagggggaggaactgctcagttaggacccagagggaaccatggaagccccagctcagcttctcttccgtcctgctactctggtctcccagataccatccggagaagttgtgttgaccacagtctccgagccacctgtctttgctccgaggggaagngccacccgtctcctagccgacgggcctagtcagaacgtattcgacctcctaacttgcctaggtacccaacgagaaacctggtcacggctcccgaggcctcctcacgttctagtcgagttcgaccgtatcccgaaacgacggggtcccctaacgtcgggacctaacgtcccccaaaggtacccgtagggtttaccaggttggtccaaggttcggggtaccttaggggaaccctacggtacctttacgacccgttaccttaccgaccctagtacccgaacggtccgtaaccgtcccgttaaaccggtaccgtccgtaaacggtaaaccgttacccgtttaggggttaaacctttttacgtaccggttacgttaccgacgttaaccggacgtaccggttagttaccggtttccgtaccggggtccctttacccggtccgttacccgttacgggtttacccggggaccgggttaacggggacccggttaagggggtacgggtaccggtaccgttaacggtaaacccggtcggtaggggttccggtaaccgtcgttacccgaccgtcggttacccgtggtacccgttactccggttaccccg

SEQ ID NO: 248740 - DNA, 591 bp, Homo sapiens
  misc_feature: GYAE6OF02GD62S.47.64.F09.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (384)..(384): a, c, t, g, unknown or other
  misc_feature (384)..(384): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangcccaccctctcctgcagggccagtcagaatnttcactcctacttagcctggtaccaanagaacctggtcaggcctcccaggcctcctnactctatgatgcatacccgaacgacgggccacgtggcactcccagaccaggttcagtggctaggtgggtctgggacaggacttcacttctaccaacctntcagtccacgcctaagacgtcgtagaacgttaccgtttacggtactttagttacttgtacagcgtacgtcgtagtcgtttacgtcggtcccgtccgtcttccgtacgtttccgggacgggtacgggtaccggagggtcggaggtactacgaacgtacgtggtacggtcgtacggacctactacttccgtacgttcctctacttcccg

SEQ ID NO: 248741 - DNA, 703 bp, Homo sapiens
  misc_feature: GYAE6OF02I4KIL.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaancgccaccctctcctgcagggccagtcagaatatcactcctacttagcctaggtaccaacagaaacctggtcaggctcccaggcctcctcatctatgatgcatccaaacgacgggcccacgtggacctatccccaagacaggtttacaggtcggactaggtcgggtcgtagggacctagtaccttcacttactacgacctatcacgtcaacgtaccgttaagaccggtaccttaggtaaacgttcgtttttacggactttagttttaattaccgttagtactaacggttaactaaaaccgttaaacttacccggtaggtaccccctaccggttaccgttaccgttacggtttacccggggacgggtaaccgggtaccgggtagggtacgtaaaccggtacgtacgaaaaccggtaccggttggtaccgggtcctaaccggtaccgtaaacccgtcgtttacccgttaccggttaccctttacggttaccctttcccgttaacccccgg

SEQ ID NO: 248742 - DNA, 629 bp, Homo sapiens
  misc_feature: GYAE6OF02FOYHA.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccaggctcctcatctatgatcgacatacccaacgtacggggccaacgtggaccactccccaaggtacctaagggttccaagggtcggaccgtaggttcggggtacgtggggaaccagtaccttctaaccgtcctacgacccaattaccacggactaacggccctaaggccggtaccctaggtaagtaccgtttaggtaacctttattaccgtgtactacgtcgagcgttgtagttcgtcgtccgtccgtcctcgtcgtttcgggcggaacgggtaccgtaggggtgacgtacgtaacgaacgtaacgtcggtacgtcgtacgccgtaccgagttcctcggtaccttcgtattccccg

SEQ ID NO: 248743 - DNA, 566 bp, Homo sapiens
  misc_feature: GYAE6OF02FEZ7F.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgtttgacacagtctcaagccaccctgtctttgtctccgaggggaaagngccaccctctcctgcagggccagtcagaatattcactcctattagcctggtaccaacacgaaacctggtcaggctcccaggctcctcatctatgatcgcatccaacgagggccacgtcggacactcccagacgagtttcgaggtggcaggtgggtcgtgggactagacttcactctcgacctagtcacgcaacgcctaagacgccgtaggaaacgtcgtttacggtacttttaacttactgtctaacgtcgtagtcgttggtacgtttcgtcggccctcgtctctacgttcggcgggtacgacgagggtgagatacgaacgtacgtgcggtcgtcgacactacgttcgtacgtcttctacttcccg

SEQ ID NO: 248744 - DNA, 807 bp, Homo sapiens
  misc_feature: GYAE6OF02IQ2E5.47.64.F09.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (411)..(411): a, c, t, g, unknown or other
  misc_feature (411)..(411): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagaatatcactcctacttgcctacggtaccaanacgaacctggtacagcctccaggctcctcatctatgatgacactccaacgcgggccacgtcggacaccgtccagactaggttcgaggtcggacgtaggttcggggtacttggggaactacgggtacttacgtaccgttaccgttaccaaacccgngttaccgacgtaaccgacgggtacctaacggtaacgacccgttaaggtaaacggttaccgttttttacggggtaacttttttaaacgttacccggtttacgtttaaccgacggtaccgttaagggtaccggttacgggttaccggttttccgccgggtttacccttccccgggttacctttacccggtttacccgggttttacgggggaaccccggggtaaacggggggtaacccgggttaacgggggtacgggtaaaccgggtaacccgtttaaccggaaaaccgggtttacgggtttaaccggtccggggtaacccggttacggtaaccccgaccggttttaccggtttacctttacgggttttacccttacccttaaccggttttacccccgg

SEQ ID NO: 248745 - DNA, 681 bp, Homo sapiens
  misc_feature: GYAE6OF02I7RBO.47.64.F09.1.454.CMB.1.raw
  modified_base (144)..(144): a, c, t, g, unknown or other
  misc_feature (144)..(144): n is a, c, g, or t
  modified_base (194)..(194): a, c, t, g, unknown or other
  misc_feature (194)..(194): n is a, c, g, or t
tcagagctcacgtacacgaccggtgctcgatttagcgcgtatacaagggggaggaactgctcagttaggacccagacggaaccatggaagccccagctcagcttctcttcctcctgctactctggctcccagataccatcgganaagttgtgttgacacagtctccagccacctgtctttgctccgaggggaancgccaccctctcctgacacgggccagtcaagtattgtcactcctaacttagcctaggtacccaatagaaaccctggtacaggtcctccccgaggtcctccgtacactctatcgatcgacactaccgaacgccgggaccacgtcgggaccacgtacccgagtaccgtggttaccaggtcggacgtagggttcgggtacgtagggacacggttacttaccgaccttctaccgtaactagtccacgggacctacgaccgtaggaccgtccgtaaggtaaccgttacggtttacgttacgtttacgtttacgtacgttacgtacgtacgtacgttacggtacggttacgttcgttcggtacccgttccgtccgttccgtaacggtttcgggacgggtacgggtacggtacgggtacgtacgtacgtaacgaacggtaacgtcggtacgcgttacgacgaccgtcttacgtacgtttacgtctacgttcccg

SEQ ID NO: 248746 - DNA, 330 bp, Homo sapiens
  misc_feature: GYAE6OF02HBYFL.47.64.F09.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (300)..(330): a, c, t, g, unknown or other
  misc_feature (300)..(330): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccaagggggaaangccaccgtctccngcagggccagtcagagtgtcggcagcaaactacttagcccttggtaccagtcaagaaatctgggccaaggcctcccaggcctctcgtaatnnnnnnnnnnnnnnnnnnnnnnnnnnnnnnn

SEQ ID NO: 248747 - DNA, 725 bp, Homo sapiens
  misc_feature: GYAE6OF02G7L9F.47.64.F09.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (372)..(372): a, c, t, g, unknown or other
  misc_feature (372)..(372): n is a, c, g, or t
  modified_base (467)..(467): a, c, t, g, unknown or other
  misc_feature (467)..(467): n is a, c, g, or t
tcagagctcacgtacacgaccggtgctcgatttagcgcgtatacaagggggagggaactgctcagttaggacccagagggaaccatggaagccccagctcagcttctcttcctcctgctactctggctcccagataccagtcggaagtaagttggtgttagacactacgtctccacgcccacccgtgtctttcgtcctccgtaagggggaaanacgtcccacccttcncctagcgacgggcctagcaagtaattctctactccttaacttagcctacggtaaccaacgagtaaacctggtacgaggcctccgaggtcctcctacagttacctagtacatcggacctaacgtacaaaccggcggtacccctancgggtaccaacgtaccccgaaggtaacttacggttccaaggggttcggacgaacggtttcgggccggtaagggacggttaaccgcgtttaaaccnctaccgtaccacactccgaacggactacggaccgtacgtacgtaccgtaagtacgttaacgttcgttaactttacgttacgttacgtacgtacgtacgacgttacgtggtaaccgtccgtacggttcccgtccggtcttccgtaccggttcgggtacggaccgggtacggtacggggtacgtacgtacgtaacgtaaacggtacgcggtacgtaccgacggtaccacgttaccgtcgttcggttactcctactcccgg

SEQ ID NO: 248748 - DNA, 740 bp, Homo sapiens
  misc_feature: GYAE6OF02I04X4.47.64.F09.1.454.CMB.1.raw
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (710)..(710): a, c, t, g, unknown or other
  misc_feature (710)..(710): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagcccacctgttctttgtctccgaggggaaagcgccacctctcctgcagggccagtcagaattatcactcctacttagccttggtaaccaatacgaaccgtggtcacggcctccgaggactcctnatctatgatgcactaccgacggacggccncgtaggcctaacgtcccgagtaacgtacggtctaggtggtacgtaggtcggggtcgtacggggtaacacggtacgttaccgtaccttccgtacccaccgtaacttaccgaccggtaccgtaacgtaccctaaacggtaccggttaacccggttacgggtaaaacgtttaccggttttaacgggttttaaaccgttttaacgttttaacgttacgttaacgttaacggtaccgttacgggtacggttacgtttacggtttaccgttacgggttccccgttaccgttccgtaccgtttaccggtttaccggggacgggtaaccgggtcgggtacgggtacgggaacgtacgtaacggaaccggtacggtcggtacggtcgtacgccgtacncgttaccgttcgttacttctacccgttccg

SEQ ID NO: 248749 - DNA, 619 bp, Homo sapiens
  misc_feature: GYAE6OF02G3SR9.47.64.F09.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgctccaaggggaangccaccctctcctgcagggccagtcagaatattcactcctattcgcctggtaccaanacgaacctggtacaggcctcccgaggctcctcatctatgatcgcaactcccgaaacgtacggggccacgtggaccactcccagactggtcacgtggctaggtcgggtcagggactacgtacttcgactctaccaacctatccgagacccgtacgcccgttaagacgtaccgtaaggtaacgttaccgtttacggttaactttatacgtgtcgaacgtcgtaatccggtagtacgttcgtcgtaccgtccgtactcgttaccggttcgggacggtacgggacctaggggtcgaacgtactaacgaaacggtcgtgggtacgcgtacggactaccgtgttccgttcggtacctttcggtacttaccccgg

SEQ ID NO: 248750 - DNA, 828 bp, Homo sapiens
  misc_feature: GYAE6OF02GDHLL.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccgaggggaaanagccaccctctcctgcgacgggccagtcaagtaatattcaccttacctacttacgcctagggtacccaaacacggtaaacctggtccaacggtcctccccgaggtccttccctacgacttctaagtcgaagttcgacctaacgttacccaaacggacggggaccctaacctcggggaccaaccttccccgaaacgtaaccgaggtttcaaggttgggacctaacgggttggggtaccgtcggggaactacggtaaccctttacgaaccgttcttaacccgacccgtaacgttacaacccggtaccgtaaccgggacccttaagaccgtaccggttaacggtaaacgtttacgttttacgggttaaccttttagttaaccttacggtaccgacgtaccgtaaggttacccggtaaacgtaccgtaaacggttcccgggtaccctttaccgttaccgtttaccgtttcccgggggtaacggggtaccggggttaaacccggacgggggttaacgttaacgggaacgttaccgaacggtaaacccgggtaacggtttacgggtacggtccgttaccggtacccgtaaccgttaccgttacgttcccggtttacttttaccctacggtttaccccc

SEQ ID NO: 248751 - DNA, 756 bp, Homo sapiens
  misc_feature: GYAE6OF02JZLFF.47.64.F09.1.454.CMB.1.raw
  modified_base (195)..(195): a, c, t, g, unknown or other
  misc_feature (195)..(195): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttattttgacacagtctccagcccacctgtctttgtctccgaggggaanacgccaccctctctgcgagggtcagtcagagtgttgacagtctacgttagtactggtaaccaagaacgtaaccgtggaccaggtcctacccaggcttcccgtcgtactcgggttacggggatcggacaaccgtacccgaacggtacgggccctaacggttcggactaccgtacccgaaggtaacccgtagggttcaaggggtcggtaccgtaggggttcgggtccgttaggggaacctaggttaacctttacaccttcgtaaccgacctaacgtccaacggacgtaccgtacccgtagggaaccgtcgttaacggtaaacgttacgtttacggttaaccgttttaacttaccgttacgtacgtaacggtccgtaggtccgggttagtacgtttaccgacgggtcccttccgtaccgtaccgttaccgggtttaccgggaccgggtaacgggttaccggtaagggtacgggtaagacggttaccgaaacgtacggttacggtcggcgtacgacgtacctacggttaccgttcggttacgtccgttaccgtacccgttacccg

SEQ ID NO: 248752 - DNA, 737 bp, Homo sapiens
  misc_feature: GYAE6OF02GMUKK.47.64.F09.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (337)..(337): a, c, t, g, unknown or other
  misc_feature (337)..(337): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagccaccctgtctttgtctccgaggggaaancgccaccctctcctgcgagggtcagtcagagtgttanacagcttacttagtcgtaggaccaaggagaaacccgtggaccaggcctacccgaggccttcctcattccggtgggactgccacgtaccgaacgtacgggccngtcggacctaccgtcccgacgtcccgtagggttcagggtcggcgtagggttcgggacggtagggactaaggttacccttcgacctccgtacccaaccgtacgtacgacgcctaaccgtccgtaaggaccgtaccgtaagtaacgttacgttttacgacgtttaaggtttactttacggttacgttacgaacgtaacgttaaacgttaaacgttaccgtacggtaccccgttaccgtaccgttacccgttacgggtttacccggggaacgggtaccgggtaacggtacgggtacgaacgtaacgttaacggaaaccgttacggttcggtacggtacgttaccggaaccgtaccgttacttcggttccgtttacccttagtacccgtttcccgtaaccccgg

SEQ ID NO: 248753 - DNA, 855 bp, Homo sapiens
  misc_feature: GYAE6OF02HEJ4C.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgcctccgaggggaaancgccaccctctcctgcagggccagtcagaactattcactctacgttagcctaggtaaccaacgacgtaaacctcggtacgaaggtcctacccggaaggtcctacccgtacaacttactaagtcgtaagttcgacctaacgttacccaaaccggacggggtaccctaacgtcgggaacctacgtcccctaaaggacccgtaaggggtttccaaagggttcggaaccgtaggtacgggtaactttccgggagggggaacctaaacggttcccttacggaaccctttccggaacctaaacccgttcggtacaaccggttaacccgaagttaccccggttaaagggacccgtaaccggtttaaacggtaaacgggttttaactttttaccggaaccttttaaacgtttttaacgttaaccttaacggggttacctaaacgggtccgttaaaccgggtcggttaaaacgtacccgttaaacggttccgggttacccttaaccgttccgttaaccggggttttaccggggcggggaaacggttaccgggtaaggggttaccggaagttaccggaaccgaaggggttaaacccggtaacggttggggtaccccgtagtttaccggaccgtaaaccttcggtttacgttcgttaacccggtttaccg

SEQ ID NO: 248754 - DNA, 835 bp, Homo sapiens
  misc_feature: GYAE6OF02GSVQK.47.64.F09.1.454.CMB.1.raw
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagcccacccttgtctttgtctccgaaggggaaagagccaccctctcctgcagggccagtcagaatattcactcctacttacgcctggtaccaacgacgaaacctggtcacggcctccgaggcctcctcatctatgatgaccactccaacgacgggccacgtcggccacgtcccgaaggacgtacggttcgacggtggccgtagggttggggtccgtaggggacctaagggtacccttacggtaccttcctaccgtaacccctacgttacccgaaccggtaccgttaaccggacccgtttaaagggacccggtaccgtttaaacggggtaaaacggtttacccgggttttttaacgggttaaacccgttttttaattaccccgggtttcggttaaccggtaacggttaccgtaagggttcccggtttaacgggttacggttttccggttacccgggtccccgtttacccggtttcccgtttaccggtttaacccggggtttcccgggggaaccgggggtaacgggggttacccggttaagggggggtcggtaaaccgttaccgggttaaccgtaaaaccgggttcgttccggggttaacggtcccgaacggtaacccaccggttacgttccgttaaccggtttacccgtttacgtacccgttttcccccgg

SEQ ID NO: 248755 - DNA, 687 bp, Homo sapiens
  misc_feature: GYAE6OF02F1R5O.47.64.F09.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagtttgtgttgacacagtctccagccaccctgtctttgtctcgaggggaaangccaccctctcctgcgagggccagtcagaatattcactctactgcctaggtaccaanagaacctgtcaggctccagcctctcatctatgatgacactaccaacgacggccacgtcgcactccagactggttcagtggactggtgggtctgggacagtacgttcactctacgactactacaacacgtccgtacgactagtcgtagtaagttacgttttacgacgtttaagtttacttacgttcgttacgtacgtacgttaacgttactaccgttaaacgttaccggtcgggtaccccgttaccgttacccggtacccggttttaccgggaacccggtaaaaccgggtacccgtaaaccggttaacccgggtagggttaaccgttaaacggttaaaaccgggtaacggtttacgggtaccggtaccgttaccggaaccgtaacccgttacgttccgtttaccgtttaccgttacccgttaccgttacccccg

SEQ ID NO: 248756 - DNA, 593 bp, Homo sapiens
  misc_feature: GYAE6OF02FROYC.47.64.F09.1.454.CMB.1.raw
  modified_base (196)..(196): a, c, t, g, unknown or other
  misc_feature (196)..(196): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgctccaggggaaanagccaccctctcctgcagggccagtcagaatattcactcctacttagcctggtaccaacagaaacctggtcaggctcccagcctcctcatctatgatgcatcccaacgacgggccacgtggcactccccagaccaggttcagtggcaggtcgggtctgggacagtacttcactctccaccntcacgcagcctagcncctagaagtactttggtaactttagttactgtcacgctagtcgtgtacgttcgtcggtccctccggcttcgttaccgtttcgggacgggtacgggtacccgtagggggtacgtaggtacgtacgtaaacggtacgttcggtacggacgttacgacccgtaacctacgttccgttacggtttccttaccgtacgtttccccc

SEQ ID NO: 248757 - DNA, 881 bp, Homo sapiens
  misc_feature: GYAE6OF02G93I2.47.64.F09.1.454.CMB.1.raw
  modified_base (205)..(205): a, c, t, g, unknown or other
  misc_feature (205)..(205): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggcctcccagataccagtcggagaagttgtgttgacacagtcctccagccctaccctgttctttgcctccgaaggggaaancgcccaccctctcctgcgacgggccagtcaagtaattacttccacctccttacttacgccgttacggtaaccaaacgtaacgtaaaccctggtaccgacggtccctacccgacggtccctaccgttactacttacgttacgtcggtaactcggtacctaaccgtaaccgaaaccggtaaccggggaccctaacgggtccggtaacctaaccggttaccccaacgggtaacgttaacgggttaccgtaacgggtcggaccggtaagggttcgggtacggtaacggggactaacggttaccttaccgtaacttcctaaccgtaaccgtactaccgtaaccgacgtaaccggtccgtaacggtaacccggtccgttaaaggttaacgtttaacgttttaccggtaaccttttaaaccgttttaaccgtttacgttcggttaaccgtacggttaccggtaaccgttaaccggtactaaacccggttacgttaccgtaccccgtttacgttacccggttaaccgggtttcccggggaaccgggtaaccggggtacggggtaaccgggtagggtaaccgtaaccggttacggaaccggttaacgggttacgttacgggtcccggtacgtaccggtacccttaaccgttccgttaaccggttccgttacttaccccgttaccg

SEQ ID NO: 248758 - DNA, 764 bp, Homo sapiens
  misc_feature: GYAE6OF02H3KVX.47.64.F09.1.454.CMB.1.raw
  modified_base (208)..(208): a, c, t, g, unknown or other
  misc_feature (208)..(208): n is a, c, g, or t
  modified_base (590)..(590): a, c, t, g, unknown or other
  misc_feature (590)..(590): n is a, c, g, or t
  modified_base (687)..(687): a, c, t, g, unknown or other
  misc_feature (687)..(687): n is a, c, g, or t
tcagagctcacgtacacgaccggtgctcgatttagcgcgtatacaaggggggaggaactgctcagttaggacccagagggaaccatggaagccccagctcagcttctctcctcctgctactctggcctccagactaccatcggagtaagttgtgttgacactagtcctcacgccacccttgttctttcgtacctccgaagggggaaanacgccctacccttctccgtgaccgacgggccctaggtacaagtaacttacttacaccttaccgtaacttacggtccgttacggtaaccaacgtaacgtaaaccgttggtacgaacggccttaccgacggtccttccgtactaacttccgtaatacggtactccgtactaccttaccgaaaccggtaccgggtacctacgtaccggacctaccgtacccgaaggtaccgtaacgggttacacgggttacgcggtacggttcgggttaccgtacggggaacttacgggacctttaccgaaccgttccctaacctacggtactacggtacgaccgtacgtacgtaacgccgtacgtacgtaacgttagttacgttactttaacgngtacgtacgagtacgtagacggtttactcggttaccgtcgggtccctacggtcccttaacgttccgggttaccgggaggcgggttaacgaggggttnacgtaacgtacgtaacggcgttacggtcggaccttacgccgtacacggttccgtttacgaccttctacgttccccgg

SEQ ID NO: 248759 - DNA, 820 bp, Homo sapiens
  misc_feature: GYAE6OF02INOCR.47.64.F09.1.454.CMB.1.raw
  modified_base (562)..(562): a, c, t, g, unknown or other
  misc_feature (562)..(562): n is a, c, g, or t
tcagagctcacgtacacgaccggtgctcgatttagcgcgtatacaaggggggacggaactgctcagttaggacccagagggaaccatggaacgccccagctcagcttcttccttcctcctgctactctcggcctacccagactaccatcgggaagtaagtttgtgtgacactacgtcctaccacgcccctacccgttgttcctttacgtccgtaccggaaagggggaaactacgcccctacccttcgtcctggaccggacgggtaccacgtacaagtaacttacttctaactcctaacgtacgtaccgtacgtaaacaaacgtaacgtaaaccgtcggtaccgacggtacccgtaccgtaacggtcctccgttaactacttacgtaagtcgtaacgtcgacctaaccaaccgtaaacgaccggacctaacgtaccgtaccaacgtaccaaggtacgtacggtacggacggtcggtacgtaacggttcgggtcgaacggtacgtaccgtacctctaccgttcctaactaaccgtactaccgaacgtacgaacggtcgtaaacnccggtacgttaaggtaacggtttagtttaaccggtaactttaacgttacgttaagcgtacgtacgttacgacggtttacggtacgttcggcccgttaccgttcccgtacgttccggttaaccgttcggggaacgggaaccgggttcggaagggtacgtaacgtaacggaaacgaaccggttcgtacgggtaacgttaccgacggtttaaccctacgtacgtttaccggttacttcccgtttaacgtccccgtttaacc

SEQ ID NO: 248760 - DNA, 690 bp, Homo sapiens
  misc_feature: GYAE6OF02HM6SG.47.64.F09.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (289)..(289): a, c, t, g, unknown or other
  misc_feature (289)..(289): n is a, c, g, or t
tcagagctcacgtacacgaccggtgctcgatttagcgcgtatacaagggggaggaacgtgctcagttaggacccagagggaaccatggaagccccagctcagcttctcgttcctcctgctactctggctcccagtataccatcggagaagttgtgttgacacgagtctccagtccaccctgtctttgtctccgaaggggaaancgcctaccctntccgtncgaggccagtcagtatattcactcctatgctaggtacacagaaacctgtcaggcctaccagctctcatntagtgatcgacactccgaagacgggcctaacgtcggctactcccgagtactagggttcctaaggtcggcgtacggtcgggtctacggggactaacggtaccttcgaaccttccgtaccaaccgtactccggtaacgccgtaacgtcccgtaaggtaacgtcccgaaaggttaacgttaccgtttaaggtacctttacgttacgtacggtacgtacgtcgacggttaccgtagtacgttccggtacggttaccctcccgtacgtcccgttacggttaccgggcgggtaaacggtacccggtaagggtacgtaacgtaccggtagtaaaacccgtaggttccggtaacgccgttcgaaccggtaacttccgtacgttaccggttcctttacacccgtttcccg

SEQ ID NO: 248761 - DNA, 645 bp, Homo sapiens
  misc_feature: GYAE6OF02HUAHV.47.64.F09.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (289)..(289): a, c, t, g, unknown or other
  misc_feature (289)..(289): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtctccagccacctgtctttgtctccgaggggaaancgcccaccctctcctgcagggccagtcagaatntcactcctatgcctagtaccaacagaacctgtacaggctccaggctcctcattctatgntgacactccaacgacgggccactggcactccccaagacgtaggttcaggtggacaggttgggtacgtcgggacagtacttcaacctcgtacaccgtatcgagcgacgtacctagaccgtccgtaaggaacgtttaccgttttacggtaacctttagttaccgtagttaccgagtaccgtaggtaccggttagtaacggtttcccgtacgggtccccttacccgtacctttaccggtaccggttccggggtacgggacggggtaccggaggggttacggacgtacttaacgaaccggtaagtcggtcggtcctacggaccttccgtaattccggttacttccgttctaccgttcccg

SEQ ID NO: 248762 - DNA, 777 bp, Homo sapiens
  misc_feature: GYAE6OF02ISD6T.47.64.F09.1.454.CMB.1.raw
tcagagctcacgtacacgaccggtgctcgatttagcgcgtatacaaggggggagggaactgctcagttaggacccagagggaacatggaagcccagctcagcttctcttcctcctgctactctggctccagagtaccacgtggagaaataggtgatgacgcagtctacacgaccacctgttctttgtctcgtagggaacgacgccaccctctccgtcgacgacggtacagtacaggagtacgttagacgacgtagttacccccccccccccgttagtacgtacgtaacgtaacgtaacgtaaaccgtacggtaccgacggaccgttacccggacggtacccgtaccgtactacgtcgtacgggtagtacgactacgtaccgaaccggacggccgcgtacgtcaccgtcccgacgaccgtacggtacgtagtcggacgtgggtaggtcggtacggacgacgtacttacgtactactaccactactacacgacgtacgtaccgtagacgtaaccgtagtaacgttatttacggacgttaactttagttacggtactacgtaacgtaaccttaaacgttacttaccggaccgttcccgtaaccgtaccgttaccgttacgttccggggaaccgggttacgggtaaccggttaggggtaaccgaacggttacggtaacgttaaaccgggtacggttaccgggtttacgggaaccttaacgggacccttaaaccggttcgttaccccggtatttacccgtttaccctaacccggttaccccg

SEQ ID NO: 248763 - DNA, 699 bp, Homo sapiens
  misc_feature: GYAE6OF02FL7MC.47.64.F09.1.454.CMB.1.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (263)..(263): a, c, t, g, unknown or other
  misc_feature (263)..(263): n is a, c, g, or t
tcagagctcacgtacacgaccggtgctcgatttagcgcgtatacaagggggagaactgctcagttaggacccagagggaaccatggaagccccagctcagcttctcttcctcctgctactctggctcccagattccaccggagacatttgttttgactacagttctccagcccaccctgtctgtctctccgaggggaaangccacatctcctgtacgggccgtnacggagtattagcagtaccaacgtttagccttggtaccngcctaagcgaccgtgggcacgggtcctcccgagggtccttcccgtacgtaattccgtaactggaacttcggcccgttacccgaccgtaggggcccctaacggtttccggttccccagtaccccgtagggttccaggtggacctggtcggtctcggtaagggaccgtagggtaacttcgtacctcgtacctacctcgtaccaaccgagtccgtacgcgtacgtacgtagtaacgttagtttcgacttagttttactacgttcgacgtacgtacgtagtatacgtattaaccggtcgtaccgtcctaccgttaccggtaccggtaaccgaacggtcgacggtacgtacgggtaactaacgttaaaccgtaacgtcggttacgggtacccttggacctacgttacgttacgtcggttaccttaccgtcccgttacccgg

SEQ ID NO: 248764 - DNA, 729 bp, Homo sapiens
  misc_feature: GYAE6OF02FVV9K.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagattccaccggagacatttgttttgacacagtctccagccaccctgtctttgctccgaggggaaanagccacctctcctgcaggccagtcagagtgttggcagctacttagcctggtaaccaacacgaaacctggaccaggcctccgaggctcctcagtctaatgatgctatccaaacgcggaccagtggcacgtcccgaagtcccgtagggttccaggttcggccgtaggttcgaagttccggtagggaacctaacggtaccgttttaccaccgtttaccctccaacccgtagttccaacggtcctacggtacccgttacggaacgttacccgttagggttaaacgttacgtttttacgacctttaacttttaactttaacgttcgttaacgtacggtactaacggtaccgtaacgtaccgtaaacgtccggtacccttaccgttaccgttacccggtttaccggggtaccgggtaacgggtaccggtagggggttacggtacggtacgtaccggaacggtaaccggtaaccgttcgggtaccgggtacgtacggtaccgtaacccgtacgtttaccgttcggttaccctttacccg

SEQ ID NO: 248765 - DNA, 724 bp, Homo sapiens
  misc_feature: GYAE6OF02GTXQV.47.64.F09.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (498)..(498): a, c, t, g, unknown or other
  misc_feature (498)..(498): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggcctcccagactaccatcggagtaagttgtgttgacacagtctccagccaccctgtctttgtcctcgaaggggaaangccaccctctccngcgacggccagtcaagtaacttacttacacgtccttaccttagcccttaggtaaacccaaacgtaacggtaaaaccttcggtacgacggtacctcccgaacggtcctccgtcacttccttaatacgaagtcggaacctaactaacccgaaaaccgtaccgggacccaacggtacggacctaaccgtccccgaacgtacgtacggttccgtaggtcggacgtacgggttcggacggtagggaccaagttaccgttacgtaactcgtacccaacgtaactccganacgtacggacctaacggacggtacctaaggtaaacggttacgtttaacggttactttaacgttaacgttgtaccgtaagccgtagtacggtgttacgttccggtcgtacccgttcgtccttacgtacggttcgggacggtacggacggtacgggaggtacgacgtaacgaacggtacgtcggtacgacgtagtacgacctcgtcgttacgttcttccgacttcccg

SEQ ID NO: 248766 - DNA, 671 bp, Homo sapiens
  misc_feature: GYAE6OF02IT1UM.47.64.F09.1.454.CMB.1.raw
  modified_base (263)..(263): a, c, t, g, unknown or other
  misc_feature (263)..(263): n is a, c, g, or t
  modified_base (495)..(495): a, c, t, g, unknown or other
  misc_feature (495)..(495): n is a, c, g, or t
  modified_base (522)..(522): a, c, t, g, unknown or other
  misc_feature (522)..(522): n is a, c, g, or t
tcagagctcacgtacacgaccggtgctcgatttagcgcgtatacaaggggggaggaactgctcagttaggaccccagagggaaccatgggaagccccagctcagcttctcttcctcctgctactctggctcccagataccatcggagaagttgtgttgacacagtctccagccacctgtctttgtctccgaggggaaagcgcctaccctctccgtcgcgacgggccagtcaagaatattcactcctacttagcctggaccaanacgaaacctggtacacggtcctacccgaggtcctacctcattctatgatgactactaccgaacgagggaccctacgtcggacctactacccgagtacgacggttcgaggtcggacgtaggtcggggtacgtagggaactaggtaccttataccgttctaccgaacctatccgacgtacacggtaccgtaacggacgtcgaagtaacgttacgtttaggtaactttacttacngttacagcaggtcgtagtacgttccgnggcccttaccgcttaaccgtcggttccgggacgggtcggaccgtaaggggtacggtaagacctaacggtaaaccgtcgggttacggtacgggtacttaacggacgtaccttacgtccggttacggtttacttacgttacccttacccgg

SEQ ID NO: 248767 - DNA, 706 bp, Homo sapiens
  misc_feature: GYAE6OF02G2IHS.47.64.F09.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtcctttgctccgaggggaaangccaccctctcctgcacgggccagtcagaatnttccactcctacttagcctaggtaccaacacgaaacctggttcaggcctcccgaggcctcctcactctatgtatcgacatacccaacgcgggccacgtggccactccccagtacgtacggttccaggttcggacgtaggttggggtctaggggaacctaggtacctttccgaactcctaccgtaccctattcgaacgtcctacggacctaacggtacgtaccctaggtaaacgtttacgttttacggtaaccctttttagttaaccttggttaccaacgtcgtacggtcggttacgtaacggtttcgtccggggtcccttacccggtcgttaacccggttcggtttaccgggcggggttaaccgggaccggtaacggggttcgggaacttacggtaccgtaaaacggtcggttacggttacgggtacctacggtacctactaccggttccgttcgttaccctttacgtccttcccgg

SEQ ID NO: 248768 - DNA, 642 bp, Homo sapiens
  misc_feature: GYAE6OF02IW2TO.47.64.F09.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (500)..(500): a, c, t, g, unknown or other
  misc_feature (500)..(500): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgttctttgctccgagggaaancgccaccctctcctgcgacgggccagtcagtagttatacgctatcaacttagcctaggtaaccagcagagaccgtggcaggcctccgaggcctccgtacatacgtagtcggnacgtactcccacgtacggcctacgtcgttacacccgtagcccgttaggttccgaggtacggccgtagggtcggggtaccgtagggacttaaggtcgttccaacgttcccacaaccgtataccgaagtccgaggtccctaggacgtacgtacgtagtacgtttaacgtttctaacgttaatttagttaacgtntacgagtaccgtagttacacgtacgtaacttcggacctacgtacctaccgttacgaccgtaaggtacctacgggagttacggaagtactaaaccggtcgtcgtacggtctacggtcttaaccgtcgtacgtccgtattaccg

SEQ ID NO: 248769 - DNA, 765 bp, Homo sapiens
  misc_feature: GYAE6OF02HX7JC.47.64.F09.1.454.CMB.1.raw
  modified_base (130)..(130): a, c, t, g, unknown or other
  misc_feature (130)..(130): n is a, c, g, or t
  modified_base (136)..(136): a, c, t, g, unknown or other
  misc_feature (136)..(136): n is a, c, g, or t
  modified_base (156)..(156): a, c, t, g, unknown or other
  misc_feature (156)..(156): n is a, c, g, or t
  modified_base (199)..(199): a, c, t, g, unknown or other
  misc_feature (199)..(199): n is a, c, g, or t
  modified_base (593)..(593): a, c, t, g, unknown or other
  misc_feature (593)..(593): n is a, c, g, or t
tcagagctcacgtacacgaccggtgctcgatttagcgcgtatacaagggggaggaactgctcagttaggacccagagggaaccatggagccccagctcagcttctcttcctcctgctacctctgctccanataccntcggagaagttgtgttgacncagtctccacgtcccacctgttctttgtctccgaagggtaaanccgcctaccctcgtccgtagccgacgggcctaggtacctaggtaggttggttcgggacgtaacgtaccgttacgtttaaccgtcccgttaacggtaaccctaaaccgaaaccggtaaaccttccgggaacccgtacgggtaccccgttacccgtcgggtacccttacctaccgtttactccgttaacgtacggtagttaggacccgtaacgtaaaccccgtaaccggacgggttcccaaccgttaccggcctaaaccgtccccgaagtccccggaggttacccgagtcggtacctaacggggtttacgggttacgtcggaaacgtacgtacttccgacttcctaacccacgtctaacgactacgccgtaactacgtacggtacgtagtaacgtntttacgtacttaacctttcttcgaagtcaacgcgtaacggtcgtacgtacctacgtcgttcccgtacttcggttaccgttcggcgggaacggtcgggagtaccgaggttacgaagtaacgaactaaccggttgccggtaagtccacgtaacgttacgtcttaccggtacccg

SEQ ID NO: 248770 - DNA, 823 bp, Homo sapiens
  misc_feature: GYAE6OF02H8283.47.64.F09.1.454.CMB.1.raw
  modified_base (145)..(145): a, c, t, g, unknown or other
  misc_feature (145)..(145): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagacttccaccgganactatttgttttgacacagtctcagcccaccctgttctttgtctccgaaggggaaagacgccctaccctctccgtgaccgagggccagtcagagttgttggcagccttacgttacgccgtcggtaaaccaacgtaacgaaaccgttcggacccaggtaccctacccgaacggtcccttaccctacctaatttacctaagttcgacttagaccctaaccgtaacccgaaaccgtacgggtaccccaaggtccggacctaacccgtccccgaacgtcccgtaacggtttcgaacggttgaaccgtaggtcgaacggttcgtacggggtactaacggttacctcctacgttccgtaacccctaacgtacttaccggaacgtaacccgtaacggtacccgttaaggaaccgtccggtaaggttaaacggtttacttttaccgtaaccgttttaacgttttaaccgttaccgttaggttacgaacgtaccggtaacggtaccggtaacgtaccgtaaccggttccgtacccttacggttaccttacgggtttaccgggaaccgggtaacgggtaccgggtaggggtacgtaacgtaccgttagggaaaccggtaaccgggttactcggggtaaccgtccgtacggtaccttaccgttacgtttccgttacgttaccttaccgg

SEQ ID NO: 248771 - DNA, 719 bp, Homo sapiens
  misc_feature: GYAE6OF02HQ963.47.64.F09.1.454.CMB.1.raw
  modified_base (208)..(208): a, c, t, g, unknown or other
  misc_feature (208)..(208): n is a, c, g, or t
  modified_base (458)..(458): a, c, t, g, unknown or other
  misc_feature (458)..(458): n is a, c, g, or t
  modified_base (645)..(645): a, c, t, g, unknown or other
  misc_feature (645)..(645): n is a, c, g, or t
  modified_base (672)..(672): a, c, t, g, unknown or other
  misc_feature (672)..(672): n is a, c, g, or t
  modified_base (704)..(704): a, c, t, g, unknown or other
  misc_feature (704)..(704): n is a, c, g, or t
tcagagctcacgtacacgaccggtgctcgatttagcgcgtatacaagggggaggaactgctcagttaggacccagagggaaccatggaacgccccagctcagcttctcttcctcctgctactctggcctcccagataccatcggagaagttgtgttgacactagtctccagcccacccttgttctttagcctaccggaagggggaaanacgccctacccttctccgtagccggaacgggcctacgtacaagtaaacttacgtcctaactaccttaacgtacgccgttacggtaaccaaacgaacggtaaccgtggtacacggtccctaccgacggtcctacctacattaccgtagtggtactcggacctactaccgaaaccggtacgaccgtccttaggcctaacgttacccgagtaaccgtacggttacacggtcgtaaggtcggtacgggttccgngggtaaactgtaccttacggacctttacgaacctaacctcgtaccgtaacggtacctaccggtagtacccgacgggttacctaggtaacccgtttagtttaacgtacgtttaaccttgtacgacgttagccgtagtacgtgtacgtcgacgttccctacgcttacggtgtccgggaggtacggacgngtagacgtacgactacggacgttcggntacccgtagccaccgtttctacgtacggtttntaaccctgttccccg

SEQ ID NO: 248772 - DNA, 701 bp, Homo sapiens
  misc_feature: GYAE6OF02IB5TX.47.64.F09.1.454.CMB.1.raw
  modified_base (221)..(221): a, c, t, g, unknown or other
  misc_feature (221)..(221): n is a, c, g, or t
  modified_base (700)..(701): a, c, t, g, unknown or other
  misc_feature (700)..(701): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacgagtcctccacgccctaccctgttcctttgcctaccgaagggggaaacagccctacccgtntccctgcgacgggccagtcaagtaatacttccaccttaccgttacttacggtcccgttaggtaacccaaacgtaacggaaacccgttggtaccgaacgggccttaacccgacggtaccctcctacgaattccgtatgactgaccactaccgaacggacggaccaacggtcggacactccgaaggtactacggttcgacggtcgagacggttgggtaccggtacgggaactacgttacctttacccacgttaccctaccaactcgttacgacgtacgacgtaccgacgtactacgtacgtaacgttaacgtttagtttaactttaacttacgttacgttacgaacgtcgtacgtacgttacgtacgtacgtacgttcctaccgtctcgttacggttacggacgggtacggtacggtacggtagaacgtacgacgaacgtacggtcgtcgtacgtcgactacgtacgtcgttactccttann

SEQ ID NO: 248773 - DNA, 666 bp, Homo sapiens
  misc_feature: GYAE6OF02G6IEE.47.64.F09.1.454.CMB.1.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagcctaccctgtctttgctccgaaggggaaancgcccaccctctcctggccacgggccagtcaagtaattnttcacttcctacttcgcctggtaccaanacgaacctggtcaggcctccgagcctcctcatcctatgatgactactaccaacggacgggcccaacgtcggaccacgtacccaggaccgtaggtcaggtcgggactacgggtgggtacgtggggaactaggtacctccgtaaccttcctaccgtacccatccaacgacgtacgtaccgtagaccgttaccgtaagtaacgttacgtttaggttactttagtacgttacggacgagtcgtacgtgtagttaccgttgtcgcccgttacccgtcgtccgtttacgggtccggaacggggtaccggtacggtaggggtaggacctgtaaacccggtaaggtacgtcggtacggtcctacgacccgtacgtcttacgttaccgttcttaccgtacgttaccccg

SEQ ID NO: 248774 - DNA, 794 bp, Homo sapiens
  misc_feature: GYAE6OF02I9G2H.47.64.F09.1.454.CMB.1.raw
  modified_base (513)..(513): a, c, t, g, unknown or other
  misc_feature (513)..(513): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccacctgtctttgtctccgaagggaagagcccacctctcctgccgacgggtccagtcaagtaatacttaccaccttcctaacttacgccctaggtaacccaaacgacgtaaaacccgttggtacgacggccctaccccgaggtccttaccctactacttacgtaactacgtagttacgacctaaccgtacccgtaaacggtaccgggacccgtaaccggttcggaacctaccgtacccggaacggtaccgtacggtttacggacggtcgggacgtacgggttcggggtacggttacggggaccgttaacggttacccttacgacgttaccctaccgaacctacncgtaacgactacggaccgtagtaccgcgtacgtaacgttacgttacgttaactttagtaccttacggtactagtacgtacggttacgttaacgtacggtttccgccggttacctcccgttacggttaacccgtttaccggggtaccgggttaacgggtaaccggtaccggggtacggggtagtaaccgttaccgtaacgaaacgggttaaccggttgacgggtacctacggaccctaacgttccgttccggtttaccttcgtttacccaccgtttaccccg

SEQ ID NO: 248775 - DNA, 658 bp, Homo sapiens
  misc_feature: GYAE6OF02HN6UW.47.64.F09.1.454.CMB.1.raw
  modified_base (196)..(196): a, c, t, g, unknown or other
  misc_feature (196)..(196): n is a, c, g, or t
  modified_base (243)..(243): a, c, t, g, unknown or other
  misc_feature (243)..(243): n is a, c, g, or t
  modified_base (407)..(407): a, c, t, g, unknown or other
  misc_feature (407)..(407): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctccagataccatcggagaaagttgtgttgacacagtctccagccaccctgtctttgctccaggggaaangccaccctctcctgacagggccagtcagaatattcactcctacttancctaggtaccaacagaaacctggtacaggctccaggctccgtacactctaatcgtatgcattccaaacgtacggggaccaacgtcggacattaccccaagaacgtacggttccaggtcggactaggtcgggtgtacggggaactaggacctttacgactccgtnaaccctatccaaggtccacgcctaaggacgaccgttagaaacggttaacgtttagggttacccttttaagtttaaccttaggttaccgaacgaccgtaacgacggttagtacggttccgttacgtcccgttaccgcttaccgtacggtttccgggacgggacgggaccgaggggtcgtagactcgaaaacgtacgttaggtcgggtactggaccaaccgtacttccgtcgtttactttacgactttccccg

SEQ ID NO: 248776 - DNA, 641 bp, Homo sapiens
  misc_feature: GYAE6OF02FQO56.47.64.F09.1.454.CMB.1.raw
  modified_base (198)..(198): a, c, t, g, unknown or other
  misc_feature (198)..(198): n is a, c, g, or t
  modified_base (365)..(365): a, c, t, g, unknown or other
  misc_feature (365)..(365): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggtccagtcagagtgttgcagctacttagcctaggtaccagcaacggaaacctggggacaggtcctccccgaggtctcccgtcaacttcctatgatgacactaccacgagggaccatcggcactccccgagtcccgagttcgagtcgganacggtggacgttcggacggcaacgtcttacccactccctcgaaccacgtcaacgactaaccggacctaacggacgtccgtaagtaaacggttcctttaacggtacttttaagttactgtactacggactacggtcgttagtagttccgccgtccgtaccgtcctacgttcggttccgggaacgggtacggtaccgggtgggcgtaggtaaccgtaacccggtaacggtaacgggttgtggacccgttacggaccgtactacggttctacggttccc

SEQ ID NO: 248777 - DNA, 661 bp, Homo sapiens
  misc_feature: GYAE6OF02HBG2S.47.64.F09.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacacagtctccagccaccctgtctttgtctccgagggaaagngccaccctctcngcgaggccagtcagatattcactcctactagcctggtaccaanagaacctggtcagcctcccgagcctcctcatctatgactagctactcccaaacgacgggccctacggtcggaccctactacccccgaaggaacccgttacgggttaccgaggtcgggtaccgtaagggttcggggttaccggtggggaacctaagtaccctttacgaccttctacccaaccgtactcgacgtacgacgccgtaaggactaccggtaaggtaaccgttacgtttacgggttaacttttagttaccgtacgtcctaagtcgtaggtcgttgtacggttcgtcggtccgtccgtcttaccgttacgttcgggacggtacgggaccggagggtcggagacgtaacgaacggtaagtaggtcggcgtacgccgtacctagttcctcggttctacctacgttcccc

SEQ ID NO: 248778 - DNA, 707 bp, Homo sapiens
  misc_feature: GYAE6OF02HUPKS.47.64.F09.1.454.CMB.1.raw
  modified_base (134)..(134): a, c, t, g, unknown or other
  misc_feature (134)..(134): n is a, c, g, or t
  modified_base (201)..(201): a, c, t, g, unknown or other
  misc_feature (201)..(201): n is a, c, g, or t
  modified_base (330)..(330): a, c, t, g, unknown or other
  misc_feature (330)..(330): n is a, c, g, or t
  modified_base (532)..(532): a, c, t, g, unknown or other
  misc_feature (532)..(532): n is a, c, g, or t
tcagagctcacgtacacgaccggtgctcgatttagcgcgtatacaaggggggaggaactgctcagttaggaccagagggaaccatggaagccccagctcagcttctccttcctcctgctactctggctcccagnttccaccggagacagttgttttgacacagtcctccagccaccctgttcttgtcctccgaaggggaancgccctaccctctcccgtgacacgggcctagtcaggagtggttcggcagtcttatacgtccgacggtaccaagtaacgaactcggaccgacggcctcccgaggtctccctagatcctatcgatcgtccnccaaccggtacgggacccttcgtccggtttacccacggcgttaaggttaccgagttcgggaccgtacggtcggttaccgcggtacggtacacggttaacgttcccacgtttaccaccgaacctttaacgtcccgaaacgtccgtcccgtgacctacgtcgtaggtacgtttaagtcgtacgtttactttacttactcgttanacgtaacgtgaccgttagtaactacgtaccggtcgtaccctccgtaaccggttccgaaccggtacggtaacgaccgtaggacgtaacgtaactaacggtaacgtttccggcggttaaccgtcgaaccgtccgattaccggtcttaccgttcttaaccgtcccgtaccgttacccg

SEQ ID NO: 248779 - DNA, 709 bp, Homo sapiens
  misc_feature: GYAE6OF02GGEKE.47.64.F09.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctccgaggggaaagcgccaccctctcctgcagggccagtcagatntcactctactagcctggtaaccaanagaacctgtcaggctccagctccnatctatgatcgcatccgaaacgngggaccacgtcgacactccccaagtaccgtaggtcaggtcgcgtaggtcgggtcgtaggacgtagtccgttacacgttaccaccgaactcggtacacggtaccacggtaccgtaacggtaaccgtcgtaagggtaaccgttacggtttaacgtttaaccgttttaacgtacgttacgttagtaaccggacgtacggttaccggtcggttaacgtttcccggtccggttacccgttcccgttcccttaccggtttaccgggtttaccgggtaccgggggaaccgttaccggggtaacgggtaagggttaaccgacggttaaaccggaaaacggttaacgtcgggttaacggtaccgttaccgacccgttaacgtaccgtttcggtaccgtttactttccgtacgttccccg

SEQ ID NO: 248780 - DNA, 663 bp, Homo sapiens
  misc_feature: GYAE6OF02IJBIZ.47.64.F09.1.454.CMB.1.raw
  modified_base (197)..(197): a, c, t, g, unknown or other
  misc_feature (197)..(197): n is a, c, g, or t
  modified_base (494)..(494): a, c, t, g, unknown or other
  misc_feature (494)..(494): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccacccgtctccgtgcacgggccagtcagaatattcactctactagcctgtacacagaactgtcagctccgaggcctcctcatctatcgattcgacctactaccgaaacgtacgggacctacgtcggacaccgtcccgaacggtacctaagggttccaggtcggacctagggttcgggtaccggtagggacctaggtacctttacgaccttcgtaccaccgtatccgagaccgataccgtagaccggtcctaaggtaacgttacgtttacgggtacttttaacgttcgtaccgtanaaccgtcgtaggacgttagtacgttccgtacggtccccgtacgttctcgttacggttcgggacgggtacgggacgtggggtacgtaacgacttacggaacgttacgtcggtacggtccgtacgtaccctaggtccttacgtccggtttacctaccgtcctttaccccgg

SEQ ID NO: 248781 - DNA, 620 bp, Homo sapiens
  misc_feature: GYAE6OF02F4139.47.64.F09.1.454.CMB.1.raw
  modified_base (145)..(145): a, c, t, g, unknown or other
  misc_feature (145)..(145): n is a, c, g, or t
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
tcagagctcacgtacacgaccggtgctcgatttagcgcgtatacaagggggaggaactgctcagttaggacccagagggaaccatggaagccccagctacagcttctcttcctcctgctactctggctcccagattccaccgganacattgttttgacacagtctcagccacctgtctttgctcagggaangcctacctctcctgcagggccagtcagngtgtggcagtctacttagcctggaaccaatagaaccctggaccaggcctccgaggcctccncatctatgatcgacactaccaacgagggcccatcggacactccgagccaggttcaggtcggcagtgacgtcagggactaggtctacactcacgaactatacgagtcacacgtagacgtcgtagtaattactttacgctttaacgtttaacttacgtacgtactaacggcctagggtaccgtaacgtactaaccggttcgtaccccttagttacccgtaaccgtttccgggaccgggtacggaacccgggtagggtcggaacgttacgaacgaacggtaaccggaacgtacggttacggacgttacccgccgtaaccagtttacgtaccgttacctaccgg

SEQ ID NO: 248782 - DNA, 673 bp, Homo sapiens
  misc_feature: GYAE6OF02F8C66.47.64.F09.1.454.CMB.1.raw
  modified_base (198)..(198): a, c, t, g, unknown or other
  misc_feature (198)..(198): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacgacagtctccagccaccctgtctttgtctccgaggggaaancgcccaccctctccgtgccgagggccagtcgagagtgttggcagctacttagcctggtaccaacgagaaacctggacccagggcctaccgacggtcctcctacatctatcgatcggccgtccaccgagggcctacgttcggttcccagcctagggttcagtggcagtcggcgttccgaggggacctaggtacttccacttcgtacctaaccataccaacgacgcctaggctaacggtctaggtaagttagttttgacgtttaagtttacgttacgttcgttacgagtaccgtaattacgtacgtaattaccggtacggtcccttaccttccgtacccggttaccggaccggtaacgggtccctaaacggacggtacggttaacggaacgttaaacgtaccggttaaggtacggtccggtacgtaccgtaacgtacttcggttaacgttcctttacgtaccctttacccgtccccg

SEQ ID NO: 248783 - DNA, 758 bp, Homo sapiens
  misc_feature: GYAE6OF02IED1X.47.64.F09.1.454.CMB.1.raw
  modified_base (137)..(137): a, c, t, g, unknown or other
  misc_feature (137)..(137): n is a, c, g, or t
  modified_base (143)..(143): a, c, t, g, unknown or other
  misc_feature (143)..(143): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (285)..(285): a, c, t, g, unknown or other
  misc_feature (285)..(285): n is a, c, g, or t
  modified_base (442)..(442): a, c, t, g, unknown or other
  misc_feature (442)..(442): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccnctgganaaatgagatgacgcagtctccagcccacccttgctgtacgttctaccgaaggggaaanacgtccaccntcctcgtggtacgggccgtnagagttatagcatactaacttcgccttaggtaccagtcaggcgaccgtggaccnggtaccctccgaggtccctccgtctactcctatggtactcgtccgacccgaccgacgggtaccctacgtttccgggttaccccaggtaccgttaacggttcggtaacgtcggtaccgtaggtttcgacccggtggtacggtacgtaacgtcgttacncccttacgtaccctacgtaatcccaacgtacgtaccgtaacgtccggtaaccgtaacggttaaacgttaccgttttaacgggttaactttttaacggtttaccgtacttacggtaccgtacggtacgttacgggttagtacggtttccgtaccggttccctcccggtttaccgttcccgttacggttttacccggggacggggtaacccggggtcgtaacggggggttccgtaaggaaccgttaacggtaaaccgttacgtcgggtaacgtccgtacggtaccgacttacgttacgtcgtttcttacccgttaccg

SEQ ID NO: 248784 - DNA, 810 bp, Homo sapiens
  misc_feature: GYAE6OF02H721V.47.64.F09.1.454.CMB.1.raw
  modified_base (106)..(106): a, c, t, g, unknown or other
  misc_feature (106)..(106): n is a, c, g, or t
  modified_base (269)..(269): a, c, t, g, unknown or other
  misc_feature (269)..(269): n is a, c, g, or t
tcagagctcacgtacacgaccggtgctcgatttagcgcgtatacaagggggaggaactgctcagttaggacccagagggaaccatggaagccccagctcagcttcncttcctcctgctactctggctccagataccatcggagagttgtgttgacacagtctccagccacactgtctttgtctccgaggggaaagcgcccaacctctcctggccagggcctagtcaagtaatattcactacctaattaggcccttagggtaacccaaanacgaaacctggtacagggcctacccgaggcctccgtcatctatgatcgacactaccaacgacgggcctacgtgggacctactaccccgaaggtaccgtaacggggtttccaagggttcgggaccgtaagggggtttcggggggttaacccgtagggggttaaaaccctaaggtaacccgttttaccaacccggttacctttaaccgaacccctaaagttccaaacgggaccctaacgggtacccttaaacgggaccgtcccgttaaggtaaacggttaaccgttttacgggtaaacctttttaagttaaccgtccgttacgaacgtcgtacgggttcgttaggttacgtttcgtccgggtacccttcccgtacgttaccgttacccgttttacggggaccgggttaaacggggacccggttaagggggtacggtaaggtaaccgttaaacccgggaaaacggttaccgttcgggttacggtaccttaccgggacctacccggttaacgttccttacggttttaccccttacgttaaccccg

SEQ ID NO: 248785 - DNA, 770 bp, Homo sapiens
  misc_feature: GYAE6OF02HC2FT.47.64.F09.1.454.CMB.1.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctcccagataccagtcggagtaagttgtgttgacacagtcctccagcccacctgtctttgtctccgaaggggaaancgccaccctctcgtgcgacgggccagtcagtaactataccacctccgtaactacgccgtaggtaaccaacagtaaacctggtacacggcctcccaggtcctcctacatctatnatcgacactaccaacggacggccctactcggacctaaccgttccccgaagtaccgttacgggttacacggttcgggacgttacggtttcgggacggtacggggactacggtacctccgtaccgttccaacccgtaacccgtaattccgaaccgtacgaccggtaccgtacggtaccgtaccggttaacgtaaggtttaccgtttacgtttactttaacgttaactcggttacgacgtttacgacggttctaaagggttcgtacccgggttcgtcccccgttaacgtcccgttaaccggttaccgggttaccgggggacgggttaaccggggtaacccggtagggggttataaccgggtaccgttaaaaccgggacccggtttagggttaccgcggggttaaaccctcgggtaaccctccgtagttccgttccgttacttacccgttacgtccccg

SEQ ID NO: 248786 - DNA, 813 bp, Homo sapiens
  misc_feature: GYAE6OF02IKYB7.47.64.F09.1.454.CMB.1.raw
tcagagctcacgtacacgaccggtgctcgatttagcgcgtatacaaggggggaggaactgctcagttaggacccagagggaaccatggaacgccccagctcagcttctcttcctcctgctactctggcctccagtactaccatacggagtaagttgtgttacgacactaggtctacccacgccctaccctgttctttcgtcctaccggaagggggaaacacgtaccctacccttcctccgtcggacgacgggtcctacgacaagtaacttaccttccaccttacctaacgttaccgccgtacggtaaccacgaacgtaacctcggtactaacggccgtacccaggtaccttcctactattaacctaggtactacgtacgactaacgaacccctacggaaccggtcaccggttgaccctaaccgtaccgaacgtaacgttcggtactgggagtcgtacgggtcggtacggtagggaactacgtaccgttaccaccttccaataacccgtgtaaccgagaactccggtaacgcgtaaacgtcgtaaaccgtacgttatttaacggtactttacttaacggcgtaaccggactacggtacgtagtaccgggttagccggttcccgttaaccggtccttccgtaaacccggttcgggttaaccgggggtacccggtaaacgggacgggttaacgggggttaaccgtacggttaaccaaaccgggtaacggttaaccggttagggtccgggtaccgttaaacgccgtttaaacccgttgttaccggtacctttaccctttaccgacccggttaacccc

SEQ ID NO: 248787 - DNA, 712 bp, Homo sapiens
  misc_feature: GYAE6OF02JZZCX.47.64.F09.1.454.CMB.1.raw
  modified_base (194)..(194): a, c, t, g, unknown or other
  misc_feature (194)..(194): n is a, c, g, or t
  modified_base (227)..(227): a, c, t, g, unknown or other
  misc_feature (227)..(227): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccagtcggagaagttgtgttgacacagtctcagccacctgtcttgtctccgaggggaanagccaccctctcctgcgagggccagtcagaatnttcactcctattacgcctaggtaccaacacgaaccgttgtacacggcctacccgaggtcctacctactacttctagtcgaattcgctacgtacccaacggtacgggtccaacggttcggacctacgtaccccgaaaggtaccgttacgggttacagggttccggactagggttcgggtacgtagggacctaagtaccttcgaactccgtacaccgtanaccgtanaccctagaccgtaacgacgtaccgtaggtaacgtacgtttacggtaactttaacgtttacgtacgtacgtacggtactacggtaccgttagtaccggtttcgttaccgtcccgttaccgtccgttacgtccggtttaccgggacgggtaccggtaacggtacggggttacgacgtacgtaccgtaaacggtccgttaaggacggtacgtaccgtacgtaaccttacggtccgttacgtaccgttaccgtcccttacccgg

SEQ ID NO: 248788 - DNA, 661 bp, Homo sapiens
  misc_feature: GYAE6OF02GMGAB.47.64.F09.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (408)..(408): a, c, t, g, unknown or other
  misc_feature (408)..(408): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccaggggaancgccacctcncctgcagggccagtcagaatattcacttccattagcctggtaccaacagaaacctggtcagctccagctcctcatctatgatgcactccaacgtacgggccacgtcgggcactaccccaagaccgtagggttaccagggtcggcgtagggtcgggtcgtacggggactacggtacgttacaccttcgtaccacctacgtcgacncgaacgtaccgtaacggtacgtccgtagtaacgttacgtttacgggtacttttaacgttacgtcgtacgtacggccgtagtccggtagttacggtttcgtacggtcccgttaccgtcgttaccgtaccgttttaccggggacgggtaacggggtaccgtaggggtcgggtaacgacgtaaccgtaaacggtacgtaggtacggtcgtacggtaccaccgtacttaccgttcgttaccttaccgtacttccccg

SEQ ID NO: 248789 - DNA, 585 bp, Homo sapiens
  misc_feature: GYAE6OF02JHY7U.47.64.F09.1.454.CMB.1.raw
  modified_base (456)..(456): a, c, t, g, unknown or other
  misc_feature (456)..(456): n is a, c, g, or t
  modified_base (504)..(504): a, c, t, g, unknown or other
  misc_feature (504)..(504): n is a, c, g, or t
tcagagctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggacctggtgaagccttggagacccctgtcccctcacttgctattgtctctggtcgctccatcacctagttttatgttggtgggctggtactccgcctacgcccccgaggggaagggctaggaactggagttgggacgtattagttttagtaagtgggactacgtaccttaacctaaccctatccctagaagtacgtcgtactttccagtactccgacacgtacacggtcgagtaactcctactcctccgtacgtaactcgacgtctctcgcgaccgcacgacgacncgtcttgttatctgtcagactcgtcgaccgacgtagacgctaagttcncgtatacgttacgttgtacgttaggtcggtacgaaggtaacgtacggtccaccgtccgacgtacaccgtccacctaaccgg

SEQ ID NO: 248790 - DNA, 711 bp, Homo sapiens
  misc_feature: GYAE6OF02IJ0DQ.47.64.F09.1.454.CMB.1.raw
  modified_base (196)..(196): a, c, t, g, unknown or other
  misc_feature (196)..(196): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccacctgtctttgtctccgaggggaangccaccctctcctgcgagggccagtcagaatattcactctattagcctgtaccacagaaacctggtacaggtcctcccgaggctccgtcagttctattgaattcgacacgttacccaaacgtacggggaccctagtcggacctacgtaccccgaagacgtacggttcaggtcggactaggttcggggtacgtagggaactacggtacttccgactcgtaccaacctagtccgacgccgtaacgtcccgtaaggtcgaccgttaggaaccgttacgttttacggtaacttttaacgttacgtacgtacgacgtcgtaacggtcgttagtacgtttacgtcggtacccttccgtacttccgttaccgggtttaccggggacgggttaacgggtaccggttaggggtacgtaacgtactaacccggtaaagggtccgtacgggttacgaccggttaccgaaccgttaccgttacgttacccggtttactttcgttacccgttacccgtttacccccgg

SEQ ID NO: 248791 - DNA, 728 bp, Homo sapiens
  misc_feature: GYAE6OF02JBXR5.47.64.F09.1.454.CMB.1.raw
  modified_base (163)..(163): a, c, t, g, unknown or other
  misc_feature (163)..(163): n is a, c, g, or t
  modified_base (210)..(210): a, c, t, g, unknown or other
  misc_feature (210)..(210): n is a, c, g, or t
  modified_base (398)..(398): a, c, t, g, unknown or other
  misc_feature (398)..(398): n is a, c, g, or t
  modified_base (481)..(481): a, c, t, g, unknown or other
  misc_feature (481)..(481): n is a, c, g, or t
tcagagctcacgtacacgaccggtgctcgatttagcgcgtatacaagggggaggaactgctcagttaggacccagagggaaccagtggaagccccagctcagcttctcttcctcctgctactctggcctcccagactaccatcggagaagttggtgttgacanagtcctccagcccaccctgttcctttcgtcctccggaaggggaaacncgtcccaccctctccgtaggccgacgggcctagtcgaagtaacttacttccaccgttaccttaacttcgccgttacgtaccagaccgaacgtaaaccgtggggaccacgggtccctacccgacggtcctcctacacgttaccttaggtcggtcgcctacgtcccgaccggacggccctacgtcggacncccgacggccgtaggtttcacggtcgtaccggtggtcggtcgtacgggactaacggtgtttcccaacgtcctcaacccgttcncgtaactccagtccctcgaccgtattcgtaataagtttcgtttacacgtttaaattttctctacgtacgacgttacgtaataagttaccgtagtaccggtcccgttccggttaacggtacccgaacggtaaccgggtaacgtaccgggtacgtaacggaacgtttaactaaaccttcgggtgaaccggtcgtaactcccggttacttacgtccgtttactaccttccgtcccgttcccgtaccctcg

SEQ ID NO: 248792 - DNA, 642 bp, Homo sapiens
  misc_feature: GYAE6OF02HTZCX.47.64.F09.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (380)..(380): a, c, t, g, unknown or other
  misc_feature (380)..(380): n is a, c, g, or t
tcagagctcacgtacacgaccggtgctcgatttagcgcgtatacaaggggggaggaactgctcagtttaggacccagagggaaccatggaagccccagctcagcttctcttcctcctgctactctggctcccagataccatcggagaagtttgtgttgactacagtctccagccacctgtctttgctcaggggaaangcccaccctctcctgcgagggccagtcagaatattcactcctacttacgcctagtaccaacagtaaacctgtcaggctcccaggctcctcactctatntatgccatcctaagacgggccaccgtggacctagtacccgaaggactagggttcaggtggaccgtaggtcggggtctaggggacngtaacttctaactctccactagtcacgcacggctacggactaccgtagaaacgtagtttcggtaaccttttagtaccttgttcaagccgtagcgttggtacgttccgtcggtccgtacccggtcttacgttaccggtttcgggaaccgggtagggtaaccgggtagggttacggaagtacgtaacggtaaaccgtacggttggtacgggtacctcgaccctaaccgtgtttacctcgttacctttacgtaccttacccccgg

SEQ ID NO: 248793 - DNA, 681 bp, Homo sapiens
  misc_feature: GYAE6OF02FJW3X.47.64.F09.1.454.CMB.1.raw
  modified_base (113)..(113): a, c, t, g, unknown or other
  misc_feature (113)..(113): n is a, c, g, or t
  modified_base (162)..(162): a, c, t, g, unknown or other
  misc_feature (162)..(162): n is a, c, g, or t
  modified_base (195)..(195): a, c, t, g, unknown or other
  misc_feature (195)..(195): n is a, c, g, or t
  modified_base (259)..(259): a, c, t, g, unknown or other
  misc_feature (259)..(259): n is a, c, g, or t
  modified_base (453)..(453): a, c, t, g, unknown or other
  misc_feature (453)..(453): n is a, c, g, or t
tcagagctcacgtacacgaccggtgctcgatttagcgcgtatacaagggggaggaactgctcagttaggaccagagggaccatggaagcccagctcagcttctcttcctcctnctactctggctcccagataccatcggagaagttgtgttgacacagtccnccagcctaccctgtctttgctccgaaggggaangccaccctctcctgcacgggcccagtcagaatactttccactcctacttagcctaggtaccaanaacgtaaacctggtcacggtcctaccccgaggtaccctccttacgacttactagtcgagtcggactaacgtacccaaccgggaccggccccgtaacggtcgggtacctaacccgtccccaaaggtaccgtaacgggtttccgaaggtaggtaccggtagggttcggggtcggttacgggactacgggtcttacncgtacctcctaccactacgtacgacacgtacgtagacgctaggtaacgtttagtcgtagttacgtttaatacgttgtacgtacgtaacgttaaactacgtaacgtcgtaccctccgtacttccgtacggttcggacgggtacgacgggtacggtacgtacgagtacgaacggtacgtggtacggtacggctaccgtacttacgtctccgttatcctcttcccgtaccg

SEQ ID NO: 248794 - DNA, 689 bp, Homo sapiens
  misc_feature: GYAE6OF02JKQUL.47.64.F09.1.454.CMB.1.raw
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (375)..(375): a, c, t, g, unknown or other
  misc_feature (375)..(375): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccacctgtctttgtctaccgagggaagagccaccctctcctgcgagggccagtcagtaatattcactcctacttagcctgtaccananaacctgtacaggcnccgacgctcctanattctagtcgagtcgcaacaccctaaacggcggaccctacgtcgggactacccgtacccgaagtaacggtacggtttacgaggttcgggacncggttggggtaccgtgggaaccagttacctccgtactaccgtacgaacctacgtccgaagaccgtaccggtacgtaacgtaacgtccgttaaggaacgtttacgtttaggttaaccttttagtaccgtcggtaccgaagttcccgaggtttaccggtcgtacggttaccgtcgtcccgttaccgtcgttaccgtaccggttcgggaacggtacgggacggtagggtacgacgttagtaaccgaacgttaccggtggttcggaccttgaaccctcgttacgttccgtaacgttccgttacgttccgttaccccgg

SEQ ID NO: 248795 - DNA, 669 bp, Homo sapiens
  misc_feature: GYAE6OF02HU874.47.64.F09.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctcgaggggaaangccaccctctcctgcgaggccagtcagaatattcactcgtacttgcctggtaccaanagaactgtacaggcctccgagtctcctcatctangatgacataccaacgtacgggcccaacgtcggaccacgtcccagaccgtaaggttccaaggtcggctaaggtgaacgtcggtggactacgtaccttcgaccttaccgtacaacgtactacgacgtacacgtaccgtagaccgtacgtaaggtaacgttacgtttacgtactttaaccgtttacttaacgttcgtacgactaccgtagtaccgtaacgtacgtaaccgttccggtacccttacgtaccggttaccggtttccggggaccgggtaaaccgggaacggttaggggtacgggtagtacgttaacggaacggtaccgtaacggtcgggttacgtacggtctaaccgtaccgttcgtacctttacggtacccttaccgg

SEQ ID NO: 248796 - DNA, 786 bp, Homo sapiens
  misc_feature: GYAE6OF02HZ605.47.64.F09.1.454.CMB.1.raw
  modified_base (199)..(199): a, c, t, g, unknown or other
  misc_feature (199)..(199): n is a, c, g, or t
  modified_base (716)..(716): a, c, t, g, unknown or other
  misc_feature (716)..(716): n is a, c, g, or t
tcagagctcacgtacacgaccggtgctcgatttagcgcgtatacaagggggaggaactgctcagttaggacccagagggaaccatggaagccccagctcagctttctcttcctcctgctactctggctcccagataccatcggagaagttgtgttgacacagtctccagcccacctgtctttgtctccgaaggggaaancgccctacccgtctcctggctacgggcctagtcaagtaatacttccactaccttaacgttacgccgttacggtaaccaaacgaacgtaaaacccgtggtaccagggtaccctacccgaggtacccttccgtactacgttacgttataggtaacgttggaccctaactaaccccggtaaaacgtaacggggccctaacgttacgggaccctaacgtaccccgaagggtaaacctagggttaactacgggtacggcggtaggttcggggtcgtaagggaactaccggtttaccttcgaaaccttccgtaccaaaccgtactaccgacgtaccgtaacgacgtaacgcgtacgtaggtaacgttaccgtttaagtttaacttacgttaacgtgtaccgtaggtactacggtacgttacgggtacttcgtccgtacccgtccgttacgtaccgtttcggttaccgggacggggttaaacgggcggtaagggtacgtaagtacgtaaacccgaaacgggttntaccggggtagttacgaaccgtccgtaccgttacttacggtaccgtttcctaaccgttacccgttacccg

SEQ ID NO: 248797 - DNA, 654 bp, Homo sapiens
  misc_feature: GYAE6OF02JZJTE.47.64.F09.1.454.CMB.1.raw
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
  modified_base (308)..(308): a, c, t, g, unknown or other
  misc_feature (308)..(308): n is a, c, g, or t
tcagagctcacgtacacgaccggtgctcgatttagcgcgtatacaagggggaggaactgctcagttaggacccagagggaaccatggaagccccagctcagcttctcttctcctgctactctggctcccagataccatcggagaagttgtgttgacacgagtctaccagaccacctgtcttgctccaaggggaancgaccacctctcctgcgacgggtccaagtcagaattatcgctactacttagcctaggtaaccaanacgtaaacctggtacacggtctaccgaggtcctccttcatactacgtnaactgctacacctaacgacggccgacgtcgcgactcccaaggacctacgtcgaggtacgcgaggtggtacgtagggactacgtacgtacacgtacgtcaacgtactacgagctacgctacgtacgtacgtaacggaattacgttacgggtacctttaggttaacctgtaccgttaggtcttacgggtcgtgtaccggttgttacccgggattccgtacgtcggttacgttccggggtgtaaaccgggcggtaaggcggtacgtacgttaaccggtaacgtaaccgttggtacggtcttaacgggacctacggttacggttcttacggtaccttagtccgttaaccc

SEQ ID NO: 248798 - DNA, 707 bp, Homo sapiens
  misc_feature: GYAE6OF02GCYFB.47.64.F09.1.454.CMB.1.raw
  modified_base (194)..(194): a, c, t, g, unknown or other
  misc_feature (194)..(194): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
tcagagctcacgtacacgaccggtgctcgatttagcgcgtatacaagggggaggaactgctcagttaggacccagagggaaccatggaagccccagctcagcttctctcctcctgctactctggctcccagataccaccggagaagttattttgacacagtctccagccaccctgtcttgtctccaggggaaanagccacctctactgcagggtcagtcagagtgtgacagctactagtctggtaccaagagaactggaccagctccagntctcatctggatcncacgtaccaagtacgggccgtactggcctaactccccgaaggtccctagggttccaagtcgggacagggttcggggtacctgggggaaacctaggtaccgtttacaaccgttctacaaccctaagttccaaggacctacgaccctaaggacgtactacggaaagtagttttacgacgttaacggtttacttaacgttgtacaaggtaactaaaaccggtttaaataccgtacggtacccttaccggtacttaccgtaacgttttaccgggacgggaaccgggtaaccggtagggtaacggtaacaaggttaacgggaaaccggtaacgttagggtacggtaaccgtacggtaaccctaaccgtacgttacgttaacgtttccgttaacccggttacttaccccgttacccgtaccgttaaccg

SEQ ID NO: 248799 - DNA, 758 bp, Homo sapiens
  misc_feature: GYAE6OF02FRB02.47.64.F09.1.454.CMB.1.raw
  modified_base (202)..(202): a, c, t, g, unknown or other
  misc_feature (202)..(202): n is a, c, g, or t
  modified_base (324)..(324): a, c, t, g, unknown or other
  misc_feature (324)..(324): n is a, c, g, or t
  modified_base (597)..(597): a, c, t, g, unknown or other
  misc_feature (597)..(597): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctcccagataccatcggagaagttgtcgttgacacgagtcctccagccaccctgttcctttgctccgaggggaaancgcccacccgtctctgctagggccagtcaagaatactcgtactcctattacgccttaggtaaccaacgacgtaaaccgtggtaccaggctcccgaggcctaccgtctaactcttaagtcgtntacgccgttacaacccgaacgtacgggtacctacggacgggctaaccgttcccgaacgtaccgtagggttttaccccaggttacgggcctacgggggtggttaccgggtacggggacgtaacgggttaacttacccggtaacctcttaccacccgttaactcgaacgtcgtaacgtaccggttaaggccgtcgtaaacgggtaacgtttagtttacggtttagtttaacgtttaccgttcgtaccgtggtaacccggttgtcgacggttttcncgggtccgtccggtactacggtttcccgttaacggggaccgggtaacggtccgggtaagggtaccggtaagtacggtaacccgaagttccgggtaggtccgaccgttccggtactaccgtaacgttccggttacctaaccgtttcccagggtttacccccg

SEQ ID NO: 248800 - DNA, 691 bp, Homo sapiens
  misc_feature: GYAE6OF02G1UJC.47.64.F09.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (666)..(666): a, c, t, g, unknown or other
  misc_feature (666)..(666): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagactaccatcggagaagttgtgttgacacagtctccagccacctgtctttgtctccgaaggggaangccacctctcctgcagggccagtcaagaatnttcactctactagcctaggtaaccaacacgaaaccgtggtccgacggtcctacccgaggtccttacctcacgtcttaatcgacttacgctaacctaccgaaacggcggggccctacgtcgggacctaaccgtacccgaacgtacgtacgggtttacgaagggttcggacggtacggttcggggtacgtaggggaactacggtaccttaccgacttacctacgaaccctagtaccgacgtacgaccgtacgtaacgacgtacgtacgtacgttacgtttagttactttattacgtcgtactacgtcacggtcgtacgttacgttccggtcgtccgttaccgtcgttaccgtacggtttccgggacgggtaccgggtaaccggtagggtacggaacgtacgtaaccgtaacggtcgtaggtcgacgtcgtacgacgttacncgttcttaccgttcgtaccttcccg

SEQ ID NO: 248801 - DNA, 738 bp, Homo sapiens
  misc_feature: GYAE6OF02F1B6T.47.64.F09.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggctccagataccatcggagaagttgtgttagacacagtctccagcccaccctgttctttgtcctccgaggggaancgccaccctctctgcgaggccagtcaagaatattcacttcctacttagcctaggaccaacacgaacctggacacggcctacccgaggccttccncacttcgtatgacgtgaccactacccgaacgtaccggggccctaacgttcgggaacctaccgtaccccgaaggtaccgttacgggttacgtagggtcgggtaccgtagggttcgggggttaccgtaggggtaacctaacggttaccctttaccgaaccggtttcctaacccgtaaacctacgtacgacgaccgtaccgtacgttaaccgacgtccgaacgtaacgttaccgtttaggttaacctttattacgtcgtcgtacgtctacggttcgtaggttccttcggttccggtccctcgtcctaccggttaccggttcggggtaccgggtacgggtacggttacggggtcgtaccggtacgtacggtaaaccgtcggttagggtaccgtaccgttagacccgttaacgttcgttccggttactcccgttactccgtttaccccg

SEQ ID NO: 248802 - DNA, 679 bp, Homo sapiens
  misc_feature: GYAE6OF02F8TWM.47.64.F09.1.454.CMB.1.raw
  modified_base (148)..(148): a, c, t, g, unknown or other
  misc_feature (148)..(148): n is a, c, g, or t
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
tcagagctcacgtacacgaccggtgctcgatttagcgcgtatacaagggggaggaactgctcagttaggacccagagggaaccatggaagccccagcctcagcttctcttcctcctgcctactctggctcccagataccatccggganaagttgtgttgacacagtctccagcccaccctgtctttgctccgaggggaaancgcccaccctctcctgccagggccagtccagatnttcactcctacttagcctggtaccaacacgaaacccgtggacacggcctacccgaggtcctccgtcatctatcgatcgacactaccaacgacggccacgtcggctacncccgaanacgtagttccaggtcggaccagggttcgggtcgtacgggaacacgtaccgtttacgacttccgtacaccgtactaacgtacgccagtaccgtagaccgtaccgtagtaacgttacgttaggttactttattacggtacgttacgagtacgtacgtacgtacgtacgtttctaccggccctttacggtccttaccgttaccggtttaccggggacggtaccgggtacggtacgggggtgaacggttaccgttaagaaaccggttaacggtccggtagtacgttaccgccctaaccgtactttccggtacttaccgttcctaccttccccg

SEQ ID NO: 248803 - DNA, 619 bp, Homo sapiens
  misc_feature: GYAE6OF02F25ED.47.64.F09.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (276)..(277): a, c, t, g, unknown or other
  misc_feature (276)..(277): n is a, c, g, or t
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
  modified_base (372)..(372): a, c, t, g, unknown or other
  misc_feature (372)..(372): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgctccgaaggggaaancgccaccctctctgcagggccagtcagaatatcactcctactagcctgaccananaactgnagcnccagctctnatcannatgcatccaacgnggccagtgacctacaccaggtactggtactggcgnaggttcgggctagggaccagtacttcactcgtacacctagtcgacanacgtacctaaggactccgagtaaacgtacgttttagaaccttttaacgtacctagttacgaagtcgtaacgggtcctacgggtatttccgaccggttcctacccggttccttacgttaccgtttacgggaccggggacggtaaccggaggggttggtaacgttacaaccggtaaaacggagttcggttaggtacccttaggaccttaaccggattaccgtcggtttacttaccgtacccgttacccg

SEQ ID NO: 248804 - DNA, 748 bp, Homo sapiens
  misc_feature: GYAE6OF02FQCRQ.47.64.F09.1.454.CMB.1.raw
tcagagctcacgtacacgaccggtgctcgattttagcgcgtatacaagggggaggaactgctcagttaggacccagagggaaccatggaagccccagctcgagcttctcttcctcctgctactctggctccagataccatcggagaagttgtgttgacacagtctccagccacctgtctttgtctccgaggggaaatcgcctaccctctccgtgcgacgggccgtcgagggtattagctatcaacttacgcctggtaccaggtcaacggtagaccgtacggacccaggtaccttacccgagggtccctacccgttcaacgttcgtcggggtaacttcggacctaactaccccgaaaccgtaccgggggcccgtacggtcgggacctaccgttcccgaacgtacccgtaacgggtttccaggttcgggacgtaacggttaggggtcgttacgggaccgtacggtaccttcgtaacctccgtacaacctacgttaccgaagtccgaacgtaccgtaacggtaacgtaccgtaaggtaacggttaacttttacggaccgttaagttttaacgtaacgtttcgttaacgaagtaacgttaaacgtaacttacgtacggtacctcccgacgttaccgttaccgttcgggacgggttacggtaccgtaagggtcgaacgagtaccgaacggtaccgtaggtcggacttcgaacctactacgttagttcggttcttacgtaccttccgtaccccg

SEQ ID NO: 248805 - DNA, 795 bp, Homo sapiens
  misc_feature: GYAE6OF02JV41Y.47.64.F09.1.454.CMB.1.raw
  modified_base (209)..(209): a, c, t, g, unknown or other
  misc_feature (209)..(209): n is a, c, g, or t
  modified_base (756)..(756): a, c, t, g, unknown or other
  misc_feature (756)..(756): n is a, c, g, or t
tcagagctcacgtacacgaccggtgctcgatttagcgcgtatacaagggggaggaactgctcagttaggacccagagggaaccatggaagccccagctcagcttctcttcctcctgctactctggcctccagataccagtccggagtagttgtgttcgaacacagtcctccgagcccaccctgttctttcgtcctaccgaaggggaacncgccctaccctctctagccgagggccagtcagtaatacttccaactccgttatccgtcgtacggtaccaaacacggtaaacccgttggggtaccacggtcccgttaccccgagggtccccttaccctcgtaacttccgttaaagcgtacgttaccgaccaccgttaaaacccgaccgggttaccggacctaaccgggttccgacccgttaactccccgaacggttaacggcggttacctacgggtacggtccgtacggggtttaccggacggttaaggggtacccgtaaggtttacccttaaccgaccgttccgttaccgaaaccgttcgaccgtacgtaccggaccgtacccgtacgtacccggtaccgtaaggaccgtttaaccgtttagtaacctttagggtaacctgggacttacgtagtaaccgtcggttgttaccgtcgttaaccggccgtccgttaccgttcgtacgggttccggtacgtacggggtactagggtaccgtaacgtcggttaacacgggtcgttacgggcgcccttacggntaccgttcgtaccttccgtattacccgttccgttaccgg

SEQ ID NO: 248806 - DNA, 148 bp, Homo sapiens
  misc_feature: GYAE6OF02HMQP1.47.64.F09.1.454.CMB.1.raw
  modified_base (107)..(107): a, c, t, g, unknown or other
  misc_feature (107)..(107): n is a, c, g, or t
  modified_base (113)..(113): a, c, t, g, unknown or other
  misc_feature (113)..(113): n is a, c, g, or t
  modified_base (117)..(148): a, c, t, g, unknown or other
  misc_feature (117)..(148): n is a, c, g, or t
tcagagctcacgtacacgaccggtgctcgatttagcgcgtatacaaggggggaggaactgctcagttaggacccagagggaaccatggaagccccagctcagcttcncttccncctnnnnnnnnnnnnnnnnnnnnnnnnnnnnnnnn

SEQ ID NO: 248807 - DNA, 753 bp, Homo sapiens
  misc_feature: GYAE6OF02JB8LA.47.64.F09.1.454.CMB.1.raw
  modified_base (465)..(465): a, c, t, g, unknown or other
  misc_feature (465)..(465): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctccagataccatcggagaagttgtgttgacactagtcctccagccctacctgttctttgtctccgaggggaagacgcccaccctctcctggcgagggtcctagcgagaattcttacacctcctactagtcctcggtaaccaacgaacgtaaccgtggtacgacggcctacccgcggcctcctcatcgttatacgactgctactaccgaacgcgggtccaacgtcggacctaaccttccccgagtacccgtagggttaccgtaggtacggccgtagggttccggtacggttacggggtacctacggtaaccttccgtaacccttcctccgtaaccgtacnccgtaacggaccacggttaacccgaagggtacccgtaaccggtacgtaacggtttaaccggttttggttaaaccttttaggtacccgttagtaccgacgtcgtacggttcgttacgttcggtttcccgacggtccgttcccggtacgttcggtttaaccggtttcggggacgggttaagggacccgttaggggtacggtacttacgaaccgggtaaccgtaggttaacggtcggtacgtacccgtaccgacgttcctttaccggtacctttcgtacctccttccccgg

SEQ ID NO: 248808 - DNA, 605 bp, Homo sapiens
  misc_feature: GYAE6OF02F7ULY.47.64.F09.1.454.CMB.1.raw
  modified_base (326)..(326): a, c, t, g, unknown or other
  misc_feature (326)..(326): n is a, c, g, or t
tcagagctcacgtacacgaccggtgctcgatttagcgcgtatacaagggggaggaactgctcagttaggacccagagggaaccatgggaagccccagctcagcttctcttcctcctgctactctggctcccagataccatcggagaagttgtgttgacacagtctccagcccacctgtcttgtctcaaggggaaagagcccaccctctacctgctagggccagtcagtgtgttgcagctacttagcctggaccaagacgaacctggaccaggcctcccaggcctcctcatctatgatgacactcaacgacggcctagcgcactccngccgtgtcagtggacagtcgagtcgtagggacaacgtcttacgctctaccaaccgtataccgagtaccgagtacccgtagacgtccgtaagtaacgttagtttacggacctttacttttaattactgtcaacgtcacggtacgacgtacgtaccgtcgtaccgttctacgttaccgttcggaagggtacgcggtagggtacgactaaggaacgaaacgttacggtcggttaccgaccgttcgaccgtaccgtacgttccgttacggttacccttaaccg

SEQ ID NO: 248809 - DNA, 757 bp, Homo sapiens
  misc_feature: GYAE6OF02GOFKX.47.64.F09.1.454.CMB.1.raw
  modified_base (199)..(199): a, c, t, g, unknown or other
  misc_feature (199)..(199): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgttctttgtctccgaggggaaagngcccacccttctcctgcagggccagtcagaatattcactcctacttagcctggtaccaacaacgaaacctggtacaggtcctccgaggcctcctcatctagtcgatcgacactaccgaacacggggcccacgtggaccaactcccaaggactagggtttccaaggttcgggaccgtaagggttcgggggtacgtccggggaactacggtaccgtttcctaaccgttcctaacccgaacccgtattcccgaacggtcccgaaccgtacccggtaacgtacccggtacccttaaggggtaaacggttaaccgtttttacgggttaaacctttttaacggttaaccgttccgttaacgtaacggtaccgttaacggtccggttaagtaccgggttttcgttccggaacccgtttcccggtcctttaccggttaccggttttcgggggacccgggtaacgggacccgggaggggttaccgggagaacgttaacctaaaacgggtacgttacgggcggtaccgtgtaacgacccttaggttcctacgttcttactccgttccc

SEQ ID NO: 248810 - DNA, 663 bp, Homo sapiens
  misc_feature: GYAE6OF02JL5LK.47.64.F09.1.454.CMB.1.raw
  modified_base (106)..(106): a, c, t, g, unknown or other
  misc_feature (106)..(106): n is a, c, g, or t
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagagctcacgtacacgaccggtgctcgatttagcgcgtatacaagggggaggaacgtgctcagttaggacccagagggaaccatggaagccccagctcagcttntcttctctgctactctgctcccagactaccaccggagaagtttattttgactacaagtcctcagcccacccgtgtcttttgctccgaggggaagagtccaccctntcctgctacgggtcagtcagagtgttnacgtagcttacttgtcttcggaacaagataaccgtgccaaggccttacccgnggtctacctcgagtcgtgggacngaacctcaccgaagcggtaccngtggtccactccgaagcccgttaggtaacnggtgaccgaggttcggggtctagggacctgtaactcacgtcaccaagtcctnaaccggnaacgtcacgtacgacgtcgaacgttagttcgtacgttagtttagttactgtacgtacgtaactaacgtaagttcgtaccgtaccgtcgtacttccggttacgttcggacgggtacgggtaccgtacgggtacggtaaacacgttaaggaaacccgttagacggtcggtccgttacgaaccgttacccgtaagttaccgttacgttcgtttactccggttctttaccccgtattaacccg

SEQ ID NO: 248811 - DNA, 711 bp, Homo sapiens
  misc_feature: GYAE6OF02HKT4J.47.64.F09.1.454.CMB.1.raw
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
  modified_base (502)..(502): a, c, t, g, unknown or other
  misc_feature (502)..(502): n is a, c, g, or t
tcagagctcacgtacacgaccggtgctcgattttagcgcgtatacaagggggaggaactgctcagttaggacccagagggaaccatggaagccccagctcagcttctcttcctcctgctactctggctcccagataccatcggagagttgtgttgacacagtctccacnccaccttgttctttgtctccgaaggggaacncgacccaccctctcctgcgacgggccagtccgaaggagttaattacgcagactaacttacgccgttaggaaccaggacaacgaaccgtgggccaggcctcccgacggccttcctcattccgtagtcggtacgctaaccgtcccgaaccggtccgggcctaccgtttcggttaccccagtccgtacggttacgtaggtcggcttaggtcgttcggtacgtacgggtactaggttacgttactaccgtactccgaacctactcaaccgtacgccgtacgtccgtaaggttctaggtaacgtttntttcggaagtttacgttttaactcgtagttacgaacgttacgttaagacctttaacgtaacggttaacccggtccgtccggttactcccggttaaccggttacgaaccgtaacgggttaccaccggttacgttaaccgggagtaaaccgttacgttaaggactaggtccttacgacctacgttcagttcccgttactcctacttcccgg

SEQ ID NO: 248812 - DNA, 671 bp, Homo sapiens
  misc_feature: GYAE6OF02G4QWP.47.64.F09.1.454.CMB.1.raw
  modified_base (207)..(207): a, c, t, g, unknown or other
  misc_feature (207)..(207): n is a, c, g, or t
  modified_base (324)..(324): a, c, t, g, unknown or other
  misc_feature (324)..(324): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccagtcggagagttgtgttagacacagtcctccacgccctacccttgttctttcgtctccgaaggggaaacncgcccaccctcgtcctgcgacgggcagtcgaagaatcttacaccttaccgttacttacgccgtacggaaccaacaacggaacccttggtacgacggccctaccgagtcctccgtacncttacattgatccgacactaccgaaccggacggtccctacggcgacctacgtcccgaagtaccgtagttcgacggtggcgtaggttcgggtcgtacggactacgtacctcgtaccgtaccactaaccgtcgtacgtcgacgtaccgtcgtaacggtacgtccgtaagtacgttacgtttagtaactttgttaacgtcgtgtacgtctcggtacgtgttccgtcgccgtaccgtcccgtattcggttacgtcggacgggtacgggaaccgtgggtacgacgtacgtaacgacggtcggtcgtgccgtacgccttacggtctttacctcggttaccttcgtcccgttcc

SEQ ID NO: 248813 - DNA, 691 bp, Homo sapiens
  misc_feature: GYAE6OF02IWJ6D.47.64.F09.1.454.CMB.1.raw
  modified_base (151)..(151): a, c, t, g, unknown or other
  misc_feature (151)..(151): n is a, c, g, or t
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
tcagagctcacgtacacgaccggtgctcgatttagcgcgtatacaagggggaggaactgctcagttaggacccagagggaaccatggaagccccaggctcagcgttctcttcctcctgctaactcgtggcctcccagactaccagtcgganaagttgtgttcgacangtctccagccacctgtctttgctacgaggggaangccacctcgtccgtgcgacgggccaggtcaagtattactcactcgtacttacgcctagtaaccaanacgtaacctggtacaggtcctaccgaggtcctactctatcatgatgacactaccgaaggtcggacccaggttcgacctactaccgaaggacgttacggttacaggtcggactaggtcgggtgtacgggactagtctacgtactacgtcaacctacgtagccgacgacgtacgacggtacgtacgtacggtaacgttacgtttacggtaacttttacgtaaccgtgtactacggtcacggttcggacggttgttaccggtcggtacccgtcgtacccgttcgtaccgggtttaccggggacgggtaccgggacggtacgggggagtaccggtaagtaaccggtaacggtaacggtcgggtacgtaccggtaccgtacctaaccgggttattccgggttcttaccgttaccgtaccgttaccccgg

SEQ ID NO: 248814 - DNA, 888 bp, Homo sapiens
  misc_feature: GYAE6OF02IIVNG.47.64.F09.1.454.CMB.1.raw
  modified_base (813)..(813): a, c, t, g, unknown or other
  misc_feature (813)..(813): n is a, c, g, or t
tcagagctcacgtacacgaccggtgctcgatttagcgcgtatacaagggggaggaactgctcagttaggacccagagggaaccatggaagccccagctcagcttctcttcctctgctactctggcctccgagactaccagtcggaagtaagttgttgttagacacgagtcctaccagccctaccttgttctttcgtctaccgaagggggaaactcgccctacccttctcctgacgacgggcacgtcgaataattacttcaccttaccttacgtacgtcccgttacggtaaccaacaacgtaaaacctcgggtaccacggtaccctacccgacggccctaccgtctaacttccgtaatggtacttacgactaccgttacgaaacccggtgggacccctacggtacgtacccgaaccctacccgtaaacggtaacggttaccgggttaaccgtggggttacgacgggttcgggttcggggtaccgggtacgggtaaccggtacggtttaaaccctttcggtaaaccttcccgtaacctaaccctacggtaccgacgtaccgtaaccgtccgttacggaacccgtaccgttaacgggtaaccgtttacggtttttaagttaccttttaaacgttccgtacgggtaccaacggttaaccgttgttaaccgggttagtttaccggtcgttacccgggcccctttaactcccgtttaaccgggttccgggtaacccggggaccgggttaaacggggggtaccgttcggggaaacgtaccggttaaccgttaaaccggtaccggttcgggtttaaccggngggtaaccccggttaacgaccccgttccgtttacggtttacccggttcttttacccgtcttaccccggttccccg

SEQ ID NO: 248815 - DNA, 647 bp, Homo sapiens
  misc_feature: GYAE6OF02I1JNQ.47.64.F09.1.454.CMB.1.raw
  modified_base (193)..(193): a, c, t, g, unknown or other
  misc_feature (193)..(193): n is a, c, g, or t
  modified_base (320)..(320): a, c, t, g, unknown or other
  misc_feature (320)..(320): n is a, c, g, or t
  modified_base (615)..(615): a, c, t, g, unknown or other
  misc_feature (615)..(615): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccaccggagaagttatttgacacagtcctccagcctacctgtcttgctacgagggaancgccaccctctctgcgaggtcagtcagatgtgacagctaactgcgtagtaaccaagacgaaacctggccaaggctacccgaggcctacctgactgaggtactcgacctataccgaacgacggccgtntacggccactcccgaagcctaacggttacgagttccggagtaccgggttggggttaccacggggaactacggtacttacgtacttccggacttaccaagttacaacggctaacgacccgttagaccgtacgtacgtaaaccgttagtttaccgtagttaacgtttacgtaaacttcggtaactacgaacttaaacgtaaatccgttaaggccctaacgcttacgtaccgttacggacggaacggtaccgaagtacgtacgagtaacgaacgtagtgtacgcttacgctaaccgtntactacgtcttagcgtaccgtaccgtactacg

SEQ ID NO: 248816 - DNA, 759 bp, Homo sapiens
  misc_feature: GYAE6OF02FOXRJ.47.64.F09.1.454.CMB.1.raw
  modified_base (151)..(151): a, c, t, g, unknown or other
  misc_feature (151)..(151): n is a, c, g, or t
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (290)..(290): a, c, t, g, unknown or other
  misc_feature (290)..(290): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgngttgacacagtctccagccaccctgtctttgctccgagggaangccacctctcctgcagggtcagtcagngtgttgacagactattagtctaggtaccaaggacgaaaccgtggaccaggcctaccagggtcctacctnagttccgtaggggactcgacctacgtaccgaaacggtccggggacccgtcggtacgggacctaaccgtccccgaacggtccgtagggtttaccagggttcggaccgtagggtcggggttacgtacggggaactaggtacccttacgtaaccttccgtaccgaaaccttacgttacccggaacgtacccggtaacgtaccgttaacgggtaaccgtaccggttacgggtaaacgttaggttttaccgaacggttttaacggttttaaccttacggttacggttaacgtaacgtaaccgttaaacgttaacgttaccgtaccgggtcccttaccggtaccttaccggttaccggtttaccgggacgggtacgggtacggacgggttacgacgtagtaaccggaacgtacggttcggtacgtacgtaccgacctacgtacgtcgttacgttctacgtcctttcccgtacccg

SEQ ID NO: 248817 - DNA, 707 bp, Homo sapiens
  misc_feature: GYAE6OF02JLDEH.47.64.F09.1.454.CMB.1.raw
  modified_base (199)..(199): a, c, t, g, unknown or other
  misc_feature (199)..(199): n is a, c, g, or t
  modified_base (240)..(240): a, c, t, g, unknown or other
  misc_feature (240)..(240): n is a, c, g, or t
  modified_base (625)..(625): a, c, t, g, unknown or other
  misc_feature (625)..(625): n is a, c, g, or t
tcagagctcacgtacacgaccggtgctcgatttagcgcgtatacaagggggaggaactgctcagttaggacccagagggaaccatggaagccccagctcagcttctctcctctgctactctggcctcccagataccatcggagaagttgtgttgacacagtctccagcccaccttgttctttgcctaccgaggggaaancgcccaccctctcctgcgaggcctagtacagtatacttacnctacctactagccctaggtaacccaactaacgaaccgttgggaccacgccgtacccgaggtcctaccctcctatccttagacgtacgtacgctaactcccgaaaacggccggtaccctaggtcggacccaccgtacccgaagtactacgggttcacgggttacggcgtagggtcgggttccgtaggggacctagcccttacgaccgttctacaccctatcgacacgtcgaccgtacgaccgctaggtaactcggtttaccgttaatttacgtactgtacgtggtacctaggttcgtccgtaagttccggtacgcccgttaccgtaccgttaccggttccggttacgggttaccgggagggttacggaccgggtagtaccggttanacggtaacccgttcggttagtacccggaccgtacgaccgtaccggttacgtccgtttacgtaccgttccgtaccttccccgg

SEQ ID NO: 248818 - DNA, 686 bp, Homo sapiens
  misc_feature: GYAE6OF02G9571.47.64.F09.1.454.CMB.1.raw
  modified_base (403)..(403): a, c, t, g, unknown or other
  misc_feature (403)..(403): n is a, c, g, or t
  modified_base (454)..(454): a, c, t, g, unknown or other
  misc_feature (454)..(454): n is a, c, g, or t
tcagagctcacgtacacgaccggtgctcgatttagcgcgtatacaaggggggaggaactgctcagttaggacccagagggaaccatggaagccccagctcagcttctcttcctcctgctactctggcctcccagataccatcggagtaagttgtgttgacacagtctccacgcccaccctgttctttgtcctccgaaggggaaagacgcccacccttctccgtgccgacgggccagtcaagtacttattccacttccttacttacgcctacggtaaccaacgaacgtaacctggtaccacggtcctcccgaggccttcctcattctatgtacgtcgacctactacccgaacggaccgggtcctaacgtcggacctacctaccgtacgaaccgttcggttacgnggtcgtcgtaggtcggtcgtagggactacgtactcactcgtacactgcacncgaccgcgtagaccgtacgtaggtaacgttcgtttagtactttaacgtcgtacgtacgacgtccgtaggtcgttacgtcggttaccgcggttaccctccgttaccgtccgttacggttccgggagggtaccgggtacggtaggggtacgaagttacctaccgggaacggtacgtcggtcggtacgtaccgtaccgaaccttcgtggttaccttccggttactaccggttccc

SEQ ID NO: 248819 - DNA, 877 bp, Homo sapiens
  misc_feature: GYAE6OF02FK56V.47.64.F09.1.454.CMB.1.raw
  modified_base (200)..(200): a, c, t, g, unknown or other
  misc_feature (200)..(200): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagtaagttgtgttgacacagtcctccacgccaccctgtctttgtctccgaggggaaancgacccacccgtctccgtgacgtacgggcccagtaccgagtaattacttaccaccttaccttaacgttacgacccttacgggtaacccaaacaacggtaaacccgttggtaccacgggtaccttaccccgaagggtccttacccgtactaacttcctaagttacggtactcggtacctaccgttaacccgaaaccggtaccgggtaccctaacggttacggacctactaccccgtaagtaaccgtacgggttaccgaggtccggtacgttaggttaccgggtcgttaccggggaacttacgggtttacgttcccaaccgttacctaacccgaaacccgttacgttaaccgaaaccggtaccgtaccgtacgtaccggtaacgtttccggtaaggtaaccgtttagtttaccggtaacgtttaaggttttaaccgttaccttacggtaaccgttgtaaccgttaaacggttacctacctttaaaccggttaccggttcccggtacccggtacccgtttaacccggttaccccggttaaccgggtaaccccgggtaacgaacccggtttaaggacccgttaagggtaaacctaaccggttaaacggtacgtaccggtaggtaacccctagtaacccgtacgtaccttagttccgtttaccctaccgttacgttaccccg

SEQ ID NO: 248820 - DNA, 936 bp, Homo sapiens
  misc_feature: GYAE6OF02I9VB3.47.64.F09.1.454.CMB.1.raw
  modified_base (116)..(116): a, c, t, g, unknown or other
  misc_feature (116)..(116): n is a, c, g, or t
  modified_base (161)..(161): a, c, t, g, unknown or other
  misc_feature (161)..(161): n is a, c, g, or t
  modified_base (208)..(208): a, c, t, g, unknown or other
  misc_feature (208)..(208): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
tcagagctcacgtacacgaccggtgctcgatttagcgcgtatacaaggggggaggaactgctcagttaggacccagagggaaccatggaagccccagctcagcttctcttcctccngctactctcggctacccagactaccagtcggagtaagttgtgttnacacagtctctacgacccgtacctgtctttcgtcctcgaaggggaanacgcctaccgtcctcctgccgacggccagtcgaagtatactcacgtctacgttacgcctacggtaaccaacacgtaaaccgtgtacgacggtactccccgaaggcctaccttcaacttccgtaatgacacggtactactacgaacgacgggtcctaacgtcggaccncgtaacccgngaacgtacgtcgtaaggtcggacgtaggtcgggttcggaaacgggcgtaactccgtagtactaccccgtttacaacccgtacgttaccacggtacgacccgtacgttaacccggtaacgtaacccgttaaacggtaaacggtttacgtttaacggtttaaaccgtttaccgttaaaccgtttacgtaaccggtaacggttacccgggttaacgttaacggtttaccgggttaaccgggttttacccggccccggggttaaccccgtttaccccggttacggtttaacccggtttacccggggttttcccggggggtaaaccgggggttaaacccggggtaaaccccgggtttaaggggggtaaccgggttaaccggggtaaacccgggttttaaccggggttaaaaaccccgggtaaccggttttaagggggaaccccgggtttacccggggtacccgtttaaaccccgggtacccggtttaaacccttttacccgggtttaccccggtttaacggttttaccccccggtttaaagtttcccccccccggg

SEQ ID NO: 248821 - DNA, 800 bp, Homo sapiens
  misc_feature: GYAE6OF02HG01H.47.64.F09.1.454.CMB.1.raw
  modified_base (197)..(197): a, c, t, g, unknown or other
  misc_feature (197)..(197): n is a, c, g, or t
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaanacgcccacccgtctcctgcgacgggccagtcaagaattagttcactcctacttacgcctggtaccanacgaaccgtggtcaggcctccaggcctccncatctatcgatgcctactacccgaacgtacgggcccaacgtcggaccacgtcccagtaccgtaggttcaggttcggacgtacgggtaggtcgtaggggacctacggtaccttacctacgttccttaccgaaccctagttaccggagtacccgtaacggtacccgtaagggtaaccgtccggtttaaagggaaaccttttaccgggtttttaaccgggtttaaacctttttaaccttttaacggttcccggtttaacaaccgggtcgtaaccgggttccggttaggggtttaccgttccggttaaccgggtccccgtttcccgtaccggtttcccgttacccgggttttacggggacccgggttaccggggaacccggttgggggttaacccgacggttaaccggtaagggtaaaccggttccggtagggttccggtcgttaaccggtcccgtaaagtcccggtttaaccgttcggtttaccttaacccgtttccgttaccccccgg

SEQ ID NO: 248822 - DNA, 900 bp, Homo sapiens
  misc_feature: GYAE6OF02G424C.47.64.F09.1.454.CMB.1.raw
  modified_base (201)..(201): a, c, t, g, unknown or other
  misc_feature (201)..(201): n is a, c, g, or t
tcagagctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagcccaccctgttctttgtcctaccgaaggggaancgcccaccctctcctgcgacgggccagtacaagtaattacttaccacctaccttacgttacgcccgttacggtaacccaaacgaacgtaaaccgtcggtaccacggccctacccgacggtacccttcctacgtacttaccgtagtcgggtacgacctacctacccgaaccggtacgggacccttacggtacggtacctaccccgaggtaccgtacgggttcgagggtcggtaccgtagggttcggggttaccggtaggggtaaccgtaggttacgttacccgaccgttaccgtacccgtaacctacgttacgaaccggtacctaccgggtcccgttacggtaccctaacggtttaccgttaaagggttaacgtttaaccgttttcggaaccgtttaagggtttaacgttttaaccgtttaccgttaacggttaccgtaacgttacggtaaacgttaacgggtacggtaacccgttccccttaacccgtttaccggttttacccgttacccccgggttttcccgggaacccggggtttacgggtaaccgggttaaacgggttacgggttaacgtaaccgggttaacccggtaaaaccggtacggttccggggtaaacggtccggttaacccggacccgttaaccgtttccggtaccgtttaccgttaccttacccgttacccgtttacccggtacccccg

SEQ ID NO: 248823 - DNA, 679 bp, Homo sapiens
  misc_feature: GYAE6OF02GGW4E.47.64.F09.1.454.CMB.1.raw
  modified_base (197)..(197): a, c, t, g, unknown or other
  misc_feature (197)..(197): n is a, c, g, or t
tcagagctcacgtacacgaccggtgctcgatttagcgcgtatacaagggggaggaactgctcagttaggacccagagggaaccatggaagccccagctcagcttctcttcctctgctactctggctcccagataccatcggagaagttgtgttgacacagtctccagccaccctgtctttgtctccgaaggggaaangccaccctctcctgcagggccagtcagaatattcactcctacttagcctgtaccaacacgaaccgtggtcgacggctcccgaggtcctacctcatactagtcgaatgacaactaccgaacgaggggcccacgtcggcctacgtccccaagtaccgtaggttaccaggtcgggacgtaaggttcggggtctacggggaactaggtcccttaccgaccttccgtaaccaaccctataccgtacacgtaacgtacccgtaagaccggttccctaaggtaaacgttacgtttcggttaactttacgttaccgtagttccaagtcctaaggtcgttacgtagtttccgtaccggtcctaccgtcgtacctttacggtccgggtacggggacgtacggagggttacggaactacggtaacgaaacggtcggtggtaccgtacgtcgactaccgtacgttccgttaggtccctttacgtaccttcccgg

SEQ ID NO: 248824 - DNA, 887 bp, Homo sapiens
  misc_feature: GYAE6OF02JI0RI.47.64.F09.1.454.CMB.1.raw
  modified_base (864)..(864): a, c, t, g, unknown or other
  misc_feature (864)..(864): n is a, c, g, or t
tcagagctcacgtacacgaccggtgctcgatttagcgcgtatacaagggggaggaactgctcagttaggacccagagggaaccatggaagccccagctcagcttctcttcctctgctactctggcctccagtactaccatcggagtaagttgtgttgacacgacgttcctccacggaccctcccgttgttctttcgtccgtccggaaggggaaacgcctacccacccgttcgttcctacggaccgaacggggtacctacggtacaaaggttaacttacttacctaccgttaaccttacgtttacgacccgttacggaaaccaaaccggtaaccgtaaccgttggttaccgaaaccggtctacccgtaacggtccttccgtaactcgttaacgtacgtatacggacctacgtaaccgtaaccgaacgtacgggtaaccctacgttaccggaccctttaaccggtcccggaactacgggttaaccgtacggtacgggttaacggcgtttaaccgggtcggttcgggtaaccgggaattaaccgggtacttaccggtaacttacccgtaccaaacgtttaccgacggtaccaagggtaccttaccggaacggttaccggtactaaacgggtaaccgttagttttacgggtaacccttttacgaacgttttccgaacgtacgtacggttacgtacggttacgttacggtactcccgggttactaccggttccgtacggtaacccgttacgggaccggtaacggtacggttcggaacggtactaccgggtaacgtaaccggttacccggttaaggtccgtaaacggttcccgttaaccgtaccggtttaacggtccgttttaacccggngtttaccccggtccctttaccgg

SEQ ID NO: 248825 - DNA, 559 bp, Homo sapiens
  misc_feature: GYAE6OF01AJAZV.17.26.C04.1.454.CMB.1.raw
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaagcccctaagctcctgatctttgctgcatccagtttgactaaggtcggggtcccttagaaggttcagtggcaggtggatcgtgggacagtatttcacttctcaccatcagcagtcngacacctgaatntttagactaacttactactgtacaactagtacgttaaccaactccccgttacggtccttaccgtaccggtttccgggaccgggtaacgggaaccggtaaggtagggaagtaacgtaccgaaaacggtaacgtcggtacggcctacggccgtaaccgtacg

SEQ ID NO: 248826 - DNA, 551 bp, Homo sapiens
  misc_feature: GYAE6OF01BO8HM.17.26.C04.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
  modified_base (529)..(529): a, c, t, g, unknown or other
  misc_feature (529)..(529): n is a, c, g, or t
  modified_base (543)..(543): a, c, t, g, unknown or other
  misc_feature (543)..(543): n is a, c, g, or t
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccggnaagtcagagcattagcagcttaatttaaattggtatcagacaagaaaccagggaaacnccccgtaagcctcctgattctttgctgctattcctagtttcgacgtaaaggttcggggtcccttagaacggttcaggtcggacgaggtggactcgtagggactaggtactttacgacttctacacctatcagtctagtctagaccaacgtagtaagttattttacgacttaacttactactagtacaactagtaacttactaacttacccgcgtactcgtacgttcggcggacggacgaggtagagtanacgaagactgcgangcactacg

SEQ ID NO: 248827 - DNA, 517 bp, Homo sapiens
  misc_feature: GYAE6OF01CQQ1W.17.26.C04.1.454.CMB.1.raw
  modified_base (229)..(229): a, c, t, g, unknown or other
  misc_feature (229)..(229): n is a, c, g, or t
  modified_base (419)..(419): a, c, t, g, unknown or other
  misc_feature (419)..(419): n is a, c, g, or t
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagngcattagcagctatttaaattggtatcagcagaaaccagggaaacgcccctaagctcctgatctttgctgcatccagtttgactaaaggtcggggtcccttgaaaggttcagttggctagtggatcgtgggacagtattcacttctcacatcagcagtctgcactgaagtatttgactaacttactactntacaacagtacttacacttacccctgtcctctacgttcggacggtaggaaccgagggtgaagactacgaaacgtacgtgtacggctacggcacgtacg

SEQ ID NO: 248828 - DNA, 571 bp, Homo sapiens
  misc_feature: GYAE6OF01AVCOX.17.26.C04.1.454.CMB.1.raw
  modified_base (385)..(385): a, c, t, g, unknown or other
  misc_feature (385)..(385): n is a, c, g, or t
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgaccccagtctccatcctccctgtctgcatctgtaggagacagagtcaccatcacttgccgggcaagtcagagcattagcagctatttaaattggtatcagcagaaaccagggaaacgcccctaagctcctgattctttgctgcatcctagtttgctaaaggttcggggtcccttgaaggttcaggtggcaggtggtatcgtgggacagtatttccactctcaccntacagctacgtctcgaccaaccgtgaagtacttttgactaacttactactagtacaacgagtaacgttaaccaaccttaccccgtccgtactcctacgtttccgggacggtacgggaacccgtaaggggtacggaacgtactaaccgaaaaccggtacgtcggtagggacctgcccgaaccgtacg

SEQ ID NO: 248829 - DNA, 578 bp, Homo sapiens
  misc_feature: GYAE6OF01DCYTJ.17.26.C04.1.454.CMB.1.raw
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatcacttgccgggcaagtcagancattagcagctaatttaaatggtatcagacaagaaaccagggaaacncccctaagctcctgactctttgctgctactccagtttgacgtaaggttcggggtccctttagaaggttcaggttggactaggtggtaactcgtagggacagtactttcgactactaccacctatacagtctagtctagcctaacgtagtaacgtatttacgactaacttactactgtaacaactagtaacttacaacttcccgtcgtacctcgtaccgtttcgggacgggtacgggaccgtaagggtaggtaaggtactaacgaaacgacgttcggtacggtcctacgccgtaccgtacg

SEQ ID NO: 248830 - DNA, 558 bp, Homo sapiens
  misc_feature: GYAE6OF01ET9RJ.17.26.C04.1.454.CMB.1.raw
  modified_base (236)..(236): a, c, t, g, unknown or other
  misc_feature (236)..(236): n is a, c, g, or t
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
tcagcgtagactagcacgaccggtgctcgatttagtctagcgacttttggggtttggggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatcacttgccgggcaagtcaganctattagcagactaatttaaattggtatcagacaacgaaaccgaaggaacgaccctaacgcctcctgaanccttttgcctgcattccagtttgcgaaacgtgggggtacccttcaaagggtttcagtggcagtggagtctgggactagatttcntactctactacactcagactacgtcgtacgactacgtagtagtactttacgtactaacttactactactactaacgtaagtaactaactacctacccgtccgtactactacgtcggacggacggtacgtaggaggacgtagtaacgaacgtacgtgagcgtcgcgtac

SEQ ID NO: 248831 - DNA, 931 bp, Homo sapiens
  misc_feature: GYAE6OF01CN74O.17.26.C04.1.454.CMB.1.raw
tcagcgtagactagcacgaccggtgctcgatttagtctagcgactttggggtttgggggagtcagtctcagtcaggacacagcatggacatggacgggtccccgctcagctccgtgggctcctgctactctggctccggaggtgccagatgtgacatccagatcgacccagtctccatccctccctgtctgctatcgtaggtaggagacagtacgtacaaccacttcacgtttcggacccggggtactaaacgtccgaaggagtacctaagtttacgactaacgttaccgttttaaagtttttaaaagtttggttaactacgaaggtaccgaaaacggtaaaacccggaaacggggtaaaaccgtacccccgttaaacgtccttaccgttagtacctttcgttttcggaccttacgaccttacgttaccgttaaggttttacggaacggttaaacggggtttccggggtttaccctttaacggttaaacggggtttcccgtaagggttcggtacggttacggtcggtacgttcgggtaacgggtaacgtacggtttaacctttaccgtaaccgtttccttaacccgaacccttacgtaccgacgtacccgttaaggttacccgtacggaacccgttaacggtaaggttaacgtttacgttttaacgaaccctttaaacgttttacttaacccgggttaacggttaaaccctaaacggttaaacggttaaaccgttttaacccgtaaaccccgtttaccccggttaccggtccctttaaacccgggtttaccgggtttaccgggggaaaccgggtaaaccggggtaaccggttaaacggggttagggtaaaacccgtacggttaaaccccgttaaaacgggtacggttacgggttaccggtaccttaaccggaccgttaaacccgtttaccg

SEQ ID NO: 248832 - DNA, 644 bp, Homo sapiens
  misc_feature: GYAE6OF01D5BYC.17.26.C04.1.454.CMB.1.raw
  modified_base (102)..(102): a, c, t, g, unknown or other
  misc_feature (102)..(102): n is a, c, g, or t
  modified_base (223)..(223): a, c, t, g, unknown or other
  misc_feature (223)..(223): n is a, c, g, or t
  modified_base (280)..(280): a, c, t, g, unknown or other
  misc_feature (280)..(280): n is a, c, g, or t
tcagcgtagactagcacgaccggtgctcgatttagtctagcgactttgggtttgggggagtcagtctcagtcaggacacagcatggacatgagggtccccgntcagctcctggggctcctgctactctggctccggaggtgccagatgtgacatccagatgacccagtctccatccctccctgtctgcatctgtaggagacagagtcaccatcacttgccggnaagtcagagcattagcagtcttaatttaattggtatcagcaagaaaccagggaaacncccctaagctcctagtactttctttcgctcgactacttccgtagtttacgacgtaaaggttccggggttacccttagtaaggtttcaggttgacgtaggtggactcggtacgggactaaggttactttacgacttctaccacctatcgacgtactacgtctacgacctaacgttaggtaacgttatttacgaccttaactttactacttcgtaacaacgtacgttaacgttaacctaaccgttaccccgtacgtaccttacgtaccggtttacgggacgggtaacggtaccggtaaagggtacggtaacgtaaccgtaaacgtaaacgtacgttcgggtacggtacctacggacctacgttacg

SEQ ID NO: 248833 - DNA, 504 bp, Homo sapiens
  misc_feature: GYAE6OF02G16KO.17.26.C04.1.454.CMB.1.raw
  modified_base (324)..(324): a, c, t, g, unknown or other
  misc_feature (324)..(324): n is a, c, g, or t
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtgggtccttnaaggttcagtggcagtggatctgggacagatttcactctcaccatcagcagtctgcaacctgaagtattttgctaacttactactgtacaactagagttaacaacttaccctcggctcactttcggcggtacgggaccaagggtcggaagatacgaaacgaactggtagctgcacctacg

SEQ ID NO: 248834 - DNA, 718 bp, Homo sapiens
  misc_feature: GYAE6OF02IHEVZ.17.26.C04.1.454.CMB.1.raw
  modified_base (201)..(201): a, c, t, g, unknown or other
  misc_feature (201)..(201): n is a, c, g, or t
tcagcgtagactagcacgaccggtgctcgatttagtctagcgactttgggtttgggggagtcagtctcagtcaggacacagcatggacatgagggtccccgctcagctccgtgggctcctgctactctggctccgaggtgccagatgtgacatccagatgacccagtcctccatccctccctgtctgcattcgtgtagganacagagtccaccatcacttggccgggacaagtcagagctattagcagtacttaattttaaattggtatacagacaagaaaccgagggaaacgaccccgtaagcctcctgacttctttgctgctactccgtagtttcgacgtaaacggttcggggttacccttagtaacggtttcgaggtcggactaggtaggtatcgtagggactagttactttaccgacttcctacctaaccctagtaccgacgtcgtaagttccgtacgaacctaaaccgtaggtaaacgtttacgttttcgtaaccttaaaccttttaccgtaaccgtttacgtaaccttaaacgtaacgttaaaccgtttaaaccgtaacccgttaacccccgttacgaccgtttaacccgtaccggttttaccgggaccgggtaaccgggtaaaccggaacggggttacgggaacgtaacgttaacgaaaaccggtacggttacggttacggtacccgttacggaccccgttaaccgtaccg

SEQ ID NO: 248835 - DNA, 641 bp, Homo sapiens
  misc_feature: GYAE6OF02IA2YW.17.26.C04.1.454.CMB.1.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
tcagcgtagactagcacgaccggtgctcgatttagtctagcgacttttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggcaagtcagagcattagcagtacttaattaaattggtatnagacaagaaaaccgaagggaaacncccccgtaagccttccgtagacttctttgctcgactatcctagtttcgacgtaaaggttcgggtacccttacgaagtttccgagtcggactaggtacggatcgtagggtactagtacttttaccacgttcacactaatacgagcacgtctagacctaactagtaagttatttacgaaccttaacttaactacttacgtaactaaacgtacgtaacgttaacctaaccgttaacccgttccgacgttaccgtaccgtttacgggaccgggtaaccggtaccggtaaagggtcggtaaacgtaacgttaaacccgaaaggtacgttacgtacggtaccgttacgaccctaccgttaacg

SEQ ID NO: 248836 - DNA, 702 bp, Homo sapiens
  misc_feature: GYAE6OF02IVO33.17.26.C04.1.454.CMB.1.raw
  modified_base (131)..(131): a, c, t, g, unknown or other
  misc_feature (131)..(131): n is a, c, g, or t
  modified_base (341)..(341): a, c, t, g, unknown or other
  misc_feature (341)..(341): n is a, c, g, or t
tcagcgtagactagcacgaccggtgctcgatttagtctagcgactttgggtttgggggagtcagtctcagtcaggacacagcatggacatgagggtccccgctcagctcctggggccctcgctactctcgngtccgtacggtggccacgatgtggacactcctacgatcgtacccgacgtcgttcctactcccttcccctcgtctgcactctggtaggaggacagagtaccaccactctacttcggccgggacgaagtcgagagactattagcagtacttaattttaattaggtatcagacaacgaaacgacgggaacgccctaagctcctgattcgttcngtcgcactcctagtttacgcgtaaaggttccggggttccttaacgtagggttcgacggtggtacgtaggtggtaacgtcgtacgggtaatagttactttcctactccttaccgtaaccgtacgtaccacgtactacgttactaccgtaccgtaaccgtaggtaagtttacgtttacgttaacctaacctttactactacgtactaaacgtagttacgttaacctaaacctacccgtccgttacctacggttaccgttacgggccgggtaacgggtaccggtacgggtaaggtacgtaaaccggtaacctaaacggtaacgtcgggtacgtaccgtaccgtaaccgacccgttacttaccgg

SEQ ID NO: 248837 - DNA, 502 bp, Homo sapiens
  misc_feature: GYAE6OF01B5JSQ.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacaactcctgatctatttggtctaatcgggcctcggggtccctgacaggttcagtggcagtgatcaggcacagactttacactagaaatcagcagagtggaggctgaggagtggttagggtttattacgtgctagtgacaagctactacaaactccgctacacgtttcgggacggacgggaccaagggtggaagatcgaagtacg

SEQ ID NO: 248838 - DNA, 609 bp, Homo sapiens
  misc_feature: GYAE6OF01CWYBI.39.36.D03.1.454.CMB.1.raw
  modified_base (508)..(508): a, c, t, g, unknown or other
  misc_feature (508)..(508): n is a, c, g, or t
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactcctccctgcccgtcacccctggacgacgcccggcctccatcctcctgcaggtctagtcagacgcctcctgcataagtaatggaatacaacttatttggattggtacctgacagaacgccgaggcagtcctaccaacaactcctagactcttagtttggtactaagtccgggcctccggggtcctgacgtaggttcaggtcggctaggtggatcgaggctaacgacgtaactttacaacgtaagaaaactcgaagtcgaaggtaggtgggaaggtcgtagggagggtagtttgggtttaggggtttaacttacgtgactagtacgacgtaanccgttaacaaccgtaaacgtcccgtacttaccgttaccggtttcgggaacgggtaacggggaaccgtaagggttacggaagtaacgtaccgaaaggtaccg

SEQ ID NO: 248839 - DNA, 554 bp, Homo sapiens
  misc_feature: GYAE6OF01EIRLJ.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggaatacaacttattggatttggtacctgcagaagccagggcagtctcacaactcctgatctatttggtctaagtcgggcctcgggtccctgacaggttcagtggacagtggatcaggcacagtacttacactagaaatcagcagagtaggagcgtagaggtagttggtttagggtttattacgtagtctagtacgacgaagtaccttacctaaacgtaaacctccggtacctaccgtacggtttccgggacgggtaacgggaacccggtaagggtacgggaagtaacgtacgaaggtaaccgg

SEQ ID NO: 248840 - DNA, 523 bp, Homo sapiens
  misc_feature: GYAE6OF01ATNYL.39.36.D03.1.454.CMB.1.raw
  modified_base (344)..(344): a, c, t, g, unknown or other
  misc_feature (344)..(344): n is a, c, g, or t
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgccaggtctagtcagagcctcctgcatagtaatggatacaactatttggattggtacctgcagaagcgaggcagtctcacactctgatctagtttggtctaacgtcggccgtcggggtccctgacnggttcagtggcagtggatcgaggtcacacgtacttacactagaaatcagcgagagtcggagcgtagagtagttgtttgggtttaattacgtgactagtgacagtctacgtaacaacgttccgcttacgacgtttcggacggtaagggaccgtaaggtaggagacgtacgaaggtaccgg

SEQ ID NO: 248841 - DNA, 701 bp, Homo sapiens
  misc_feature: GYAE6OF01DWBJB.39.36.D03.1.454.CMB.1.raw
  modified_base (351)..(351): a, c, t, g, unknown or other
  misc_feature (351)..(351): n is a, c, g, or t
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccaggtgggatattgtgatgactcagtctccactcctccctcgccccgtccaccccgtggacgacgcccggcctccattcctcctgcgaggttctagtcaggacgtccctcctgactaattaagtaagtggaactaactaacttagtttggatttcggtacctgacgagaacgccgaggctacgtcctaccaactactcctgtacttnttacgtttcggtactaacggtcccggtacccggttcccggggtccctaggacgtacggttcgagggttcggacgtaggtcggtactcggaacggtacgtaaccgtagttaaacctttaacgtaacgttaagtaaaactcgaacggacgaagggtacggtagggacggtcgtagggacgttaggtttaggtttagggtttactacgtcgtactaggtcacgtaacgtccttaaccgtaaaccgtaaccgtacccggttaccgttaccgtttaccgggttacccgggggaacgggtaaacccgggtaccgggtaaacggtagggaaagtacccgtaaggaaacggttaaccg

SEQ ID NO: 248842 - DNA, 758 bp, Homo sapiens
  misc_feature: GYAE6OF01B2RIX.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctccgtgggctgctaatgctcgtggtctctggatccaggtgggatattgtgatgactcacgtcctccacttcctccctcgcccgtccacccgtggacgacgcccgtcctcctactcctccgtgacaggttcgtacgtcaacgtacgtcccttacctagacctaagtagttaacgtaggaacttaacgttaaacgtttagtttacggtagtttaccgggtacctcggaacgtaacggacgacccggagggtacctaaccgttccaaccctaaccgaacctttaccgtagttaaccgtttacgtttacggttttacgggtaccgtaaccgggttcccgggtccccggttacccggggttactaacggaccgttacggttcgcggttacggacgtagggtacgtagtacccgaaggaccgtaacgtaacgttaaccgtttaaaccgaaacggttaacgaaacgtacgaccggtaaggtaacggtaagggtagggtacggtacgggtaaggtagggtttaacggtttaggggttttacggttttaacgtacgttacgagtacgttaagaccgttactacgtacctaacgtaaccctcgtctaacgttccggtacggacggtaacgacggtaggacgagtaacgtcgagtacgg

SEQ ID NO: 248843 - DNA, 1198 bp, Homo sapiens
  misc_feature: GYAE6OF01CLH5W.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccaggtgggatattgtgatgactcagtcctccactcctccccgtcgccccgtccaccccgtgggacgaccggccccggtcccttacccacttcccttccgtcggaccgtacggttccgtaacgtcgaacggtaccgtcccgttcccgtgacctaagttaacgtaaggttacggtaacttaacctaacgtttaggttttacgggtaacgttttacccgggttaacccgtcggaaaccgtaacgggtaaaaccggtcccgggtaacggggtaaccgttaacccggtttacccctaaccccggttaaaacccttaacccgtttcccggtaacgtttaaccgtttttaaccggtttttaacggggttttttacccggggtttaacccgtttaaaacccgggggtttcccccgggggggttccccccgggttttacccccggggggggtttaccccttaacggggggttaacccccgtttaacggggggttttacccgggttaacgggggttaccgggggtttacccggttaaacgggggtttaaccgggttaaccgggtttacccgggtaaacccgggtacccgtaaaaaccccgggttttaaaccgggttttaaaccccgtttttaaaacccggaaaacgttttaaaaaccgggtaaaaacccgggtttccggtaaaccggggtaaacccggggttaaaggggttaaaccgggggttacggggggtaaacgggtttccggggttaaaggggggtttaaaccgggttttaagggggtttttttaaccgggggtttttttaacggggttttttaaactacccggggtttagttaaccgggttaaccgttaacgggaaccgtttaaccccgggttacccttttaaacccgggtaaaaccccgttaaacccgtttaccccgggttacccgtttaacccggggttttaacccggggggttaaccccggggggaaaccggggtaaaaccccgggggtttaaaaccggtaaaccggggggtttaacgggtaaaaccccttaacccggggtttaaaccgtaaaacc

SEQ ID NO: 248844 - DNA, 562 bp, Homo sapiens
  misc_feature: GYAE6OF02IK2JW.39.36.D03.1.454.CMB.1.raw
  modified_base (350)..(350): a, c, t, g, unknown or other
  misc_feature (350)..(350): n is a, c, g, or t
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatcctcctgcaggtctagtcagacgccctcctgcatagtaatggatacaacttatttggatttggtacctgcagaagccagggcagtctcacaactcctgatctatttggtctaagtcgggcctccgggtccctgacngtcagtgcagtggatcgaggcacgagtactttacactagaaatcagacgagaggtagggaggcgtaggagggtagttgggtttaggggttttagtttacgtgtactagtgacgaagtctaccgtaacctaaccgtccgtacttaccgtaccgtttaccgggacgggtaacggggtaccggtaacgggtaggaggtacgtacgaaggtaccgg

SEQ ID NO: 248845 - DNA, 557 bp, Homo sapiens
  misc_feature: GYAE6OF02GWMDW.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagacgcctcctgcatagtaatggatacaactatttggattggtacctgcagaagccgagggcagtcctccacaactcctgactctagtttggttctaagtccgggccttccggggtccctgactaggttcagtggcagtgatcgaggcacgagtactttacactagaaaatcgagcgagaggtaggagcgtaggaggtagttgggtttagggtttattacgtgtactagtcgactaagtcctactaccaaaccgtccgtcttaccgtaccgtttcgggacgggtacgggaaccgtaagggtacggaagtacgtacgaacggtacgg

SEQ ID NO: 248846 - DNA, 572 bp, Homo sapiens
  misc_feature: GYAE6OF02HARJU.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactctccctgcccgtcacccctggagacgcccggcctccatcctcctgcaggtctagtcagagcctcctgcatagtaatgatacaacttatttggattggtacctgcagaacgccgagggcagtctccacaactcctgatcttagtttggttctaagtccgggtccgtccgggtcctgacgtagttcagtggctaggtgactcgaggcacgtagtactttacatagaaatcgagcaaggtaggtgggagcgtaggtaggtagttagggttttaggggtttacttcgtagtacgtagtcgacaagtcctacttaactaaccgtccgtaccttacgttaccggttaccgggacgggtaacggaaccggtaagggtaggaacgtacgtacgaaggtaccgg

SEQ ID NO: 248847 - DNA, 636 bp, Homo sapiens
  misc_feature: GYAE6OF02G7955.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactctccctgcccgtcaccctggagacgccggcctccattcctcctgctaggtctagtcagacgcctccgtgcatagtaatggactaactaacttagttggtactttggtacctgacaagacgccgagggccagtcctaccactactctgacttcttagtttggttactaacggtccgggtcccgttcccggggtccctaggacgttacgggttcgaggttggacgtaggtcggtatccgaggcctaacgtacgtacctttacacgtaaacgtaaactcgaagtcgtaaggtaggtacggaggtcgtagggtagggttacgtttggggtttagggttttaactagtacgtgttagtacggactacgttactaccgtaacgtaaccgtccgtaacttaccgtacggttcgggaaccgggtaagggaccggtaagggcggtaacgtacggtacgtaacgtacgg

SEQ ID NO: 248848 - DNA, 692 bp, Homo sapiens
  misc_feature: GYAE6OF02IQ1GI.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctcctggggctagctaatgctctgggtctctggatccagtggggatattgtgatgactcagtctccactctccctgcccgtcacccctggacgacgccggcctccatcctcctgcaggtctagtcagacgcctcctgctagtagttaagtggtactaactaacttagtttggtagttcggtactgacgaaggtacgacggacgggctacgttcctacccaactaccgttccgtagtacttgttagtttcggttactaacggtccgggtccgttcccgggtcctagtacgtaggtctaggtcggacgtagggtcgacgtacgacggacaacgtacgttaacttactaacgtaagtaaacgtcgtacgacgtaagggtacggtacgggaacggtacggtaggtaacgggttacgtttaggggttttaagggtttaacgttacggtacgtacgtaggttcgaacggtacgtaccgttaacgtaccgtaaaccggtccgtaaccttaccggtttaccgggtaccgggaaccgggtaaccgggttacggtaagggtacggtaacgtacggttacggacgttaaccggg

SEQ ID NO: 248849 - DNA, 617 bp, Homo sapiens
  misc_feature: GYAE6OF02HO5HU.39.36.D03.1.454.CMB.1.raw
tcagtcgcactagtcacgaccggtgctcgatttagctgcgtcacgatctctcttggggactgatcaggactcctcagttcaccttctcacaatgaggctccctgctcagctcctggggctgctaatgctctgggtctctggatccagtggggatattgtgatgactcagtctccactctccctgcccgtccacccctggagacgccggcctccatctcctgcaggtctagtcagacgcctctgctatagtaatggatacaactatttggattggtacctgacagagccagggcagtctaccacaactctgatctagtttggtactaagtccgggccgtccgggtcctagactaggttcagtggcagtgatcgacggcacgtaagtacctttacacgtaagaaactcgaagacaagggtaagtcgggaggtacgtacggtaagggtacgtttaggggttttaggggttttaatttacggtgtaccgtagttacgtaccgtaagtccttacctaacgttaaaccgtcccgtaccgttaccgttaccggttacggggaaccggggtaacgggtaacccggtaagggtcggtaacggtaacgttacggaaccgtaaccggg

SEQ ID NO: 248850 - DNA, 233 bp, Homo sapiens
  misc_feature: GYAE6OF01BDRQ0.40.34.D01.1.454.CMB.1.raw
  modified_base (232)..(233): a, c, t, g, unknown or other
  misc_feature (232)..(233): n is a, c, g, or t
tcagtctagcgactcacgaccggtgctcgatttagatcgtctgtgttgggtttgggatgactactgggccagggaaccctggtcaccgtctcttcagcttccaccaagggcccatcggtcttccccctggcgccctgctccaggagcacctctgggggcacagcggccctgggctgcctggtcaaggactacttccagtcgctagactgagcgggctggcaaggcgcatagnn

SEQ ID NO: 248851 - DNA, 214 bp, Homo sapiens
  misc_feature: GYAE6OF01CI9HT.40.34.D01.1.454.CMB.1.raw
  modified_base (212)..(214): a, c, t, g, unknown or other
  misc_feature (212)..(214): n is a, c, g, or t
tcagtctagcgactcacgaccggtgctcgatttagatcgtctgtgttgggccagggaaccctggtcaccgtctcttcagcttccaccaagggcccatcggtcttcccctggcgccctgctccaggagcacctctggggcacagcggccctgggctgcctggtcaaggactacttccagtcgctagactgagcgggctggcaaggcgcatagnnn

SEQ ID NO: 248852 - DNA, 237 bp, Homo sapiens
  misc_feature: GYAE6OF01DRQN1.40.34.D01.1.454.CMB.1.raw
  modified_base (233)..(237): a, c, t, g, unknown or other
  misc_feature (233)..(237): n is a, c, g, or t
tcagtctagcgactcacgaccggtgctcgatttagatcgtctgtgttgggtttggggatgactactggggccagggaaccctggtcaccgtctcttcagcttccaccaagggcccatcggtcttcccctggcgccctgctccaggagcacctctgggggcacagcggccctgggctgcctggtcaaggactacttccagtcgctagactgagcgggctggcaaggcgcatagnnnnn

SEQ ID NO: 248853 - DNA, 260 bp, Homo sapiens
  misc_feature: GYAE6OF01DU3OD.40.34.D01.1.454.CMB.1.raw
  modified_base (235)..(260): a, c, t, g, unknown or other
  misc_feature (235)..(260): n is a, c, g, or t
tcagtctagcgactcacgaccggtgctcgatttagatcgtctgtggttggggtttggggatgactactggggccagggaaccctggtcaccgtctcttcagcttccaccaaggcccatcggtcttccccctggcgccctgctccaggagcacctctgggggcacagcggccctgggctgcctggtcaaggctacttccagtcgctagacctgagcgggctggcaaggcgcatagnnnnnnnnnnnnnnnnnnnnnnnnnn

SEQ ID NO: 248854 - DNA, 527 bp, Homo sapiens
  misc_feature: GYAE6OF01D2LEA.40.34.D01.1.454.CMB.1.raw
  modified_base (516)..(516): a, c, t, g, unknown or other
  misc_feature (516)..(516): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctcatcgacagctcctccaattctgcctccctcaccatctctggactgaagctgaggacgagctgattatactgtcagtagtttatgattgactaactaatttacgtggggttgttcggacgggaggaaccaagctgacccgtctagtcagcccgaaggctcgcccctcggcacgtctcgtccccncctctcgtacg

SEQ ID NO: 248855 - DNA, 243 bp, Homo sapiens
  misc_feature: GYAE6OF01B20OQ.40.34.D01.1.454.CMB.1.raw
  modified_base (234)..(243): a, c, t, g, unknown or other
  misc_feature (234)..(243): n is a, c, g, or t
tcagtctagcgactcacgaccggtgctcgatttagatcgtctgtgttgggtttggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctagactgagcgggctggcaaggcgcatagnnnnnnnnnn

SEQ ID NO: 248856 - DNA, 556 bp, Homo sapiens
  misc_feature: GYAE6OF01AKYX3.40.34.D01.1.454.CMB.1.raw
  modified_base (183)..(183): a, c, t, g, unknown or other
  misc_feature (183)..(183): n is a, c, g, or t
  modified_base (261)..(261): a, c, t, g, unknown or other
  misc_feature (261)..(261): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcgggtctccggggaanacggtaaccatctcctgcacccgcagtagtggcagcattgccagcaactatgtgcagtggtaccagcagcgcccgggnagttcccccacactttaatctatgaggataacaaaagctctctggggtccctgatcggttctctggctccatcgacagcctcctccaattctgccctccctcaccatctctggactgaagactgagacgaggctgatttattactgtacagtagttatgatgacctaccaatttacgtgggtagttcggacgggaggtaacccaagcctggacccgttcaggtccagtccccgaaggtccctcggcccccctgggtacccacgttcctcgttaccccccgcccttccgctaccgg

SEQ ID NO: 248857 - DNA, 675 bp, Homo sapiens
  misc_feature: GYAE6OF01AJZXZ.40.34.D01.1.454.CMB.1.raw
  modified_base (185)..(185): a, c, t, g, unknown or other
  misc_feature (185)..(185): n is a, c, g, or t
  modified_base (284)..(284): a, c, t, g, unknown or other
  misc_feature (284)..(284): n is a, c, g, or t
  modified_base (364)..(364): a, c, t, g, unknown or other
  misc_feature (364)..(364): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaatttttatgctgactcagccccactctgtgtcggggtctccggggaanacggtaaccatctcctgcacccgcagtagtggcagcattgccagcaactatgtgcagtggtaccagcagccgcccgggcacgttcccccacactttaanctatgaggataaacaaaagctctcgtggggtccctgattcggttctcgtggcctccatcgacagcctcctccaatttccncgcccttcccctacacctacttcctcgtggaccttaggaacgtacgtggaacgggaccggaggcttaggtaatttactttacgtgttaccagttagtttaatgaacttcgaacctaacctaagtttaccggtggggttaccggttcgggacggggtaacgggaccctaaggtccgttacggaacccggttccgtaagggttccgacggtaccccgaaggtccccgttacccggtcccccccggttaggtcccttacccgttcccgtttacccgttacccccccctaccccgtttcccgtccgtaacccggg

SEQ ID NO: 248858 - DNA, 640 bp, Homo sapiens
  misc_feature: GYAE6OF01AT2NM.40.34.D01.1.454.CMB.1.raw
  modified_base (340)..(340): a, c, t, g, unknown or other
  misc_feature (340)..(340): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcgggtctccggggaagacggtaaccatctcctgcacccgcagtagtggcagcattgccagcaactatgtgcagtggtaccagcagcgcccggcacgttccccacactttaatctatgaggataacaaaagctctcgtgggtccctgactcggttctctggcctccatcgacancctcctcctaacttctcgccctccctcacctactcctcgtcgactagaacgtcgtagacggacgaggtctagttaatttactactgtactagtacgttagtgatacgaacctaactaacgtttacggttgggttacggttaccgggacgggtaacgggaccgaaggtccgtacgggtaccccgttaccggtacggtccgaccggaccccgtaacgggtccctaccccgggtcccccgttacggtacccctaccgtttcccgttaccccttacccccgtaccccttccccgtcgtacccgg

SEQ ID NO: 248859 - DNA, 788 bp, Homo sapiens
  misc_feature: GYAE6OF01A7OI4.40.34.D01.1.454.CMB.1.raw
tcagtctagcgactcacgaccggtgctcgatttagatcgtctgtgttgggtttgggaacctatgaacattctgtaggggccactgtcttctccactacttctcaccctcctcgctcactcgcacacggttctcgggcctaattttactcgctcgacctcacgcccactctcggtcggtcggggtcgtccggggaagaccggtaaccactcctcctcgccacccgcaggtacgtcggcacgctattcgccagacctaaacttagtggtcgacgtaggtcggtaaccaggccgacggccggcccgggacctaccgttacccccaacctaactttaatctagtgaagaactaaaacaaaacgctcgtcggtcggggtcctgtacgttcggttctcgtcgcctccacgtacgacacgtcctcctacctaacttcctccgtacccttccctacctaacctacttccgtacgtacggaacgtacggaaacgtacgtacgggaacgggaacggtacggtacttagttaactttaacgtttacgttacgtacgtaaggttaaggtttaacgtacgtaactaacgaacctaaacgttaaacgtttcgggttacggggtttacgggttaccgggggacggggtaaccgggaaccgtaacggtaccgtacggtacccggttaccggtaacggtacccgaaccggtacccggtaacgggtcccgttcccggtacccccggttccggtacccttaccgttcccgttaccccgttaccccttacccctcccgtccgtaccgg

SEQ ID NO: 248860 - DNA, 735 bp, Homo sapiens
  misc_feature: GYAE6OF01C0O1M.40.34.D01.1.454.CMB.1.raw
  modified_base (278)..(278): a, c, t, g, unknown or other
  misc_feature (278)..(278): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggaccagcagcgcccggcacgttccccacactttanctatgagataacaaaagctctcgtcgggtccctgactcggttctcgtggctccatcgacagcctcctcctaattcctcgccctccctcaccctatccgttctacggacttaggaacgacgtagggaacgggaccggtaagggtccttaggttaacttttaacgtttacgttacggtccgtaagggttaagttttaacgtgtaacgttacggaaaccctaaccttaaagttttacccggttgggggtttacgggtttaccggggaccgggggtaaacggggaaccccgtaagggtcccgttaccgggtaaccccggtttcccggttaaaccgggtcccgaaccggtacccccggtaaaccgggtcccgtacccccggttcccccccggttaccggttaccctaccccgtttcccgttaccccggtttcccccccgccccctttccccgtcgtacccgg

SEQ ID NO: 248861 - DNA, 615 bp, Homo sapiens
  misc_feature: GYAE6OF01ATTJ4.40.34.D01.1.454.CMB.1.raw
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (571)..(571): a, c, t, g, unknown or other
  misc_feature (571)..(571): n is a, c, g, or t
  modified_base (610)..(610): a, c, t, g, unknown or other
  misc_feature (610)..(610): n is a, c, g, or t
tcagtctagcgactcacgaccggtgctcgatttagatcgtctgtgttgggtttgggaacctatgaacattctgtaggggccactgtcttcgtccactacttctcaccctccctcgctcactgcacaggttcttgggccaattttatgctgactcagccccactctgtgtcgggtctccggggaagacgtaaccatctcctgcacccgcagttagtggcagctattgccagcaactagtgtgcaggtgtaccagcagcgcccggcacgttccccactactttanctatgagataacaaanctctcgtcgggtcctgtactcggttctcgtgcctcatcgacacgtcctacctaccaattccgtacgtccccttcccgtaccaaccgtactcttacgtaggtacgtagaacgtacgtaggaacggacgtacggtacgtacgttaactttagttacgtgttacgtaggtagtttagagtactacgaaccctactaaagtttacggtagggtttacggtacggacgggaccggaactagcgtacgaccgtcgtaggtaccacgtacccgcgtccnccgtccccgtcgtcaccgtctcccgtcccgtccctcctntaccg

SEQ ID NO: 248862 - DNA, 828 bp, Homo sapiens
  misc_feature: GYAE6OF01ERNMT.40.34.D01.1.454.CMB.1.raw
  modified_base (149)..(149): a, c, t, g, unknown or other
  misc_feature (149)..(149): n is a, c, g, or t
tcagtctagcgactcacgaccggtgctcgatttagatcgtctgtgttgggtttgggaacctatgaacattctggtaggggccactgtcttctccactacttctccaccctcctcgctcactgcacgtaggttctcgggacctaattttncgctcgactcacgccctactcgtggtcggtccggggtccgtaccgggggaacgtaccggtaacctctcctccgtcgccaccgctaggtacggtcggcacgctagttcgaccagactaaacgttgtgtcgacgtaggtcggtacacgcgacggcccggcccggactacccgtccccaacttaactttactctagtaggaagtaaactaaaacaaacgtctcgtcggtcgggtcctggtacgttcgttctcgtcgtcctctactcgacgtctcctacctaccttacttcctccgtccctaccctacctacctcttccgtacgtacggtaactaacggaacgtacggtagggaacggggtacgagggttacttagttaacttttaacgttacgttacgtaacgtaaggtttaacgtttacgtaaggtaaccttaacaaaccgttaaccggtttaacgggttaacggggtttcggggttacggggttacccgggggaaccggggtaaaccggtaacccggtaacgggttcccggttaacccggtaacccgggttcgggttaaaccgggtacccgaacccggttaacccgggtaccggttccccgtaccccggttccccggttcgttaccttccccggtttcccgtacccccttacccccgtacccttccgtcccggtaaccgg

SEQ ID NO: 248863 - DNA, 631 bp, Homo sapiens
  misc_feature: GYAE6OF01CYZ2W.40.34.D01.1.454.CMB.1.raw
  modified_base (288)..(288): a, c, t, g, unknown or other
  misc_feature (288)..(288): n is a, c, g, or t
  modified_base (375)..(375): a, c, t, g, unknown or other
  misc_feature (375)..(375): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagcccccatctgtgtcggggtctccggggaagacggtaaccatctcctgccacccgcagtagtggcagcattgccagcaactgtgtgcagtcggaccagcagccgcccggctacgtcccccactactttaatctanacgaagactaaacaaaagactctcgtcgggtcctgacgtcggttctcgtcggcctccactcgacagtccctcctacctaactttccncgtccctcccctacacctactccttctacggtactacggaacgcgtaggacgggagtacggtctagtaatttacttactgtacgtagttacttatagtatacgaacctaacctaagtttccgggttggttcgggttcgggacgggtacgggactaacgcgtcggtaccgtccgtacggccacgacccgaaggtccctacccggtcccccgttcggtccctaccgttccctcccgttcccccaccttccgtcgtacg

SEQ ID NO: 248864 - DNA, 819 bp, Homo sapiens
  misc_feature: GYAE6OF01D4V6H.40.34.D01.1.454.CMB.1.raw
  modified_base (146)..(146): a, c, t, g, unknown or other
  misc_feature (146)..(146): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
tcagtctagcgactcacgaccggtgctcgatttagatcgtctgtgttgggtttgggaacctatgaacattctgtaggggccactgtcttctccactacttctcaccctcctcgctcactcgcacgaggttctgggcctaattttancgctcgactcacgcccactctgtcggtcggggtcgtccggggaagacggtaaccnctcctctcgccaccgcagtagnggcagctattcgaccagactaacttagtgtcgcgtaacggttacggtaaccaggcgacggcccggcccgggacctaacccgttacccccaaaccttaaaccttttaaactacgttaagtaggaaacggtaaaactaaaaaccgaaaaacggtccttcgttccggttccgggggtccctggtaccgtttccggtttcttccgtcggtcctaccgacgtaccgacgacgtccttacccttaacctaactttccgtcctccccttccctacctaacctactcctcgtacggtacgtaagaacgtacgtacggaacggacggtaggtcttagttaatttacttacgttcgtacgtagttagttagtacgtactacgtaacctaaacgttaagtttacgggttcgggggttacgggttaccgggggaacggggtaaccgggaaccgtaacgggtaccgtaccggttacccgttaccggtacggtcccgaaaccggacccggtaaccggtcccgttccccggtcccccgttcgggttaccccttacccggtttccccggttccccgtttccccccgttccccgtttcccgtaccggtacccg

SEQ ID NO: 248865 - DNA, 689 bp, Homo sapiens
  misc_feature: GYAE6OF01AZZO5.40.34.D01.1.454.CMB.1.raw
  modified_base (144)..(144): a, c, t, g, unknown or other
  misc_feature (144)..(144): n is a, c, g, or t
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttangctgactcacgccccactctgtgtcgggtctccggggaagacggtaaccatctcctgcacccgnagtagtggcagcattgccagcaactatgtgcagtggaccagcagcgcccggcacgttcccccacactttaanctatgaggataaacaaaagactctcgtcggggtccctggacttccggttctcgtcggcctccatccgacacgtcctaccctacctaattcctcgcccttcccctcaaccctattcctacgttaggaccttaggaacgtaccgttaggaacgggtacccgagggtcttagtaacttttaatttaccgtgttacaaggttaacgtttagagtactacgaacctactaaagttttccggtaggggttacggttacgggtaccggggaacggtaacctaagtccgtacggtacccgttaccggttaaggtaccaaccgggaccccgaagggtccctccccggtccccccgtttcgggacccttaacccgtcccgtttcccggttaccccccgtccccctccgttccgtaccgg

SEQ ID NO: 248866 - DNA, 256 bp, Homo sapiens
  misc_feature: GYAE6OF01AYIBP.40.34.D01.1.454.CMB.1.raw
  modified_base (235)..(256): a, c, t, g, unknown or other
  misc_feature (235)..(256): n is a, c, g, or t
tcagtctagcgactcacgaccggtgctcgatttagatcgtctgtgttgggtttggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctagactgagcgggctggcaaggcgcatagcnnnnnnnnnnnnnnnnnnnnnn

SEQ ID NO: 248867 - DNA, 696 bp, Homo sapiens
  misc_feature: GYAE6OF01C2OOA.40.34.D01.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (683)..(683): a, c, t, g, unknown or other
  misc_feature (683)..(683): n is a, c, g, or t
tcagtctagcgactcacgaccggtgctcgatttagatcgtctgtgttgggtttgggaacctatgaacattctgtaggggccactgtcttctcactacttctcaccctcctcgctcactgcacaggttcttgggcctaattttatgctgactcacgccccatctgtggtcggggtcgtccggggaagacggtaaccatctcctgccacccgcagtgnggcagcattcgccagactaactntgtgcaggtcgacagcagccgccggcaccgtccccaactactttaatctagtagaagaataaacaaacgtctctcggtccggtcctgtagttccggtctcgtcgtcctaccgtataccgacgactaccttccctacgtaactttccgtccgtacccctacctacccgacctacttccgtacgtacggtactaaggaacgtaccgttagggacggaacggtacgtcgtaagttaatttacttaccgtagtaccgtaagttagttaagtacacgtacctaaacctacgttaacggtttcgggttgggtaccgggttacggggtaccggggtacggaactacggttaccgtccggtaaccggttcctaacggtcgaacccggaccgtacgtcccgtccccgtaccccggttctaaccctccgttcccttacccgcccccgttacccncgttaacgtccgg

SEQ ID NO: 248868 - DNA, 763 bp, Homo sapiens
  misc_feature: GYAE6OF01AJTAS.40.34.D01.1.454.CMB.1.raw
  modified_base (284)..(284): a, c, t, g, unknown or other
  misc_feature (284)..(284): n is a, c, g, or t
  modified_base (372)..(372): a, c, t, g, unknown or other
  misc_feature (372)..(372): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagccgcccgggcacgttcccccactactttaanctatgaggaataaacaaagctctcgtcgggtccctgtactcggttctctggtcctccatccgacacgtccttccctactaactttccnccgtccccttcccctccacccgtacttcctacgttcggaacctaggaaacgtctaggaacgggtaccggaggtacctaggttaactttaactttaccgttaggttaccgtaaggttacgtttaacgtagttaagtaccgaaaccttaaccgttaaacgtttacgggtttcggggttacggggttaccgggacgggggtaaaccgggtaacccaaaggttccgtacccggtacccggtttaccggtacgggttaccccgaacccgggccccggtaaacgggtcccccgttacccccgggtccccccgtttaccggggttaccccttacccggtttcccccgtttacccccgggttcccccccttcccccgttacccgttcccgtaacccggg

SEQ ID NO: 248869 - DNA, 875 bp, Homo sapiens
  misc_feature: GYAE6OF01AFC5D.40.34.D01.1.454.CMB.1.raw
tcagtctagcgactcacgaccggtgctcgatttagatcgtctgtgttgggtttgggaacctatgaacattctggtaggggccactgtcttctccactacttctccaccctcctcgctcactgcacgtacggttcgttcgggacctaattttatcgctcgacctcgaccgccccactcgtcggtcggtccggggtccggtaccgggggaacgaccggtaaccacgtcctccgtcgccgacccgcgtaggtacgtcggcacgcagtcgccacgactaactagtcggtcgacgtacggtcggtaccgagccgaccggccgggcccgggacctacccggttaccccctaaccttaactttaactcgtaagtacgggaaacgtaaacttaaaaacgaaaacgtccgttaccggttccgggtccggggtttaccctagggttaccgtttccgggtttccgttacgtcgggtcccttaccgaacggtaccgaccgtacgttcccttacccgttaaccgttaacttcccgtccgtcccctacctaccaaccgtactccgtacgtacggtacgtaacggaacgtacgtacgggaacgggtacggtacggttacgttaacgtttaactttaacgtttacgtagttacggtaaagtttacgttaagtacggtaactaccggtaaaccctaacggtttaaacggtttacggggttcgggggttacggtaccgggggaacgggtaaccgggaactaccggttccgtaaccggttacccggttacggtacgtaccgaaccgggtacccggtaacggtcccgtccccggttaccccggttcgtaaccttcccgtttcccgtcccggttcccccaccgttccgtcgtaccg

SEQ ID NO: 248870 - DNA, 254 bp, Homo sapiens
  misc_feature: GYAE6OF01CPIH8.40.34.D01.1.454.CMB.1.raw
  modified_base (239)..(254): a, c, t, g, unknown or other
  misc_feature (239)..(254): n is a, c, g, or t
tcagtctagcgactcacgaccggtgctcgatttagatcgtctgtgttgggtttggggatgactactggggccagggaaccctggtcaccgtctcttcagcttccaccaagggcccatcggtcttcccctggcgccctgctccagggagcacctctgggggcacagcggccctgggctgcctggtcaaggactacttccagtcgctagactggagcgggctgggacaaggcgcaagtagnnnnnnnnnnnnnnnn

SEQ ID NO: 248871 - DNA, 676 bp, Homo sapiens
  misc_feature: GYAE6OF01AZZW4.40.34.D01.1.454.CMB.1.raw
  modified_base (184)..(184): a, c, t, g, unknown or other
  misc_feature (184)..(184): n is a, c, g, or t
  modified_base (283)..(283): a, c, t, g, unknown or other
  misc_feature (283)..(283): n is a, c, g, or t
  modified_base (349)..(349): a, c, t, g, unknown or other
  misc_feature (349)..(349): n is a, c, g, or t
tcagtctagcgactcacgaccggtgctcgatttagatcgtctgtgttgggtttgggaacctatgaacattctgtaggggccactgtcatctccactacttctcaccctcctcgctcactgcacaggttcttgggccaattttatgctgactcagccccactctgtgtcggggtctccggggaanacggtaaccatctcctgcacccgcagtagtggcagcattgccagcaactatgtgcaggtcggtaccagcagccgcccggcacgtccccactactttaanctatgagaataacaaaagctctcgtcggggtccctgtacttcggttctcgtcggcctccatcgacncgcctcctaccaattcctcgtccctccctcaccctattcctcgttcggactggaacgtacgtaggaacggtacggacggtccttaggttaacttttaacgttacgttcggtactaaggttagtttagtaggtactacggaacctaaccgtaacgttttcggtaggggttcggttacggggacgggtaacgggaaccctaaggtccgtaccgggtaacccgttccgtaacggtacccgaccggtacccgaacgggtccctccccggtccccccgttaccggtcctaccgttcccgttaccccggttccccctcccttcccgtacccgg

SEQ ID NO: 248872 - DNA, 651 bp, Homo sapiens
  misc_feature: GYAE6OF01CR1AW.40.34.D01.1.454.CMB.1.raw
  modified_base (136)..(136): a, c, t, g, unknown or other
  misc_feature (136)..(136): n is a, c, g, or t
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
  modified_base (432)..(432): a, c, t, g, unknown or other
  misc_feature (432)..(432): n is a, c, g, or t
  modified_base (519)..(519): a, c, t, g, unknown or other
  misc_feature (519)..(519): n is a, c, g, or t
  modified_base (619)..(619): a, c, t, g, unknown or other
  misc_feature (619)..(619): n is a, c, g, or t
tcagtctagcgactcacgaccggtgctcgatttagatcgtctgtgttgggtttggaacctatgaacattctgtagggccactgtctctccactacttctcacctcctcgctcactgcacaggttctggccaatttncgctgactcacgccccatctgtgtccgggtctccggggaataccggtaccagtcctaccgtgaccacccgntaggtagtggctagcctattcggaccagtcctaaactgtggnacctagtcggaccaggccaggccgtcccgggactaccgttcccccaactacttttaaacgccttagtagaagtaacaaactaaaacgtacctctacggtcggggtccctgaccgttccgttctcgtacggtcctcctaatcgaagcgtcctaccctaccaatttcggcctaacccttccctanacccagtccctggttacgacttagaagccgaggaacgtacggaccggtcaagttatttaccgttatacggtctagggtacttagtanacgtctacaaccgttatacgggttgtacggttcggacgggtacggaccaagttcgacaccgtacgtagacacgacccgagtcctacccgcccgtaccgcncgttcctacgtacccctccgtccctcgtaccg

SEQ ID NO: 248873 - DNA, 898 bp, Homo sapiens
  misc_feature: GYAE6OF01B8BB5.40.34.D01.1.454.CMB.1.raw
tcagtctagcgactcacgaccggtgctcgatttagatcgtctgtgttgggtttgggaacctatgaacattctgtagggccactgtcttctccactacttctccaccctcctcgctcactcgcacgtacggttcgttcgggaccttaaatttttatcggtccttcgacctccgaccgcccctacttcgttggtcgggttccgggggttccggtaccggggggaaacggtaaccgggttaaacctacttccgtccgtcggacccgacccggacgtaaggtacggtcggacacgtctagttcgaccaacgtacctaacttagtcgtcgacgtacggtacggtaccgacgacgacggcccgggcccggtacctacccgttaccccctaaccttaactttaactcgtaagtaggaaacggtaaactaaaacgaaacgtccgtcgttcggttccgggtcctaggtacgttcggttcgtcgtcgtcctacgactcgactcgtcctacctactacttcctcctccctaccctacctacctcttccgtacggtacggtaacgtaacggtaacgtacgggtacgggtaacgggtaacggtacgttacgtttagtttaacgtttaacgttacgttacgtaacggtaagtttaacgttacgtaacgttaacgtaaccgttaaccgttaaacgtttaacgggtttacgggttcgggggtttaaccgggtaccggggtaacggggtaaccgggtaacgtaacggttaccggtaccggtaccggttacggtaccggtacccggtaaccggtacccggtaccggtccccgggtaccccggttcccggttacccgttacccgttcccgtttaccccgttaccccgttacccctacccggttccgtaaccggtccg

SEQ ID NO: 248874 - DNA, 656 bp, Homo sapiens
  misc_feature: GYAE6OF01CM7CP.40.34.D01.1.454.CMB.1.raw
  modified_base (238)..(238): a, c, t, g, unknown or other
  misc_feature (238)..(238): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (342)..(342): a, c, t, g, unknown or other
  misc_feature (342)..(342): n is a, c, g, or t
  modified_base (461)..(461): a, c, t, g, unknown or other
  misc_feature (461)..(461): n is a, c, g, or t
  modified_base (478)..(478): a, c, t, g, unknown or other
  misc_feature (478)..(478): n is a, c, g, or t
  modified_base (621)..(621): a, c, t, g, unknown or other
  misc_feature (621)..(621): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggcctaattttatcgctgactcacgccccatctgtggtcgggtcgtaccggggaagaccggtaaccatctcctgccaccgcagtagtggcagcatcgcagacaatntgtgcagtgaccagcagcgccggnaccgtcccatacttaancatgaagaataaacaaagctacgcgtcggggtcctagacttcggttcctacgtcggtctaccngtaccgatacgtcctaccttactaacctttccgtcgtcccttaccctaccacttaactcctacgtagaccgtaagaacgtacgtagggacggagtacggacttagtaactttagttacnttacgtagtaacgtttnagtaactcgaacgtaattaacggttcgttaaggggtccggttaggaaccgggaatacgaacgtcccggttgacccgttaaacggtacggacaacccggtaacggacgttcccacccggtacccccgtttgaacccccgtttcnccgtttacccgttccccgccttccgtacggtaccg

SEQ ID NO: 248875 - DNA, 589 bp, Homo sapiens
  misc_feature: GYAE6OF01A01ME.40.34.D01.1.454.CMB.1.raw
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgnagtagtggcagcattgccagccaactatgtgcagtggaccngcagcgcccgggcacgtccccacactttatctatgagataaacaaagactctcgtgggtcctgattcggtctctggctcatcgacagcctcctcctaattctcnccctcccncacctactctctggaactagaacgacgtgaaggacggaggctagtaatttacttacgtgtacgagtaagttatgtatacgaactaactaagttacgttgggttggtacggtacgggacggacgtaagcgtacgccgtcgtaggtaccacggacccgtacggtccgtcccgtccccgtccgtacctaccgttcccgtacccgttcccctacccttcccgtcgtacccgg

SEQ ID NO: 248876 - DNA, 713 bp, Homo sapiens
  misc_feature: GYAE6OF01CCCAS.40.34.D01.1.454.CMB.1.raw
  modified_base (156)..(156): a, c, t, g, unknown or other
  misc_feature (156)..(156): n is a, c, g, or t
  modified_base (258)..(258): a, c, t, g, unknown or other
  misc_feature (258)..(258): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggcctaattttatgctgactcacnccccatctgtggtccggggtctccggggaagacggtaaccagtcctcctgccaccgcagtagtggcagcattgccagccaatatcgtagctagtggtaaccnggcagccggcccgggcaccggttcccccactactttaatctagtgaagaataaacaaaagtactcctcggtcgggtcctagacttccggttctctacggctaccagtcgaccagcccttacctcctaacttcgtccgacccttccccgtcacctacttccgtcgtcgtaaccttaggaaacggtcttagggaacggaacggacggtacgttacggtaacttttaagttaccgttagtaccgtaagtagtttaatggtaactacggaacctaacctaaacgtttacggttacggggtttaggtttaccggggaccgggaacggggaaccgtaacggtccgtaccggtacccgtaccggttacgtaccgaacccgccggtaaacggcgtacccgtaccccgtcgttaccctaacgttcccgttacccgttaccccgtacccctcccgtaccgtccgg

SEQ ID NO: 248877 - DNA, 822 bp, Homo sapiens
  misc_feature: GYAE6OF01E2XXU.40.34.D01.1.454.CMB.1.raw
  modified_base (429)..(429): a, c, t, g, unknown or other
  misc_feature (429)..(429): n is a, c, g, or t
tcagtctagcgactcacgaccggtgctcgatttagatcgtctgtgttgggtttgggaacctatgaacattctggtagggccactgtcttctccactacttctcaccctcctcgctcactgcacgtaggttcttcgggacctaattttatcgctgacctcacgccccactcgtggtcggtccgggggtccgtaccgggggaacgtaccggtaaccatcctcctgccacccgcgaggtacggtcggacagctagttcgaccacgacctaaacttagtcggtcgacgtaggtcggtaaccagcgacggcccggcccggacctacccgttacccccaaccttaactttaactcgtagtacggaagaaactaaaaccaaaacgtcctcgtcgtcgggtcctaggtcgttcggttctcgtcgcctacactcgacncgtcctaccgtacctacttccgtcctcccctccctaccacctactcctacgtacggtaactaggaacgtacgtacggaacggacgacggtacttagttaactttaacgttacgtgttacgtaagttagtttaagtacgtacgtacgtaaaccctaaccgttaacggtttacgggttcgggggtttaccgggttaccggggtaaccgggggtaaccgggtaaaccggtacggtacccggtacccggttaacccggttaccggtacggtacccggaacccgggtaacccggtaccgggtccccgtaccccggttcccccggttaccggttacccgttacccgtttaccccggttccccggttaccccccgttccccttcccggtcccggtaccgg

SEQ ID NO: 248878 - DNA, 249 bp, Homo sapiens
  misc_feature: GYAE6OF02GY972.40.34.D01.1.454.CMB.1.raw
  modified_base (230)..(249): a, c, t, g, unknown or other
  misc_feature (230)..(249): n is a, c, g, or t
tcagtctagcgactcacgaccggtgctcgatttagatcgtctgtgttggttgggatgactactgggccagggaaccctggtcaccgtctcttcagcttccaccaagggcccatcggtcttccccgtggcgccctgctccgaggagcacctctggggcacagcggccctgggctgcctggtcaaggactacttccagtcgctagactgagcgggctggcaaggcgcatagnnnnnnnnnnnnnnnnnnnn

SEQ ID NO: 248879 - DNA, 248 bp, Homo sapiens
  misc_feature: GYAE6OF02G4G2K.40.34.D01.1.454.CMB.1.raw
  modified_base (233)..(248): a, c, t, g, unknown or other
  misc_feature (233)..(248): n is a, c, g, or t
tcagtctagcgactcacgaccggtgctcgatttagatcgtctgtgttgggtttgggactgactactggggccagggaaccctggtcaccgtctcttcagcttccaccaagggcccatcggtcttcccctggcgccctgctccaggagcacctctgggggcacagcggccctgggctgcctggtcaaggactacttccagtcgctagactgagcgggctggcaaggcgcatagnnnnnnnnnnnnnnnn

SEQ ID NO: 248880 - DNA, 233 bp, Homo sapiens
  misc_feature: GYAE6OF02HSQJ2.40.34.D01.1.454.CMB.1.raw
  modified_base (232)..(233): a, c, t, g, unknown or other
  misc_feature (232)..(233): n is a, c, g, or t
tcagtctagcgactcacgaccggtgctcgatttagatcgtctgtgttgggtttgggatgactactggggccagggaaccctggtcaccgtctcttcagcttccaccaagggcccatcggtcttcccctggcgccctgctccaggagcacctctgggggcacagcggccctgggctgcctggtcaaggactacttccagtcgctagactgagcgggctggcaaggcgcatagnn

SEQ ID NO: 248881 - DNA, 529 bp, Homo sapiens
  misc_feature: GYAE6OF02JAPXL.40.34.D01.1.454.CMB.1.raw
  modified_base (524)..(524): a, c, t, g, unknown or other
  misc_feature (524)..(524): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgatttattactgtacagtagttatgatgacaccaattacgtgggtgttcggcggaggaccaagctgaccgtctaggtcacgcccgaaggcctcgccccctggtccactctcgttccccacccttccnctacg

SEQ ID NO: 248882 - DNA, 265 bp, Homo sapiens
  misc_feature: GYAE6OF02FF55H.40.34.D01.1.454.CMB.1.raw
  modified_base (235)..(265): a, c, t, g, unknown or other
  misc_feature (235)..(265): n is a, c, g, or t
tcagtctagcgactcacgaccggtgctcgatttagatcgtctgtgttgggtttggggatgactactggggccagggaaccctggtcaccgtctcttcagcttccaccaagggcccatccggtcttcccctggcgccctgctccaggagcacctctggggcacagcggccctgggctgcctggtccaaggactacttccacgtcgctagactgagcgggctggcaaggcgcatagnnnnnnnnnnnnnnnnnnnnnnnnnnnnnnn

SEQ ID NO: 248883 - DNA, 237 bp, Homo sapiens; identical to SEQ ID NO: 248852
  misc_feature: GYAE6OF02GNGRK.40.34.D01.1.454.CMB.1.raw
  modified_base (233)..(237): a, c, t, g, unknown or other
  misc_feature (233)..(237): n is a, c, g, or t

SEQ ID NO: 248884 - DNA, 237 bp, Homo sapiens
  misc_feature: GYAE6OF02HZNVX.40.34.D01.1.454.CMB.1.raw
  modified_base (234)..(237): a, c, t, g, unknown or other
  misc_feature (234)..(237): n is a, c, g, or t
tcagtctagcgactcacgaccggtgctcgatttagatcgtctgtgttgggtttggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctagactgagcgggctggcaaggcgcatagnnnn

SEQ ID NO: 248885 - DNA, 510 bp, Homo sapiens
  misc_feature: GYAE6OF02HFTW0.40.34.D01.1.454.CMB.1.raw
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagtctagcgactcacgaccggtgctcgatttagatcgtctgtgttgggtttgggaacctatgaacattctgtaggggccactgtcttctccactacttctcaccctcctcactcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattacgtgggtgttcggcggaggacaagctgaccgtcagtcagccgaagctcgcccctgcactctcgtcccnccctcnctcg

SEQ ID NO: 248886 - DNA, 535 bp, Homo sapiens
  misc_feature: GYAE6OF02G14BT.40.34.D01.1.454.CMB.1.raw
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (530)..(530): a, c, t, g, unknown or other
  misc_feature (530)..(530): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccacactttaatctatgaggataacaaaagactctcgtggggtccctgatcggttctctgctcatcgacagctcctcaattcngcctcccncaccatcctctcggactgaagactgacggacgaggctgatttatactgtacagtagttatgatgaacacctaagttcgtgggtcgttcgggcggtaggaccaagctacgaccgtctaggtcacgccgaaggcctcgcccctggtccacgttctccgttcccgcccttccnctacg

SEQ ID NO: 248887 - DNA, 566 bp, Homo sapiens
  misc_feature: GYAE6OF02IUAPE.40.34.D01.1.454.CMB.1.raw
  modified_base (261)..(261): a, c, t, g, unknown or other
  misc_feature (261)..(261): n is a, c, g, or t
  modified_base (356)..(356): a, c, t, g, unknown or other
  misc_feature (356)..(356): n is a, c, g, or t
  modified_base (424)..(424): a, c, t, g, unknown or other
  misc_feature (424)..(424): n is a, c, g, or t
tcagtctagcgactcacgaccggtgctcgatttagatcgtctgtgttgggtttgggaacctatgaacattctgtagggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggnagttcccccacacctttaatctatgaggataaacaaaagactctctggggtcccctgatcggttctctggctccatcgacagctcctccaattcngccctccctcaccatcctctggactgaagactggaggacgaggctgatttatactgtcagtaagttangatgacacctaattacgtgggttgttcgggcggaagggaccaaggctaggaccgtacctaggtccaacgcccgtaagggcctccggccccccgttggtacctaccgtccttccggttcccccgcccttcccgtaccgtacgg

SEQ ID NO: 248888 - DNA, 542 bp, Homo sapiens
  misc_feature: GYAE6OF02GDJGN.40.34.D01.1.454.CMB.1.raw
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
  modified_base (443)..(443): a, c, t, g, unknown or other
  misc_feature (443)..(443): n is a, c, g, or t
  modified_base (534)..(534): a, c, t, g, unknown or other
  misc_feature (534)..(534): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccacactttaanctatgaggataacaaaagctctcgtggggtccctgatcggttctctggctccatcgacagctccctcaattcngccctccctcaccatctctggactgaagctgaggacgaggctgattatactgtcagattangatgacacctaattctgggtgttcgggngaagggaccaagctgaccgtcgtaggtcagacccgaaggtcctcggaccccccttggacctaccgttcttcccggttccccaccccttccncgtaccgg

SEQ ID NO: 248889 - DNA, 596 bp, Homo sapiens
  misc_feature: GYAE6OF02HDPZ3.40.34.D01.1.454.CMB.1.raw
  modified_base (207)..(207): a, c, t, g, unknown or other
  misc_feature (207)..(207): n is a, c, g, or t
  modified_base (281)..(281): a, c, t, g, unknown or other
  misc_feature (281)..(281): n is a, c, g, or t
  modified_base (379)..(379): a, c, t, g, unknown or other
  misc_feature (379)..(379): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcgggtctccggggaagacggtaaccatctcctgcacccgnagtagtggcagcattgccagcaaactatgtgcaggtggtaccagcagcgcccggcacgttccccacactttaanctatgaggaataaacaaaagactctcgtcgggtccctgatcggttctcgtggctccatcgacagtcctcctccaacttctcgcccttccctcaacctnttcctcgttcggactagaagtactaggaggacgaggactgtaattattacgtgtacagtagtttatgtatacgaacaactaacttacgtgggttcgttcgggacggaacgggaaccgaagccgtcgtaaccgtcgtacgtacgacgacccgtaaggtcccgtccgtcccccgtcgtacctaccgttccgtccgttcccccgcccttccctccgtacg

SEQ ID NO: 248890 - DNA, 771 bp, Homo sapiens
  misc_feature: GYAE6OF02JY9X8.40.34.D01.1.454.CMB.1.raw
  modified_base (144)..(144): a, c, t, g, unknown or other
  misc_feature (144)..(144): n is a, c, g, or t
  modified_base (184)..(184): a, c, t, g, unknown or other
  misc_feature (184)..(184): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcgtggccaattttagngctagactcagccccatctgtgtcgggtctaccggggaancggtaaccatctctgcaccgnagtgngcagcattgccagcaaatgtgtgcagttggaccagcagcgcccggnacgttccccactactttaanctatgaggtanaaacgaaaatcctcgtacgtcggggtccctagtacgtccggtttctcgttagggaccttcccgattaccggactaaggttccctcccttacctaactttcggtccgtaccccttccccgttacaaacccttcttccgtacggtacggtacgtaacggaacgtaccgtagggaacggaacggtacgtacgttaagttaacgtttaacgttacgttaggtaacgtaaggttaacgtttacgtacgtaacgttaccgtaaaccttaaaccgtttaacgggtttacgggttacgggttacccgggttaccggggaaccgggtaaaccggtaaccgtaaaccggttccgtaacccggtaacccggttaccgtaaggtacccgtaaccggtacccggtaacgggttacccgtcccgggtacccccgttacggtaccctaccgtttcccgttaaccccgttacccctacccgtttaccgtaccggtaccgg

SEQ ID NO: 248891 - DNA, 638 bp, Homo sapiens
  misc_feature: GYAE6OF02IRAKH.40.34.D01.1.454.CMB.1.raw
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgccacccgcagtagtggcagcattgccagcaactatgtgcagtggtaccagcagcgcccggcacgtcccccacactttatctatgaggataacaaaagctctcgtggggtccctgactcggttctctggcctccatcgacacgctcctcctaatttcctcgtcccttccctccacctacttcctctaggactaggaacgacgtggacgggaacggaggcttagtaatttaacgtttacgttgtactaggtaagtttagtagatacggaactaacctaatttacgtggggttgttcggggacggtaacgggacctaagccgttacggacccgttccgtaggtaccgacgaccccgaaggtccctcccggtacccccgttcggtaccctaccgttccgttacccggtttcccccgtccccgtttacccgtccgtaaccgg

SEQ ID NO: 248892 - DNA, 604 bp, Homo sapiens
  misc_feature: GYAE6OF02I6QI6.40.34.D01.1.454.CMB.1.raw
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (371)..(371): a, c, t, g, unknown or other
  misc_feature (371)..(371): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggcctaattttatgctgactcagccccactctgtgtcggggtctccggggaagacggtaaccatctcctgcacccgcagtagtggcagcattgccagcaaactatgtgcagtggtaccagcaggccgcccggcacgttcccccactacttaanctatgagataaacaaanactctcgtgggcctagctcggttctcgtgctcatcgacngctcctactattctcgccctccctcaaccnctctcgtgactgaacgactggaacggacgacggtctaggtaatttactacttgtactaagtattacgtgtatacgaactaacctaagtttacggtgggttacggtccgggacgggaacgggaaccagtccgtacggtaccgtaccgtagtacccgtacggacccgaaggtccctaccggtcccccgttggtcccaccgtttccgtccgtaccccctcccttaccgtagtcccg

SEQ ID NO: 248893 - DNA, 570 bp, Homo sapiens
  misc_feature: GYAE6OF02HVMWS.40.34.D01.1.454.CMB.1.raw
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcacgttcccccaccactttaatctatgaggataacaaaagctactctggggtcctgatcggttctctgctccatcgacagctcctcctaattctcgccctccctcacctatctctgactgaagtactgaggacgaggctagtatttattactgtacagtagttatgatgaacacctaattacgtgggttgttcgggcgggtacggaccaagcgtacgacccgttcgtaggtcacggacccgaaggtccctccgtcccccgttcggtccacgttccgttcccgtttcccccaccccttcctccgtaccgg

SEQ ID NO: 248894 - DNA, 596 bp, Homo sapiens
  misc_feature: GYAE6OF02JXGEM.40.34.D01.1.454.CMB.1.raw
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagtctagcgactcacgaccggtgctcgatttagatcgtctgtgttgggtttgggaacctatgaacattctgtagggccactgtcttctccactacttctcacctcctcgctcactgcacaggttcttgggccaattttatgctgactcagccccactcctgtgtcggggtctccggggaagacggtaaccatctcctgcacccgcagtagtggcagcattgccagcaaactatgtgcagtggtaccagcagcgcccgggcagttcccccacactttaaatcctatgacggataaacaaaagactctctggggtccctgactcggtctctggctccagtcgaacagctcctaccaattctacgcctaccccncaacccnttccgtactcgggacctgaacgtaccngtaaggacgacgggctcggaatttactttaactcggttaccaagtagttaacgtgattcggaactaccgaaattccgtagggtgttcgggcgaggacccgaagcgtgaccgtcacggtacacggccaaggcctacggtccccctcgggtccacgttcctaccgttccccgacccttcctacccgtacgg

SEQ ID NO: 248895 - DNA, 746 bp, Homo sapiens
  misc_feature: GYAE6OF02HPC2Y.40.34.D01.1.454.CMB.1.raw
  modified_base (149)..(149): a, c, t, g, unknown or other
  misc_feature (149)..(149): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
tcagtctagcgactcacgaccggtgctcgatttagatcgtctgtgttgggtttgggaacctatgaacattctgtaggggccactgtcttctccactacttctcaccctcctcgctcactgccacgtacggttctcgggcctaattttcncgcctcgacctcaccgccccactctgtcggtccgggtctccggggaagaccggtaaccnctcctccgtcgccacccgcagtacgnggcagcattcgccagacaacttagtgcgcaggtcggtaccagcgacggccggcccgggctaccgttcccccaactactttaactctatgacggaataaaacaaacgctctcggtcgggtcctgtcttcggttctctcggcctccactcgacncgtcctcctacctaactttccnctaccctccccncgtacctcttctcgtcgactagacgtactacggacggaacgngtctagtactttactacgtggtactagttaagttagtgtaataccgaaactaccttaaaggttcgggttacggggttcggttaccggggacggggtaaaccgggaaccgtaacggcccgttacgggtaccccgttaacggtaccgggtaccgaacccggtacccggtaaaccgggtcccgttaccccggtacccccccggtttccggtaacccgttacccgtttccccgggtttacccccggtttcccccccgtaccccgttaccccgttacccggtaacccgg

SEQ ID NO: 248896 - DNA, 651 bp, Homo sapiens
  misc_feature: GYAE6OF02JR52C.40.34.D01.1.454.CMB.1.raw
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (450)..(450): a, c, t, g, unknown or other
  misc_feature (450)..(450): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcacgccccactctgtgtcgggtctccggggaagacggtaaccatctcctgcacccgcagtagnggcagcattgccagctaaactntgtgacagttggaccagcagcgcccgggtnacgttcccccacgtactttaatctatgaggataaaacaaaagctactcgtcgggtcccctgaattccggttcncgttgcctcgatcgacagcacctccaattcgngccctccctacnccgatcctcgacggtancgaagtcctagacgacgtaggcgtagtattattactggttccagtagttntaggtatcggaacacctaagttacggtacgggttacggtttccgggaccggtaaccgggaacctaaaggtccgttaacgaaccccggtttcgaaaccggtctaaccgggaccccgtaaagggtcctaccgggtccccctcgggtacccctaacggtcccttaaccccggttcccctaccccgtttaccgtcccttaaccgg

SEQ ID NO: 248897 - DNA, 617 bp, Homo sapiens
  misc_feature: GYAE6OF02HGKZ7.40.34.D01.1.454.CMB.1.raw
  modified_base (211)..(211): a, c, t, g, unknown or other
  misc_feature (211)..(211): n is a, c, g, or t
  modified_base (287)..(287): a, c, t, g, unknown or other
  misc_feature (287)..(287): n is a, c, g, or t
  modified_base (349)..(349): a, c, t, g, unknown or other
  misc_feature (349)..(349): n is a, c, g, or t
  modified_base (403)..(403): a, c, t, g, unknown or other
  misc_feature (403)..(403): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggcctaattttatgctgactcacgccccactctgtgtcggggtctccggggaagacggtaaccatctcctgccacccgnagtagtggcagcattgccagcaactatgtgcagtggtaccagcagccgcccgggcacgttcccccactactttaanctatgaggataaacaaaagactctcgtcggggtccctgatcggttctcgtgcctcatcgacngctcctctaattctcgccctccctaccacctatcctctggactaggaactacgnggaggacgagctagttattattacgtgtacagtagttagtgtagttcgaacctaacctaagtttacggttaggggttcgttacgggacgggaacggtaccgaacgtccgtacgacccgttcgtacgtacgacgacccggtaaggtccctacccggtcccccgtcggtaccctaccgtttccgtcccgttacccccacccttccgtccctaccgg

SEQ ID NO: 248898 - DNA, 673 bp, Homo sapiens
  misc_feature: GYAE6OF02JRTKY.40.34.D01.1.454.CMB.1.raw
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgccacccgcagtacgtggcagcattcgacagcaactntgtgcagtggtaccngccagccgcccgggcacgttcccccactactttacnctatgaagaataaacaaagtctctcgtcggggtacccngtacgttcggtctgtcggtctccngttacgacngtcctcctactattccgtctccctcccgtcaacgtctcctcgtcgtactgaacacgtcggaaggaaaccgggttaaccgtagttaatttacgttaacgtcggttaacgaagtttacgtttagtaggtactaaccgtaaccgtaacctaaggttttacggagggtttcgggccggggtaacgtaaccgggtaacagtccgttaccggacccgttacggtacgtaccgaaccggtacccggaagggtcccctccgaccccggtttcgaccgttacccgtccgtttccccgtccccgtacccgtttcgccgttaacg

SEQ ID NO: 248899 - DNA, 564 bp, Homo sapiens
  misc_feature: GYAE6OF02I47Y0.40.34.D01.1.454.CMB.1.raw
  modified_base (182)..(182): a, c, t, g, unknown or other
  misc_feature (182)..(182): n is a, c, g, or t
  modified_base (285)..(285): a, c, t, g, unknown or other
  misc_feature (285)..(285): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
  modified_base (557)..(557): a, c, t, g, unknown or other
  misc_feature (557)..(557): n is a, c, g, or t
tcagtctagcgactcacgaccggtgctcgatttagatcgtctgtgttgggtttgggaacctatgaacattctgtagggccactgtcttctccactacttctcaccctcctcgctcactgcacaggttcttgggccaattttatgctgactcagccccactctgtgtcggggtctccgggganacggtaaccatctcctgcacccgcagtagtggcagcattgccagcaactatgtgcagtggtaccagcagcgcccgggcacgttccccccacactttaatctangaggataacaaagctctctggggtccctgatcggtcctgtcgcttccgatccgancgctccactattcncgcctccctanaccatctcnggactgaancctggacgacgagctagattacttacgtntcgagtactttatgtatacgacctacctaatttacggtgggtcgttacgggcggaacggaccaaggccttacgaccgttcgacggttcacggcccaaggccctacggcccccgttggctactccgttgtcccccaccgttcccgntaaccgg

SEQ ID NO: 248900 - DNA, 638 bp, Homo sapiens
  misc_feature: GYAE6OF02H2Y4O.40.34.D01.1.454.CMB.1.raw
  modified_base (139)..(139): a, c, t, g, unknown or other
  misc_feature (139)..(139): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (578)..(578): a, c, t, g, unknown or other
  misc_feature (578)..(578): n is a, c, g, or t
tcagtctagcgactcacgaccggtgctcgatttagatcgtctgtgttgggtttggaacctatgaacattctgtagggccactgtcttctccactacttctcaccctcctcgctcactgcacagttctggccaattttangctgactcagccccatctgtgtcgggtctccggggaatacggtaaccatctcctgaccacccgcagtagtggcagcattgcctaggcaaactntgtcgcagtcggtaccngcagcgcccggnacgttccccactacttaatctangacggataaacaaagctatctacgggtccngtactcgttcctgtacgtcnccagttccganactccgttcccacgtaattccacgtcccttcccctcaccctagtctccgtaggtaccttaggaacgtacgtacgtaggaccgtaacggtctaggtaattacgttctagtccgaagtacttgtaagtatacgacctaacaagtttgacggttcggtacgggtaccgaacggtacgtacggtacttacgtacccggtaccttaggacctaccggtacccgtaagcccgttacccncccccgtttacgacctttccgaccgttcccgttaccccggtccttcccgtaaccgtccgg

SEQ ID NO: 248901 - DNA, 618 bp, Homo sapiens
  misc_feature: GYAE6OF02FOF72.40.34.D01.1.454.CMB.1.raw
  modified_base (372)..(372): a, c, t, g, unknown or other
  misc_feature (372)..(372): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattcgccagcaactatgtgcaggtcggtaccagcaggccgcccgggctacgttcccccaactactttaatctatgaggataaacaaaagctctcgtcgggtccctgactcggttctctcggctccatcgacacgtcctcctactacttctcncctccctcaccatcctcgtggactagacgacgtggaggacgaggtctgtaattattactggtactaggtagttatgactcgtaaactaccttaagttacggttgggttacggtaccgggacggggtaacggaacctagtccgtacggtaccgttaccgtaacgtcgaccgaccggtaacggccgttcccgtccccgttcgtcctaccgttccgttacccgttccccctacccgttccgccgtacgg

SEQ ID NO: 248902 - DNA, 645 bp, Homo sapiens
  misc_feature: GYAE6OF02IYLTX.40.34.D01.1.454.CMB.1.raw
  modified_base (145)..(145): a, c, t, g, unknown or other
  misc_feature (145)..(145): n is a, c, g, or t
  modified_base (209)..(209): a, c, t, g, unknown or other
  misc_feature (209)..(209): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaatttttangctgactcagccccactctgtgtcggggtctccggggaagacggtaaccatctcctgcacccgnagtagtggcagcattgccagcaactatgtgcagtggtaccagcagccggccggcaccgtccccactacttatctangagaanaaacaaatctcgtcgtcgggtcctgtactcgttctcgtgtctcatcgacncgcctacctacctacttctcctcctccctacacctactcctcgtacggacgtagaacgtacgtaggaacggacggacgtacgttagttaatttacgttacgtacgtacgtaaggttaagttagtagtacgtactaaacctaaccgttaaacgtttcggttacgggttcggttcgggaacgggaacgggactaacggtccgtaccgtaccgtaccgtacggtacgaccgaccgtaacggtcccgtacccgtccccgttaccgtacctaccgttccgttccccgtcccgtccccgtacctcgtccg

SEQ ID NO: 248903 - DNA, 603 bp, Homo sapiens
  misc_feature: GYAE6OF02IHE98.40.34.D01.1.454.CMB.1.raw
  modified_base (145)..(145): a, c, t, g, unknown or other
  misc_feature (145)..(145): n is a, c, g, or t
  modified_base (239)..(239): a, c, t, g, unknown or other
  misc_feature (239)..(239): n is a, c, g, or t
  modified_base (292)..(292): a, c, t, g, unknown or other
  misc_feature (292)..(292): n is a, c, g, or t
  modified_base (367)..(367): a, c, t, g, unknown or other
  misc_feature (367)..(367): n is a, c, g, or t
  modified_base (442)..(442): a, c, t, g, unknown or other
  misc_feature (442)..(442): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaatttttangctgactcagccccatctgtggtcgggtctccggggaagtacggtaaccatctcctgccacccgcagtagtggcagctattgccagaccaactntgtgcagtggtaccagcacgccggcccggctaccgtccccactacttatctgngagaataaacaaagctctcggtcgggtcctgtcgtcgttctcgtcgcctcatacgacacgtctcctactacttcncctccctcctcacctctctcgtcgacgtagaacgacgtaggacggacgtacggtaccccgtatattacttacgtntcgtagtagttagtagtactacactactacgttaggttcggttacggtcggacggacggacgtacgtacgtacgtaccgttaccgtacgtcgaccggaccgaccggtccgtcccgtcccgtccgtacgtccgttccgttccgtcccgtccctccgtcgtcg

SEQ ID NO: 248904 - DNA, 742 bp, Homo sapiens
  misc_feature: GYAE6OF02G2TRK.40.34.D01.1.454.CMB.1.raw
  modified_base (145)..(145): a, c, t, g, unknown or other
  misc_feature (145)..(145): n is a, c, g, or t
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggcctaattttangctgactcacgccccactctgtgtcggggtctccggggaagacggtaaccatcctcctgccacccgcagtagtggcagcattcgccagccaactntggtcacaggttcggtaccagccacggcccggacccgggctacccgttccccccacttactttaactntatcggaaggtactaaaacaaacgtactccgttacgtccggggttaccctggtaccttcggtttctactcggcccttaccgtactaccgacctacgtcccttaccctacctaactttccgtccgtcccctttacccaccgtaaccctactttcctacggtacgtaactacgggaaagcgtaggaacgggcgtaggcctagttacttagtttccgtagtaccgtagttacgttagtacgtagttacgaaaccctaaccttaacgttcgggtgggtttaccggcgggtaggtaaccggaacctaacgtcccgtacggttaaccgtccggtaccggtaccgaccgtaacccggcgttaccccgtcccggtaccccggttaccgtccgtaccctttccggttaccccgtcccccgttcccgttcccgtacgtacccgg

SEQ ID NO: 248905 - DNA, 752 bp, Homo sapiens
  misc_feature: GYAE6OF02JRK6Q.40.34.D01.1.454.CMB.1.raw
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
tcagtctagcgactcacgaccggtgctcgatttagatcgtctgtgttgggtttgggaacctatgaacattctgtaggggccactgtcttctccactacttctcacctcctcgctcactgcactacggttcttcgggcctaattttatgctgactcacgccctactctgtcggtcgggtctcggggaagacggtaacntctctgccaccgcagtgtggcngacattcgaccagacctaactatggtacgctacggttacggaaccaggccaaggccgcccggggtacaccgttacccccaacctaacttttaaactcctaagtacggaacggtaactaaaaccgtaaaacgtacctaccgtcggttacggggtcccttacggtattccggttctcggtcggtactccgacgtacgactacgtcctacctacctaaacttttccgccgtacctcccctacctacctaccttcgcccttagggactaacggaacgtacgtacggtacgggaaaccgtcgggtaactacggttaaacgttagtttacgttacggtaactacggttaacgttagtaggaacctttagaaccttaacctaaggttacgttacggggtacggtacgggtaccggggtaacggaaccgtacggtaccgtaccggttaccgtaccggttacgacgtaccggaccgtaacgtcccgtccccaccggttccgtaccctattcccggttcccgtacctccccgtctccgtaacg

SEQ ID NO: 248906 - DNA, 789 bp, Homo sapiens
  misc_feature: GYAE6OF02J19ZB.40.34.D01.1.454.CMB.1.raw
  modified_base (146)..(146): a, c, t, g, unknown or other
  misc_feature (146)..(146): n is a, c, g, or t
  modified_base (385)..(385): a, c, t, g, unknown or other
  misc_feature (385)..(385): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
  modified_base (515)..(515): a, c, t, g, unknown or other
  misc_feature (515)..(515): n is a, c, g, or t
  modified_base (546)..(546): a, c, t, g, unknown or other
  misc_feature (546)..(546): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
  modified_base (612)..(612): a, c, t, g, unknown or other
  misc_feature (612)..(612): n is a, c, g, or t
  modified_base (709)..(709): a, c, t, g, unknown or other
  misc_feature (709)..(709): n is a, c, g, or t
  modified_base (720)..(720): a, c, t, g, unknown or other
  misc_feature (720)..(720): n is a, c, g, or t
  modified_base (730)..(730): a, c, t, g, unknown or other
  misc_feature (730)..(730): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttcgggccaatttttangctgactcacgccccactctgtggtcggggtcctccgggggaaagtacgggtaaacctgttcctcccgtggaccaccccggactacgggttacggtggacctaacggccgtaaggtttcgacccgaggaacccgtaaactttgttacggtgaccggaaggttttccgggacccaagggctaaccggggcccggaccccgggggactacccggttcccccccaaccgttaacttttaacnccgtttaagcgaacgggaaacttaaaacaaaaacggtcttccgtacggtccggggttaccccaggtactttccggggttctacgtttggacttccggaanaccgtnaacgtccctcccttaacaactttntccgcccctttaccgactaacctctcggttnaaccggntacggtaanacgtggacggagtacggacttagtactttaacgttctgtacgtaaaggtntttcggaattacaacgtacctaacgtaatttaggtacggggttcgttccgggaccgggttaagacctaagccgtactacgggtcgttacgaaccggngttacccggancccggttccncccccgttaggtaccccttagtccccgtaacccggtcccctaccgtccgtcccgtacgg

SEQ ID NO: 248907 - DNA, 701 bp, Homo sapiens
  misc_feature: GYAE6OF02FFZSF.40.34.D01.1.454.CMB.1.raw
  modified_base (362)..(362): a, c, t, g, unknown or other
  misc_feature (362)..(362): n is a, c, g, or t
  modified_base (397)..(397): a, c, t, g, unknown or other
  misc_feature (397)..(397): n is a, c, g, or t
  modified_base (440)..(440): a, c, t, g, unknown or other
  misc_feature (440)..(440): n is a, c, g, or t
  modified_base (471)..(471): a, c, t, g, unknown or other
  misc_feature (471)..(471): n is a, c, g, or t
tcagtctagcgactcacgaccggtgctcgatttagatcgtctgtgttgggtttgggaacctatgaacattctgtagggccactgtcttctccactacttctcaccctcctcgctcactgcacaggttcttgggcctaattttatgctgactcagccccactctgtgtcgggtctccggggaagaccggtaaccatcctcctgcacccgcagtagtggcagcattcgccagcaactatgtgctagtcggtacccagccaggccgcccggcaccgttcccccacacttttaactctagtgagataacaaacgctctcgtcgggtccctgtacgtccgttctaccgtggcctccacgttcgaacncgtcctccctactactttccgcgtcccttaccccnctacctactccttcgtcggactagaacgtcgtaggacggacgngtctagtatttactactgtacaagttattangtactacgaacctactaacggtttacggtgggttcggttaccggggacgggtaaccgggtacctaacgggtaccgttaaccggtacccgtttacccgggtaaggttacccgaaccggtaccccggtaaacggttccctaccccgggttaccccccgtacggttacccctaccgttaccccggtttaccccggttacccccgtcccccgttaccttaccccggttaaccgg

SEQ ID NO: 248908 - DNA, 611 bp, Homo sapiens
  misc_feature: GYAE6OF02I155S.40.34.D01.1.454.CMB.1.raw
  modified_base (142)..(142): a, c, t, g, unknown or other
  misc_feature (142)..(142): n is a, c, g, or t
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
tcagtctagcgactcacgaccggtgctcgatttagatcgtctgtgttgggtttgggaacctatgaacattctgtagggccactgtcttctccactacttctcaccctcctcgctcactgcacaggttcttggccaattttangctgactcagccccatctgtgtcgggtctcgggaagcgtacntctctgcaccgnagtgtgcagcattgccagcaactntgtncagtggtaccagcagcgccggcacgttccccactactttanctatgagataacaaagtctctcgtcggtacctgactcgttctcgtcgctccatcgacagtcctccgtcaagttctcgtccctcctacacctactctctacgggtaacttcggaaacgtcgtacggaacggtaacgagtacgttagtaatttacgttaacgtacgttacgagttacgttaagttcgaagttacgtaacccgtaactagttacgttagggttcgttaccgggtacgggaacgtacccgaagttcgtacgtacccgtacgtacgtcgaaccgtaccggaacgtcctccgtaacccctcggtcctactcgttcccgttcccaacccgttcctacgtaccg

SEQ ID NO: 248909 - DNA, 617 bp, Homo sapiens
  misc_feature: GYAE6OF02JZBIA.40.34.D01.1.454.CMB.1.raw
  modified_base (195)..(195): a, c, t, g, unknown or other
  misc_feature (195)..(195): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (421)..(421): a, c, t, g, unknown or other
  misc_feature (421)..(421): n is a, c, g, or t
  modified_base (521)..(521): a, c, t, g, unknown or other
  misc_feature (521)..(521): n is a, c, g, or t
  modified_base (587)..(587): a, c, t, g, unknown or other
  misc_feature (587)..(587): n is a, c, g, or t
tcagtctagcgactcacgaccggtgctcgatttagatcgtctgtgttgggtttgggaacctatgaacattctgtagggccactgtcttctccactacttctcaccctcctcgctcactgcacaggttctgggcctaattttatgctgactcacgccccatctgtggtccgggtctccggggaagaccggtaaccntctcctgccacccgnagtagnggcagcattgccngcaactntgtgcagtcggaccagcctgccggccggtnacgttcccccaactactttaancgtataggacggtataaactaaaagctcgcgtcgggtacctgctcggttcnctagctccagtccganacgtcctcctacctagtttcgctcctacccctcactgtctctgggtactagaactgtagacggacnggtactaggtattaactttctacgacgtaaagttgttagtagacgttcaaacgtcctagtttaacggtggttacggttaccggaggggaacgaccgtaancgtaaccgccgtttgaccgtcacgcccggtaacggccctccgtaccccggttatccgatttccccnctttaccccccggctttccgccgtaaccgg

SEQ ID NO: 248910 - DNA, 666 bp, Homo sapiens
  misc_feature: GYAE6OF02ITD4N.40.34.D01.1.454.CMB.1.raw
  modified_base (145)..(145): a, c, t, g, unknown or other
  misc_feature (145)..(145): n is a, c, g, or t
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (273)..(273): a, c, t, g, unknown or other
  misc_feature (273)..(273): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggcctaattttangctgactcagcccatctgtgtcgggtctcggganacgtaacntctctgcgaccgnagtagtgcagcattgccagcaaactatgtgacaggtcggtaaccagcagccgccggcacgtccccactattanctatgagactaaacgaaagtctctcgtcgggtcctgtacgtccggttctcgtgtctccgatcgacacgtcctacctcctaattccgacgcccttcctacgacctattctctacggaactcgaactacgtaggaggaacgaggtacttagtaacgtttacttacgttcgtagtaaagtaacgtttatacggtacttacgaacctaaccgtaaacgtttacgggttgggttaacggttccggggacgggtaaccgggtaacctaagtccgttacggtacccgtaccgttacgaccgaaccgtacccggaagggtacccttcccgggtaacccccgttacggtaccttaaccgttccgttaccccgttaacccccacccgttccgtacgtacccgg

SEQ ID NO: 248911 - DNA, 790 bp, Homo sapiens
  misc_feature: GYAE6OF02FNP5C.40.34.D01.1.454.CMB.1.raw
  modified_base (144)..(144): a, c, t, g, unknown or other
  misc_feature (144)..(144): n is a, c, g, or t
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
tcagtctagcgactcacgaccggtgctcgatttagatcgtctgtgttgggtttgggaacctatgaacattctgtaggggccactgtcttctccactacttctcaccctcctcgctcactgcactaggttctgggcctaattttncgctgtactcagccccattctgtggtcgggtctcggggaataccggtaccntctctgcgacccgnaggtacgtcggcagctagttcggaccagtccaaacgtcgtaggtcgacgtaaggttcggaacccaggcacgccggtcccgggactaaccggtttccccccgaactaactttaatcctaagtcgtaagtaactaaaacaaaaggtccgtcgtaccgtcgggtcccctaggtacgttacggtttctaccgtcggcctccgacgttacacgtcggtaccctaccctacgtaaccttttcggtacctccccgttccccttacctaaaccctgtttaccctcggtaccggtaacgtttaaccgggaacctaaccgggttacggaacgggtaccggtaacgggtcgtttaacgggttaattttaacggttaccgttacggtaaccggtaagttacgttagtttacgacgttacgaaccgtaaacccttaggtttaacggtggggttacggttgggaacggacggaacgtgacctacgtaccgtacacggtccgacggacccgttaggcccgttacccggaccgttcccggtaaccgttacctacccggtttccccgtcccgtaccccgttacctccgggtaacccgg

SEQ ID NO: 248912 - DNA, 718 bp, Homo sapiens
  misc_feature: GYAE6OF02GBJ3Z.40.34.D01.1.454.CMB.1.raw
  modified_base (186)..(186): a, c, t, g, unknown or other
  misc_feature (186)..(186): n is a, c, g, or t
  modified_base (208)..(208): a, c, t, g, unknown or other
  misc_feature (208)..(208): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttactgctgactcagccccactctgtgtccggggtctccggggaancggtaaccatctcctgcaccgnagtagtcgcagcattcgccagctaactatgtagctaggtcggtaccagtcacgccggacccgggtcaccggttcccccaacttaactttaactctagtggaagtaactaaacgaaaacgtacttcgtacggttcgggtccctagtacgtccggttttcnccggttcggacctctactaccggaaccncgtccctcccttaacctaatttccnccgtccctcccgtacaccgtatcctggtacgacgtacgaacgtacgtaggaacggtacggaggtcctaggttaacttacttaggtcgacgtaagttacttaagtctaacgtacgaaccctaaacgttaacgttcggtttacgggtcggtaccggggaggaaaccgggtactaacgtcaccgggttaccttaccgggagttacccgacggaccccggtaaaggccccttaccccgggtcccgttacgtacccttaccggttcccttaccccgtacccctcccgttacctaccgtaccgg

SEQ ID NO: 248913 - DNA, 805 bp, Homo sapiens
  misc_feature: GYAE6OF02IMQ5Y.40.34.D01.1.454.CMB.1.raw
tcagtctagcgactcacgaccggtgctcgatttagatcgtctgtgttgggtttgggaacctatgaacatttctgtaggggccactgtcttctccactacttctcaccctcctcgctcactgcacaggttcttgggcctaatttttatgtctgactcacgccccactctgtggtcgggtcgtccgggaagacgaaccatctctgcaccgcagtagtgcagctattgccagacaactagtcgtgacgtagtacgtacgagcgacggccggcccgggacctccgttacccccaaccgttaactttaacttacgtacgtaggaacggtaaactaaacgaaaacgtacctcgttaccggttccggggttaccgtaggtacgtttccggtttccgttcgtcggtccgttacctacgtaccgacgtaccgtaccttacccttaccttactttcctccgttccccttcccctacctaaccctacttaccgtacgttacggacgttaacggaacgtaacgtacggggacgggaacggtaacggtcgtttaagttaacgtttaacgttaggtacgtaacgttaagttagttaacgtgtaacgttaccgaaccttaaaccggtacgtttcgggttcggggttacggttaccgggagggtaccggtaacgtacttccgggttaaccgtaccgggttacgtacgtaccgggtaacccgacccgggtaaccgcccgttacccgggtccccggttaccgtacccgttcccgttcccgtttccccggttcccccttacccgttcccgtaacggttacccgg

SEQ ID NO: 248914 - DNA, 774 bp, Homo sapiens
  misc_feature: GYAE6OF02JCFK0.40.34.D01.1.454.CMB.1.raw
  modified_base (243)..(243): a, c, t, g, unknown or other
  misc_feature (243)..(243): n is a, c, g, or t
  modified_base (695)..(695): a, c, t, g, unknown or other
  misc_feature (695)..(695): n is a, c, g, or t
tcagtctagcgactcacgaccggtgctcgatttagatcgtctgtgttggggtttgggaacctatgaacattctgtaggggccactgtcttctccactacttctcaccctcctcgctcactgcacaggttcttggcctaattttatgctgactcacgcccctactctgtcggtcgggtccgtaccggggaagaaccggtaaccatctcctgccacccgcgagtaggtggacagctactcgaccngaaaccgtatacgtgtcgagtaggtaccgtacgaccaagtcgaccgggtccgacggtcccctaccgtaacccgttaacttcgttaaactacgacggtagtaaacgtaaaaacgtaaacctaacgtccgtacgggttacccggtcggtaccgtacggtttaaccgttcgttacggtccgtacgtacctaccgtaaccgacgtccttacctccctaacgttacctcgtaccctccgtaccctaccactacctctaccggtacgtacgtaacgtaccgtaggacgggtaagaacgggtccttaaggaactttaggttaaccttaggtccgtaagtagttaaagtccgttagcggtaaccctaataccggtttaacggtaggttcggtcgtaacgggtaccggaacgttaacgacgtcgtaccgtaccggttagtacctacggccctaaccggggntcccggtaaccccggtaccgttccggtaaacctcggttacccttaccccgtcccgaccctttacccggtatacccgggg

SEQ ID NO: 248915 - DNA, 677 bp, Homo sapiens
  misc_feature: GYAE6OF02F8LQM.40.34.D01.1.454.CMB.1.raw
  modified_base (184)..(184): a, c, t, g, unknown or other
  misc_feature (184)..(184): n is a, c, g, or t
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (263)..(263): a, c, t, g, unknown or other
  misc_feature (263)..(263): n is a, c, g, or t
  modified_base (512)..(512): a, c, t, g, unknown or other
  misc_feature (512)..(512): n is a, c, g, or t
tcagtctagcgactcacgaccggtgctcgatttagatcgtctgtgttgggtttgggaacctatgaacattctgtaggggccactgtcttctccactacttctcaccctcctcgctcactgcacaggttcttgggccaattttatgctgactcagtccccatctgtgtcggggtctccggggaanacggtaaccatctcctgcacccgnagtagtggacagctattcgccagacctaaactntggtgactacggtggtaacccngcgacgccggtcccgggactacgttccccccaactaacttttaatcctatcggaaggtaactaaaacgaaaacgtactcgtcggtcggggtacccctgtacgttcggttctcgtcggtcctccatcgactacgccttcctactattcctcgtccctccctcacctatccgtcgtaggaccttagaacgtacgtacggacgggtaccggtaaggtctagttaactttattacgtagtactaagtagttanagtactacgaactacctaagttcggttcgggtacggttcggacgggtaacgaccgtagtcctacggtaccgttaccgtagtaccgacggccctaagggtccctccggtaccccgtggtacctacccttccgttacccggttcccctcccgttaccgtcgtaccgg

SEQ ID NO: 248916 - DNA, 596 bp, Homo sapiens
  misc_feature: GYAE6OF02HA9J7.40.34.D01.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (460)..(460): a, c, t, g, unknown or other
  misc_feature (460)..(460): n is a, c, g, or t
  modified_base (515)..(515): a, c, t, g, unknown or other
  misc_feature (515)..(515): n is a, c, g, or t
tcagtctagcgactcacgaccggtgctcgatttagatcgtctgtgttgggtttgggaacctatgaacattctgtaggggccacttgtcttctccactacttctcaccctcctcgctcactgcacaggttcttgggcctaattttatgctgacctcacgccccactctgtggtcgggtctccggggaagacggtaaccntctctgcacccgnagtgtgcagcatgccagcaatntgngctagtggtaccngcagcgcccggcacgttcccccactacttatctagngaaggataaacaaaacgtctcctcggtcgggtccctggtacttcgttctcgtgcctcgctcgaacnctctccacctattctccnccctaccctcacctgtcctcgtacggtactagaactacgtaggacggacgaggtctattactttaatctgtacctaggtattagtgactanaacctactagttcggtgggttacgtcggagggtacgaacagtctccgtacgtacncgtaccacggacccgtacggcccttacccgtccccgtacggtcctaccgttcctcccgttaccccctcttacccgctaccg

SEQ ID NO: 248917 - DNA, 455 bp, Homo sapiens
  misc_feature: GYAE6OF01ESERK.33.55.E11.1.454.CMB.1.raw
  modified_base (439)..(439): a, c, t, g, unknown or other
  misc_feature (439)..(439): n is a, c, g, or t
  modified_base (444)..(455): a, c, t, g, unknown or other
  misc_feature (444)..(455): n is a, c, g, or t
tcagtacacacactcacgaccggtgctcgatttagcactcgcacgttgggtttgggagggtgtcccaggacttgagacagaccgccacaatcacctgcactggggacagcgacaatgttggctacgaaggagcactttggctgcagcgactccagggccaccctcccaaactcctttcctacagggagaacaaccggccctcagggatcccagagaggttttctgcatccaggtcaggcaacacagcctccctgaccatcactggactccggcctgaggacgaggctgagtatttctgcttagcatgggacaggaacctcattgcttgggtgttcggcggagggaccaagctgaccgtctaggtcagcccaaggctcgccccctggtcactctcgttcccgccctcctcagtgtgtgtactgagcgggctggcaggcgnatagnnnnnnnnnnnn

SEQ ID NO: 248918 - DNA, 442 bp, Homo sapiens
  misc_feature: GYAE6OF01BH889.33.55.E11.1.454.CMB.1.raw
  modified_base (372)..(372): a, c, t, g, unknown or other
  misc_feature (372)..(372): n is a, c, g, or t
  modified_base (428)..(428): a, c, t, g, unknown or other
  misc_feature (428)..(428): n is a, c, g, or t
  modified_base (434)..(442): a, c, t, g, unknown or other
  misc_feature (434)..(442): n is a, c, g, or t
tcagtacacacactcacgaccggtgctcgatttagcactcgcacgttgggtttgggagggtgtcccaggacttgagacagaccgccacaatcacctgcactggggacagcgacaatgttggctacgaaggagcactttggctgcagcgactccagggccaccctcccaaactcctttcctacagggagaacaaccggccctcagggatcccagagaggttttctgcatccaggtcaggcaacacagcctccctgaccatcactggactccggcctgaggacgaggctgagtatttctgcttagcatgggacaggaacctcattgcgttgggtgttcggcggaggaccaagctgaccgtctagcagccaggcncgccctgcactctcgtcccaccctctcagtgtgtgtactgacgcggctggcaggcncatagnnnnnnnnn

SEQ ID NO: 248919 - DNA, 485 bp, Homo sapiens
  misc_feature: GYAE6OF01DZYQD.33.55.E11.1.454.CMB.1.raw
  modified_base (222)..(222): a, c, t, g, unknown or other
  misc_feature (222)..(222): n is a, c, g, or t
  modified_base (468)..(468): a, c, t, g, unknown or other
  misc_feature (468)..(468): n is a, c, g, or t
  modified_base (473)..(485): a, c, t, g, unknown or other
  misc_feature (473)..(485): n is a, c, g, or t
tcagtacacacactcacgaccggtgctcgatttagcactcgcacgttgggtttgggagggtgtcccaggacttgagacagaccgccacaatcacctgcactggggacagcgacaatgttggctacgaaggagcactttggctgcagcgactccagggccaccctcccaaactccttcctacagggagaacaaccggccctcagggatcccagagaggtttcngcatccaggtcaggcaacacagcctccctgaccatcactggactccgcctgaggacgaggctgacgtattctgtcttagcatcgggacaggaacctcagttgacgtttgggtacgttcggcgggacgggaccgaaagtcctgaaccgttccgtaggtccaaggcccaaggcctcgcccccgtggtcactccgtcttcccgaccctcctcacgtcgttgtgtactgacggcggctggacaggccganatagnnnnnnnnnnnnn

SEQ ID NO: 248920 - DNA, 515 bp, Homo sapiens
  misc_feature: GYAE6OF01EU681.33.55.E11.1.454.CMB.1.raw
  modified_base (491)..(515): a, c, t, g, unknown or other
  misc_feature (491)..(515): n is a, c, g, or t
tcagtacacacactcacgaccggtgctcgatttagcactcgcacgttgggtttgggagggtgtcccaggacttgagacagaccgccacaatcacctgcactggggacagcgacaatgttggctacgaaggagcactttggctgcagcgactccagggccaccctcccaaactcctttcctacagggagaacaaccggccctcagggatcccagagtaggtttctgcatccaggtcaggcaacacacgcctcctgaccatcacgtggactccggcctgaggcgaggctgagtatttctgtcttagcagtggggaacaggtaacctctagttgcttggggtgttcgggcggagggaccaagcgtgaccgtcgtagtcagcccaaggctcgccccgtggtccacgtcgtcgttccccgccctctacgtagttgtacgttacgtacgcggtacggtccgggtcgtcggacgaacggccgagtacgtagcgatcgnnnnnnnnnnnnnnnnnnnnnnnnn

SEQ ID NO: 248921 - DNA, 627 bp, Homo sapiens
  misc_feature: GYAE6OF01AQNY0.33.55.E11.1.454.CMB.1.raw
  modified_base (595)..(595): a, c, t, g, unknown or other
  misc_feature (595)..(595): n is a, c, g, or t
  modified_base (599)..(600): a, c, t, g, unknown or other
  misc_feature (599)..(600): n is a, c, g, or t
  modified_base (602)..(605): a, c, t, g, unknown or other
  misc_feature (602)..(605): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(627): a, c, t, g, unknown or other
  misc_feature (614)..(627): n is a, c, g, or t
tcagtacacacactcacgaccggtgctcgatttagcactcgcacgttgggtttgggagggtgtcccaggacttgagacagaccgccacaatcacctgcactggggacagcgacaatgttggctacgaaggagcactttggctgcagcgactccagggccaccctcccaaactcctttcctacagggagaacaaccggccctcagggactcccagagtaggttttctgcatccaggtcaggcaacacacgcctccctgaccatcactcggactccggcctggacggacgaggctgagttatttctgtccttagctagtcgggacgaacggtaacctcgtagttcggtcgtttggggttcggtttcggggacgggtacggggaaccgaaggccgtacggtacccggttccgttagggtacctaacggtacccgaaacggtcccgtacccggtccccccgttcggtccaccgtttccgtacccgtttcccccaccccgttccgtcgtacggttcgttcgttacggtacgttcggaccgggtccggggtccgttacggggcccgtaacgggtacccgtacgtaacgttagcgctgacgngtgnngnnnngcngngngnnnnnnnnnnnnnn

SEQ ID NO: 248922 - DNA, 676 bp, Homo sapiens
  misc_feature: GYAE6OF01CCE2C.33.55.E11.1.454.CMB.1.raw
  modified_base (630)..(630): a, c, t, g, unknown or other
  misc_feature (630)..(630): n is a, c, g, or t
  modified_base (651)..(653): a, c, t, g, unknown or other
  misc_feature (651)..(653): n is a, c, g, or t
  modified_base (655)..(655): a, c, t, g, unknown or other
  misc_feature (655)..(655): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (662)..(666): a, c, t, g, unknown or other
  misc_feature (662)..(666): n is a, c, g, or t
  modified_base (668)..(672): a, c, t, g, unknown or other
  misc_feature (668)..(672): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
tcagtacacacactcacgaccggtgctcgatttagcactcgcacgttgggtttgggagggtgtcccaggacttgagacagaccgccacaatcacctgcacgtggggacagcgacaatgttggctacgaaggagctactttggctgcagcgactccgagggcccaacccctacccaaaccttcccttttacctaacgagggacgaaaccgaacccggccctacgagggacctcccgaaggtaggttacggttttctcgactactccgtaggtacacggaccaacacgaccgtcccttacccgtacgacctactaccacgtaccggtaccgtccggccgtaggaacggacgtagcgtagtacttactttcgagtcttagcgtaggtacggacgacggtactgtacgtttggtcgttagggtcggttaccggacgggtaacgacgtacggtccgtacggtaccgttacgtacggccgaaccgaccgtacggtcccgtcccgtacccgtctaccgtaccttcccttacccggtacccctaccgttaccgtacgttcgttggttacgttacggtcgtacgggtaccggcgggttaaggacccgggtacgtaaccggacgttcgaagtaccggacngtcgactagcgatcaagtgannnanagngnannnnngnnnnngngn

SEQ ID NO: 248923 - DNA, 477 bp, Homo sapiens
  misc_feature: GYAE6OF02IM7Q3.33.55.E11.1.454.CMB.1.raw
  modified_base (188)..(188): a, c, t, g, unknown or other
  misc_feature (188)..(188): n is a, c, g, or t
  modified_base (224)..(224): a, c, t, g, unknown or other
  misc_feature (224)..(224): n is a, c, g, or t
  modified_base (291)..(291): a, c, t, g, unknown or other
  misc_feature (291)..(291): n is a, c, g, or t
  modified_base (325)..(325): a, c, t, g, unknown or other
  misc_feature (325)..(325): n is a, c, g, or t
  modified_base (456)..(477): a, c, t, g, unknown or other
  misc_feature (456)..(477): n is a, c, g, or t
tcagtacacacactcacgaccggtgctcgatttagcactcgcacgttgggtttgggagggtgtcccaggacttgagacagaccgccacaatcacctgcactggggacagcgacaatgttggctacgaaggagcactttggctgcagcgactccagggccaccctcccaaactcctttcctacaggganaacaaccggccctcagggatcccagagaggttttcngcatcaggtcaggcaacacagcctccctgaccatcactgactccgcctgaggacgagctgatattcngcttagcatgggacaggaacctcattgcttgggngttcggcggaggaccaagctgaccgtctaggtcacgcccaaggcctcgccccctggtccacctccgtcgttcccccaccctccctcagtcgtgttgtactggacgcgggctcgggcaaggccgcagtacgnnnnnnnnnnnnnnnnnnnnnn

SEQ ID NO: 248924 - DNA, 490 bp, Homo sapiens
  misc_feature: GYAE6OF02HDOU2.33.55.E11.1.454.CMB.1.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
  modified_base (431)..(431): a, c, t, g, unknown or other
  misc_feature (431)..(431): n is a, c, g, or t
  modified_base (460)..(460): a, c, t, g, unknown or other
  misc_feature (460)..(460): n is a, c, g, or t
  modified_base (463)..(466): a, c, t, g, unknown or other
  misc_feature (463)..(466): n is a, c, g, or t
  modified_base (468)..(468): a, c, t, g, unknown or other
  misc_feature (468)..(468): n is a, c, g, or t
  modified_base (471)..(490): a, c, t, g, unknown or other
  misc_feature (471)..(490): n is a, c, g, or t
tcagtacacacactcacgaccggtgctcgatttagcactcgcacgttgggtttgggagggtgtcccaggacttgagacagaccgccacaatcacctgcactggggacagcgacaatgttggctacgaaggagcactttggctgcagcgactccagggccaccctcccaaactccctttcctacagggagaacaaccggccctnagggatccccagagaggttttctgcatccaggtcaggcaacacacgcctccctgaccatcactgacctccgcctgaggacgngctgagtattctgcttagcatgggacacggacctcattgcttgggtgttcggcggtagggtaccaggctcgaccgtcgtaggtcacgccaaggcctcgccccgtcggtcactcctcgtccccacctcctcgtagtcgtgtctacgngacggcggctcggcgaggcgcgtatagcnacnnnntngtnnnnnnnnnnnnnnnnnnnn

SEQ ID NO: 248925 - DNA, 644 bp, Homo sapiens
  misc_feature: GYAE6OF02IXK0C.33.55.E11.1.454.CMB.1.raw
  modified_base (608)..(608): a, c, t, g, unknown or other
  misc_feature (608)..(608): n is a, c, g, or t
  modified_base (616)..(616): a, c, t, g, unknown or other
  misc_feature (616)..(616): n is a, c, g, or t
  modified_base (620)..(622): a, c, t, g, unknown or other
  misc_feature (620)..(622): n is a, c, g, or t
  modified_base (624)..(644): a, c, t, g, unknown or other
  misc_feature (624)..(644): n is a, c, g, or t
tcagtacacacactcacgaccggtgctcgatttagcactcgcacgttgggtttgggagggtgtcccaggacttgagacagaccgccacaatcacctgcactggggacagcgacaatgttggctacgaaggagcactttggctgcagcgactccagggccaccctcccaaactcctttcctacagggagaaacaaccggccctcagggactcccagagaggttttctgcatccgaggtcaggacaacacacgcctccctgaccatcacgtggacctccggcctgacggacgaggctgagttatttctgtcttagcgagtacgggacgacggtaaccctacgtattcggtcgtttggggttcggtttcgggacggggtaacggggaaccgaaggtccgtccggaacccggttccgttaacggtaccgtaccggtacccgaaacgggtcccgttccggtaccccccgtccgggtaccgtaccgtttcccgttacccgtttccccccggtcccccttacccgtccgtacggtttcggttacggttcggttaccgtcggaacggggtcgggccggttacgggaccgtacgggcccggtacgtaacgtacgggntcgatcgngacnnngnnnnnnnnnnnnnnnnnnnnn

SEQ ID NO: 248926 - DNA, 210 bp, Homo sapiens
  misc_feature: GYAE6OF01E05SG.35.71.G05.1.454.CMB.1.raw
  modified_base (209)..(210): a, c, t, g, unknown or other
  misc_feature (209)..(210): n is a, c, g, or t
tcagtacagatcgtcacgaccggtgctcgatttagtgtcgtcgcaagagagaggggcacttctccctctaacactctccctctacaagctcctcggacgttcgaccaagggaccaaggtggaaatcaaacgaactgtggctgcaccatctgtcttcatcttcccgccatctgaacgatctgtactgagcgggctggcaaggcgcatagnn

SEQ ID NO: 248927 - DNA, 368 bp, Homo sapiens
  misc_feature: GYAE6OF01ERQZ1.35.71.G05.1.454.CMB.1.raw
  modified_base (363)..(368): a, c, t, g, unknown or other
  misc_feature (363)..(368): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatcggtcttcccctggcaccctcctccaagagcacctctggggcacagcggccctgggctgcctggtcaaggactacttccacgatctgtactgagcgggctggcaaggcgcatagnnnnnn

SEQ ID NO: 248928 - DNA, 211 bp, Homo sapiens
  misc_feature: GYAE6OF01D6WQY.35.71.G05.1.454.CMB.1.raw
  modified_base (210)..(211): a, c, t, g, unknown or other
  misc_feature (210)..(211): n is a, c, g, or t
tcagtacagatcgtcacgaccggtgctcgatttagtgtcgtcgcaagagagagggggcacttctccctctaacactctcccctctacaagctcctcggacgttcggccaagggaccaaggtggaaatcaaacgaactgtggctgcaccatctgtcttcatcttccgccatctgaacgatctgtactgagcgggctggcaaggcgcatagnn

SEQ ID NO: 248929 - DNA, 374 bp, Homo sapiens
  misc_feature: GYAE6OF01CFAJW.35.71.G05.1.454.CMB.1.raw
  modified_base (361)..(361): a, c, t, g, unknown or other
  misc_feature (361)..(361): n is a, c, g, or t
  modified_base (367)..(374): a, c, t, g, unknown or other
  misc_feature (367)..(374): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaaacagaaaattacgatatgtggagtggttattacacggaaaactcgtggggccagggaaccctgctcaccgtctcgtcagcctccaccaagggccatcggtcttccccctggcaccctcctccaagacgcacctctggggcacagcggccctgggctgccctggtcaaggactacttccacgatctgtacctgagcgggctggcaaggcncatagnnnnnnnn

SEQ ID NO: 248930 - DNA, 575 bp, Homo sapiens
  misc_feature: GYAE6OF01ALJ6A.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctccgtggggctgctaatgctctgggtctctggatccaggtggggattattgtgatgactcagtcctccactcctccctcgccccgtccaccccgtggacgacgcccggccctccatcctcctgcaggtctagtcagcgcctcctgcatagtaatgatactaagttatttagaagtttggtacctgacagacgccgagggcacgtcctaccacacgtcctccgtgtacttcgttagttttcgggttacttaacggtccgggtcccgttcccggggtccctaggtaccgtacgggttcaggttcggacgtaggtggatcgaggcctacgtagttatttaccagttaacgtaaaactcgaagacgaaggacggtggaggtacg

SEQ ID NO: 248931 - DNA, 375 bp, Homo sapiens
  misc_feature: GYAE6OF01BEC67.35.71.G05.1.454.CMB.1.raw
  modified_base (364)..(375): a, c, t, g, unknown or other
  misc_feature (364)..(375): n is a, c, g, or t
tcagtacagatcgtcacgaccggtgctcgatttagtgtcgtcgcaagagagaggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatcggtcttccccctggcaccctcctccaagagcacctctgggggcacagcggccctgggctgcctggtcaaggactacttccacgatctgtactgagcgggctggcaaggcgcatagnnnnnnnnnnnn

SEQ ID NO: 248932 - DNA, 615 bp, Homo sapiens
  misc_feature: GYAE6OF01DBPID.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctctgggtctctggatccaggtggggatattgtgatgactcagtctccactctccctgccccgtcacccctggagacgcccggcctccatcctcctgcaggtctagtcagacgcctcctgcatagtaatggataacaagtatttgaatttcggtacctgacaagaagccgagggcacgtctaccacagcctccagtacttcgttagtttcgggttactaacgttccggggtacccgttcccggggtccctggaccgtaggttccaggtcggcgaggtggactcgaggaccaacgtagtaacttttaacacgtaagtaaaactcgaagaccgaaggaacggtagggaacggtacggttagggtaacgggttaagtttaggggtttagggttaaacgtttttagttaacggtggtaccgttaaagg

SEQ ID NO: 248933 - DNA, 329 bp, Homo sapiens
  misc_feature: GYAE6OF01AJXIM.35.71.G05.1.454.CMB.1.raw
  modified_base (324)..(329): a, c, t, g, unknown or other
  misc_feature (324)..(329): n is a, c, g, or t
tcagtacagatcgtcacgaccggtgctcgatttagtgtcgtcgcaagagagagggggtgaggtgaaagatgagctggaggaccgcaataggggtaggtccctgacaggttcagtggcagtggatcaggcacagattttacactgaaaatcagcagagtggaggctgaggatgttggagtttattactgcatgcaaactctacaagctcctcggacgttcggccaagggaccaaggtggaaatcaaacgactgtggctgcaccatctgtcttcatcttccgccatctgaacgatctgtactgagcgggctggcaaggcgcatagnnnnnn

SEQ ID NO: 248934 - DNA, 329 bp, Homo sapiens
  misc_feature: GYAE6OF01DIJR9.35.71.G05.1.454.CMB.1.raw
  modified_base (323)..(329): a, c, t, g, unknown or other
  misc_feature (323)..(329): n is a, c, g, or t
tcagtacagatcgtcacgaccggtgctcgatttagtgtcgtcgcaagagagaggggggtgaggtgaaagatgagctggaggaccgcaataggggtaggtccctgacaggttcagtggcagtggatcaggcacagattttacactgaaaatcagcagagtggagctgaggatgttggagtttatactgcatgcaaactctacaagctcctcggacgttcggaccaagggaccaaggtggaaatcaaacgactgtaggctgcacatctgtcttcatcttcccgcatctgaacgatctgtactgagcggctggcaaggcgcatagnnnnnnn

SEQ ID NO: 248935 - DNA, 522 bp, Homo sapiens
  misc_feature: GYAE6OF01BEQZL.35.71.G05.1.454.CMB.1.raw
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccaggtggggatattgtgatgactcagtctccactctccctgccccgtcacccctggagacgcccggcctccatcctcctgcaggtctagtcagacgcctcctgcatagtaatggatacaagttatttagaatttggtacctgcagaagccgagggcagtctccacagctcctgattcttagtttcggtactaagtccgggtcccgtccggggtccctggacgtaggttcaggtggctaggtggatcgaggcacgtagtatttacattagaaatcgagcaaggngtgggngtcg

SEQ ID NO: 248936 - DNA, 498 bp, Homo sapiens
  misc_feature: GYAE6OF01BU5GF.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaagtattgaattggtactgcagaagcagggcagtctcacagctcctgatctatttgggttctaagtcgggcctccgggtccctgactagttcagtggcagtgatcaggcactagtattttacactagaaaatcaagcaagagtggagcgtgaggattggttggtagtttatactgctag

SEQ ID NO: 248937 - DNA, 342 bp, Homo sapiens
  misc_feature: GYAE6OF01AL093.35.71.G05.1.454.CMB.1.raw
  modified_base (294)..(294): a, c, t, g, unknown or other
  misc_feature (294)..(294): n is a, c, g, or t
  modified_base (326)..(342): a, c, t, g, unknown or other
  misc_feature (326)..(342): n is a, c, g, or t
tcagtacagatcgtcacgaccggtgctcgatttagtgtcgtcgcaagagagaggggggtgaggtgaaagatgagctggaggaccgcaataggggtaggtccctgacaggttcagtggcagtggatcaggcacagattttacactgaaaactcagcagagtggaggctgaggatgttggagtttatactgcatgcaaactctacaagctccgtcggacgttcggccaagggaccaaggtgaaatcaaacgactgtggctgcaccgatctgtcttcatcttcccgcatctgaacgntctgtactgagcgggctggcaaggcgcatagnnnnnnnnnnnnnnnnn

SEQ ID NO: 248938 - DNA, 680 bp, Homo sapiens
  misc_feature: GYAE6OF01CFOD3.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgaactcaggccctgatgggtgacttcgcaggcgtagactttgtgtttctcgtaggctccctgctcagctcctggggctgctaatgctctgggtctctggatccaggtggggatattgtgatgactcagtctccactctccctgcccgtcacccctggagacgcccggcctccatcctcctgcaggtctagtcagacgcctcctgcatagtaatggatacaagttattgaattggtacctgcagaacgccgagggcagtcctcacagcctcctgacttcgttagtttggggttacctaacgttcccggggtcccgttcccgggggttccccttaggtacgtacgggtttcagggtcgggacgtaggtcgggtatcgagggacctaacgtaacggtttaacttttttaaccgaaccgtttaaggaaaaacttccgaaacgggtaccgtaaagggtaacgggttggggtaaacggggtccgttaaggggtaaacggggttagttttagggggttttaacgggtttaaaggtttttttaacgttaaacggtttcggtacccgttaaggttaaacccggg

SEQ ID NO: 248939 - DNA, 371 bp, Homo sapiens
  misc_feature: GYAE6OF01EKK69.35.71.G05.1.454.CMB.1.raw
  modified_base (366)..(371): a, c, t, g, unknown or other
  misc_feature (366)..(371): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccttgctcaccgtctcgtcagcctccaccaagggcccatccggtcttccccctggcaccctcctccaagagcacctctgggggcacagcggccctgggctgcctggtcaaggactacttccacgatctgtactgagcgggctggcaaggcgcatagnnnnnn

SEQ ID NO: 248940 - DNA, 369 bp, Homo sapiens
  misc_feature: GYAE6OF01BT0HU.35.71.G05.1.454.CMB.1.raw
  modified_base (364)..(369): a, c, t, g, unknown or other
  misc_feature (364)..(369): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatcggtcttccccctggcaccctcctccaagagcacctctggggcacagcggccctgggctgcctggtcaaggactacttccacgatctgtactgagcgggctggcaaggcgcatagnnnnnn

SEQ ID NO: 248941 - DNA, 328 bp, Homo sapiens
  misc_feature: GYAE6OF01EDJ4H.35.71.G05.1.454.CMB.1.raw
  modified_base (267)..(267): a, c, t, g, unknown or other
  misc_feature (267)..(267): n is a, c, g, or t
  modified_base (317)..(317): a, c, t, g, unknown or other
  misc_feature (317)..(317): n is a, c, g, or t
  modified_base (323)..(328): a, c, t, g, unknown or other
  misc_feature (323)..(328): n is a, c, g, or t
tcagtacagatcgtcacgaccggtgctcgatttagtgtcgtcgcaagagagaggggggtgaggtgaaagatgagctggaggaccgcaataggggtaggtccctgacaggttcagtggcagtggatcaggcacagattttacactgaaaatcagcagagtggaggctgaggatgttggagtttatactgcatgcaaactctacaagctcctcggacgttcggccaagggaccaaggtggaaatcaaacgaactgtggctgcaccatcngtcttcatcttcccgcatctgaacgatctgtactgagcggctggcaggcncatagnnnnnn

SEQ ID NO: 248942 - DNA, 545 bp, Homo sapiens
  misc_feature: GYAE6OF01BZBYF.35.71.G05.1.454.CMB.1.raw
  modified_base (330)..(330): a, c, t, g, unknown or other
  misc_feature (330)..(330): n is a, c, g, or t
  modified_base (519)..(519): a, c, t, g, unknown or other
  misc_feature (519)..(519): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctctgggtctctggatccaggtggggattattgtgatgactcagtctccactcctccctgccccgtccaccccgtggacgacgcccggcctccatcctcctgcacggtctagtcagacgcctctgcatagtaatgatanaagttattagaattggtactgacaagaacgccgaggcagtccacacagtctcctagtacttacttagtttcgggtactaacggtccgggtcccgtccggggtccctgacgtaggttcaggtcggcgagtgatcgagacagtagttactttacataagaaactcagcaggtaggtgaggacgtggaagtnttaggttaggtatttagtcngntacg

SEQ ID NO: 248943 - DNA, 576 bp, Homo sapiens
  misc_feature: GYAE6OF01DYGUD.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggcccctgatgggtgacttcgcaggcgtagactttgtgtttctcgtaggctccctgctcagctcctggggctgctaatgctctgggtctctggatccagtggggatattgtgatgactcagtctccactcctccctcgcccgtccacccctggagacgcccggcctccatcctcctgcaggtctagtcagacgccctcctgcataagtaatggatacaagttatttagaattggtacctgcagaacgccgagggcagtcctaccacacgtcctcctagtacttcgttagttttcgggttactaacgtccgggcccgttcccggggtccctaggtaccgtaggttcaggtcggcgtaggtggatcgaggcaacgtagttacttttacactagaaaactcgaagcaaggaggtagggaggcgtaggaggtagttaggtttaggttaagttttattacgtgtctaag

SEQ ID NO: 248944 - DNA, 634 bp, Homo sapiens
  misc_feature: GYAE6OF01DHTTS.35.71.G05.1.454.CMB.1.raw
  modified_base (565)..(565): a, c, t, g, unknown or other
  misc_feature (565)..(565): n is a, c, g, or t
  modified_base (626)..(626): a, c, t, g, unknown or other
  misc_feature (626)..(626): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctcgtgggtctcgtggatccgaggtggggattattgtgatgactcagtcctccactcctccctcgccccgtccaccccgtggacgacgcccggccctccactcctcctgcgtacggttctagtcaagcgccctccgtgactaataagtaagtggaaataacgtaaagtttagtttagaaagtttcggtaacctgacaagaacgaccgaggacacgtcctaccacacgtcctccgtagtaacttcgtttaacgttttcgggttacctaacggttcccggggtcccggttcccggggtccctaggaccgttagggttccgaggtcggacgtaaggtcggaactcgaacggctaacgtagttaactttacaacgtanaaactcaagacgaaggaggtgggaagcgtaggagtagttaggttacggtattttagtacgngtacgtag

SEQ ID NO: 248945 - DNA, 607 bp, Homo sapiens
  misc_feature: GYAE6OF01EUEH7.35.71.G05.1.454.CMB.1.raw
  modified_base (378)..(378): a, c, t, g, unknown or other
  misc_feature (378)..(378): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctctgggtctctggatccaggtggggatattgtgatgactcagtctccactcctccctgcccgtcacccctggagacgcccggcctccatctcctgcaggtctagtcagacgcctcctgctatagtaatggaataacgaagttatttgaattggtacctgacagaacgccgaggcagtcctaccacngcctcctgtacttcttagtttcgggttacttaacggtcccggggtcccgttcccgggggttccctaggtaccgtaggttccgagggttcggacgtagggtggactcggaggacctaacgtagttattttaaccacgttaagaaaactcgaacggacgaaggtaacggtgggagggtacgtgggaacgggtatttagggttaggttacgtttaagttacgtggtcctaag

SEQ ID NO: 248946 - DNA, 526 bp, Homo sapiens
  misc_feature: GYAE6OF01DO9JI.35.71.G05.1.454.CMB.1.raw
  modified_base (522)..(522): a, c, t, g, unknown or other
  misc_feature (522)..(522): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccaggtggggatattgtgatgactcagtctccactcctccctcgcccgtccaccccctggacgacgcccggccctccactcctcctgcaggtctagtcagcgcctctgcatagtatgatacgaagttattgaattggtacctgacagaacgccgagggcagtctccacagcctcctgtacttcgttagtttcgggttactaagtccgggtcccgttccggggtccctgacgtggttcaggtcgcaggtgatcgagcacgtagttatttacactagaaatcgagacaggagtggngtcg

SEQ ID NO: 248947 - DNA, 821 bp, Homo sapiens
  misc_feature: GYAE6OF01DFPKY.35.71.G05.1.454.CMB.1.raw
tcagtacagatcgtcacgaccggtgctcgatttagtgtcgtcgcaagagagagggggtcaggctggaactgaggagcagggtgggggcacttctccctctaacactcctccctgttgaagccttctttgtggacgggcgagctcgaggacttagactcgaggtacctcctacgtacttcctacctttcacaacgtaagtggacggtcccttccgtgtcctcgccgtcccgttccgggtcgggttcctacgtacttaacgtcgtccgttcggttcggttccttcgtaggtaccgtacggtaggggtaggtttaattggttagtacgtagtaccgtacctccgttaccttcccctacccttaccttccccgttccgtaccccggtcccccgtaccccggtaccgggtacggaccggtccccggtccccgttaccctaccgttccgtttccccgtgccgggttaacttaccggtacttaaccggacgaaccggttcccttcccgtagtaacgtaacgtttaaagtaacgttaaggtacgttaaaacgttacgtttaagtttacgtttaaggaccggtttccggacgacgaacggaaccggtaccgagggtaccgttatcccgttaacgacgtaacgtcgtaccttagtaccgtttatttacgggtttcggttacggtaccggtccggttcccgggttaccggtcgtacgaggttcccggtagtaggtcgacgtggacgtctaagcgtacctaatacgttttaacgtaaccttcgaaaagttaacgacggacgtagtaacgggtaggtaggtacgtgggtaaagg

SEQ ID NO: 248948 - DNA, 563 bp, Homo sapiens
  misc_feature: GYAE6OF01BRW72.35.71.G05.1.454.CMB.1.raw
  modified_base (369)..(369): a, c, t, g, unknown or other
  misc_feature (369)..(369): n is a, c, g, or t
  modified_base (441)..(441): a, c, t, g, unknown or other
  misc_feature (441)..(441): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccaggtggggatattgtgatgactcagtctccactctccctcgcccgtccacccctggagacgcccggcctccatcctcctgcaggtctagtcagcgcctctgcatagtatggataacaagttattagaattggtacctgcaagacgccgaggcagtctccanacgtctcctgtattcttagtttcggttactagtccgggtcccgtccgggtccctgacgtagttcgaggtcgngtgtggactcgagggcctaacgtattaacttttaacacgttaagaaactcgaagtcgaagggacggtggaacggtcgtagggaggtagttggtttagggttacgttttaatcgtgtcgtaag

SEQ ID NO: 248949 - DNA, 634 bp, Homo sapiens
  misc_feature: GYAE6OF01C5M31.35.71.G05.1.454.CMB.1.raw
  modified_base (335)..(335): a, c, t, g, unknown or other
  misc_feature (335)..(335): n is a, c, g, or t
tcagtacagatcgtcacgaccggtgctcgatttagtgtcgtcgcaagagagagggggcacttctccctctaacactctcccctgttgaagctctttgtgacggcgagctcaggccctgatgggtgacttcgcaggcgtagactttgtgtttctcgtaggctccctgctcagctcctggggctgctaatgctctgggtctctggatccaggtggggatattgtgatgactcagtctccactctccctgccccgtccaccccgtggacgacgcccggcctccatcctcctgcaggtctagtcagacgcctctgactatagtaatggataacaagttnttagaagtttggtacctgactaagaacgccgagggctacgtcctaccaacgtacgtccttccgtagtacttacgtttaagttttcgggttaactaacggttcccggggtacccgttcccggggttacctcgtacgtacggttccagggttcggaccgtaggtcgacttcgaagggtcctaacgtagttaacttttacgaacgtaagtaaaactccgaaaggccgtaaaggcgggttaggaggtacgttagggaacggttagttgggtttaacggtaagttttactacgtgtaccgtaag

SEQ ID NO: 248950 - DNA, 372 bp, Homo sapiens
  misc_feature: GYAE6OF01A7P8W.35.71.G05.1.454.CMB.1.raw
  modified_base (364)..(372): a, c, t, g, unknown or other
  misc_feature (364)..(372): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatcggtcttccccctggcaccctcctccaagacgcacctctgggggcacagcggcctggctgcctggtcaacggactacttcacgatctgtactgagcgggctggcaaggcgcatagnnnnnnnnn

SEQ ID NO: 248951 - DNA, 631 bp, Homo sapiens
  misc_feature: GYAE6OF01A7E24.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactcctccctcgcccgtccaccccgtggacgacggcccggccctccactcctcctgcgtacggtctagtcagacgcctcctgcatagtaatggatactaagtattgaagttggtactgcagacgccgaggcagtcctaccacgacgtcctccgtagtacttccgttaggttttcgggttaccttaacggtcccggggtccggttccccggggtcccttaggaccgttacgggttcaggtcggcgtaggtgactcgacggccaagtagttaacttttaacgaacgtaagaaaactcgaagtcgtaaacgggtagggtacggggtaggacggttaggggaacggttagtttacgggttagggtttaacgttttaagttaaccgttgtaccgtaacg

SEQ ID NO: 248952 - DNA, 536 bp, Homo sapiens
  misc_feature: GYAE6OF01A8EWH.35.71.G05.1.454.CMB.1.raw
  modified_base (530)..(530): a, c, t, g, unknown or other
  misc_feature (530)..(530): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgcccgtcacccctggagagccggcctccatctcctgcaggtctagtcagacgcctctgcatagtaatggatacaagttatttgaattgtacctgcagaagccagggcagtctccacagctcctgatcttagtttgggttctaagtccgggccttccggggtccctgactaggttcaggtggcaggtgactcgaggcacgtagttactttacactagaaaactcgagcgaaggtaggtggaggcgtaggaaggtagtttaggttagggtaagttttattacgtgntaacgg

SEQ ID NO: 248953 - DNA, 581 bp, Homo sapiens
  misc_feature: GYAE6OF01CBD3B.35.71.G05.1.454.CMB.1.raw
  modified_base (349)..(349): a, c, t, g, unknown or other
  misc_feature (349)..(349): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccaggtggggatagttgtgtatgactcgagtcctccactcctccctcgccccgtccaccccgtggacgacggcccggtccctccgactcctcctgctacggtctagtcagacgtccctccngcatagtaatggaatacgtaagttattagtaattcggtacctgacgtagaacgcgagggcacgtcctaccacgacgtcctcctagtcttacgttagtttcggtactaggtccgggtcccgttccggggtccctgtaccgtaggttcgaggttcgacgtgtgatcggagcctacgtagttacttttaacacgtaagtaaactcggaacgacgaggtacggtgggtacgtacgg

SEQ ID NO: 248954 - DNA, 558 bp, Homo sapiens
  misc_feature: GYAE6OF01BD2AO.35.71.G05.1.454.CMB.1.raw
  modified_base (552)..(552): a, c, t, g, unknown or other
  misc_feature (552)..(552): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccaggtggggatattgtgatgactcagtctccactctccctgcccgtcaccccgtggacgacgccgcctccatctcctgcaggtctagtcagacgcctcctgcatagtaatggatacaagtattagaattggtacctgacagaacgccgaggcagtcctccacagtctcctgtacttcttagttttcgggtctaacggtccgggcccgttcccggggtccctaggaccgtgggttccaggttcgggctagggtgtactcgaggtaccacgtagttacttttaacgactagaaatcgagcgagaggtggaggtctggaggtagttggttaggtagtttattacgtgngtaacg

SEQ ID NO: 248955 - DNA, 437 bp, Homo sapiens
  misc_feature: GYAE6OF01C8YOU.35.71.G05.1.454.CMB.1.raw
  modified_base (224)..(224): a, c, t, g, unknown or other
  misc_feature (224)..(224): n is a, c, g, or t
  modified_base (418)..(437): a, c, t, g, unknown or other
  misc_feature (418)..(437): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacaacggaaaactcgtggggccagggaaccctgctcaccgtntcgtcagcctccaccgaacgggccagtccggtccttcccccgtggccaccctcctccaacgacgccacctcgtcgggggccaccgacggccggcccgtgggcctcgccgtcggtaccaaacggtacctaaccttccgacgatccgtacgtactcggaggcggggctgggacgaaacgggccgacgaagtagcannnnnnnnnnnnnnnnnnnn

SEQ ID NO: 248956 - DNA, 387 bp, Homo sapiens
  misc_feature: GYAE6OF01AUUJB.35.71.G05.1.454.CMB.1.raw
  modified_base (378)..(387): a, c, t, g, unknown or other
  misc_feature (378)..(387): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactacgtggggccagggaaccctgctcaccgtctcgtcagcctccaccgaacgggcccatccggtccttccccctggccacccctcctccaagagccacctcgtgggggcacaggccggccctgggctgcctggtcaaggactacttccacgatctgtactgagcgggctggcaacggcgcatacgnnnnnnnnnn

SEQ ID NO: 248957 - DNA, 614 bp, Homo sapiens
  misc_feature: GYAE6OF01BAVVR.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtgggatattgtgatgactcagtctccactcctccctcgccccgtccaccccgtggagacgcccggcctccatctcctgcaggtctagtcagacgccctcctgcatagtaatggataacaagtatttagaattcggtacctgacaagaacgccgagggctagtcctacccacgacgtcctcctagtacttccgtttagttttcggggttaccttaacggttcccggggtccccgttcccgggggttcccctggtaccgtagggtttcacggtcggcgtaggtggtactcgaggaccaacgtagttaacttttaacacgtaagaaaactccgaaggaccaaggtaggtcgggaggtacgtgggaaggtagtttacgggtttaggttagttttatacgttgcgtaag

SEQ ID NO: 248958 - DNA, 421 bp, Homo sapiens
  misc_feature: GYAE6OF01CHGOZ.35.71.G05.1.454.CMB.1.raw
  modified_base (404)..(421): a, c, t, g, unknown or other
  misc_feature (404)..(421): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagttggttattacaacggaaaactacgtggggccagggaaccctgcctcaccgtctcgtcagcctccaccgaagggcccatccgtccttcccctggccaccctccctccaagacgccacctcgtcgggggccaccgacggccgggcccgtggggccgtcgcccgtagggtaccaacggaccttacttccacgatctgtacgtgacggcgggctggacgaaggcgacagtagnnnnnnnnnnnnnnnnnn

SEQ ID NO: 248959 - DNA, 843 bp, Homo sapiens
  misc_feature: GYAE6OF01B41DO.35.71.G05.1.454.CMB.1.raw
  modified_base (171)..(171): a, c, t, g, unknown or other
  misc_feature (171)..(171): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttntcacaatgagctccctgctcagctccgtgggctgctaatgctcgtgggtctcgtggactccgaggtggggatagttggtgatggactcgacgtcctcctacgtcctcccgtcgccccgtccaccccgtggacgacggtcccggtccctaccgacgttccgtacccgtggaccgtacggttacctaacggttccgaacggtaccgtcccttaccgtacgtaccgtaagttaacggtaacgttcgggtaaacttaaaccgtaaaggtttacttttacggtaaaacgttttcggttaacccttacgggaaccgtaaacgggtaaccggtacccgggtaacggggttacctaaccgggtttaccctaaccccgtaaacggtaccggttacccttacccggttaaggttaaccgttttaccgtttaacggtttttccgggttaacccgttaaacgggttccccggggttacccccggtttcccggggtttaacccttacgggtaacccggttaccgggtttaccgaacgggtttcgggaaccgttagggtaccggttaacgttaccgggtacggtaacctaaccggtttaacggtttaacgttttaaccgaaccggtttaaacggtaaaacttccgaaacgggttactaagggtacggttagggaacggttaccggg

SEQ ID NO: 248960 - DNA, 772 bp, Homo sapiens
  misc_feature: GYAE6OF01EOBBT.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctctgggtctcgtggatccgaggtggggattagttgtgatgactcagtctccactcctccctcgccccgtccaccccgtggacgacggcccggtccctaccacttcctcctcgccgtacgggttccttacgtccgaaggaccgtcccttcccgtgacctaagttaacgttaaagtagggtaattaaacgtaaaggtttaattttaggtaaagtttcgggttaaccctggacgaaggaaacggcccggaaggggtacctacggttaccctacccaacgacggtacccttccgtacggtaactttccgtttaagttttcgggggttaaccttaaaccgggttcccggggttaccccggttccccgggggttcccctagggtaaccgtacgggtttacgaagggttcggtacgtaagggtcggtaacttccgggaacggtaccaacgttaacggtttaacttttaaccgaaacgttaaggaaaaactcgaacggtaccgtaaagggtagggtagggacggtacggttagggaagggttagtacgggttttagggttaacgttttaacgttacgtgtcgtaacgg

SEQ ID NO: 248961 - DNA, 213 bp, Homo sapiens
  misc_feature: GYAE6OF01ECWZ9.35.71.G05.1.454.CMB.1.raw
  modified_base (210)..(213): a, c, t, g, unknown or other
  misc_feature (210)..(213): n is a, c, g, or t
tcagtacagatcgtcacgaccggtgctcgatttagtgtcgtcgcaagagagagggggcacttctccctctaacactctcccctctacaagctcctcggacgttcggccaagggaccaaggtggaaatcaaacgaactgtggctgcaccatctgtcttcatcttcccgcatctgaacgatctgtactgagcgggctggcaaggcgcatagnnnn

SEQ ID NO: 248962 - DNA, 705 bp, Homo sapiens
  misc_feature: GYAE6OF01EVW0H.35.71.G05.1.454.CMB.1.raw
  modified_base (319)..(319): a, c, t, g, unknown or other
  misc_feature (319)..(319): n is a, c, g, or t
tcagtacagatcgtcacgaccggtgctcgatttagtgtcgtcgcaagagagagggggcacttctccctctaacactctcccctgttgaagctctttgtgacgggcgagctcaggcccctgatggggtgacttcgcaggcgtagacttttgtgtttctcgtaggctccctgctcagctccgtggggctgctaatgctctgggtctctggatccaggtggggattattgtgatgactcagtctccactcctccctcgcccgtccaccccgtggacgacgcccggcctccatcctcctgctaggtctagtcagcgccctccngcatagtatgatacaagttattgaattggtactgacagaacgcgaggctacgtctaccacgagcctacctgtacttacgttagttttcgggttacttaacggtcccggggtcccgttccccgggggttaccctagggtacccgttagggttaccgtaagggtcgggaacgtagggttacgggtactaccggaacgggacccaaccgttaaggtttaactttttaaccgaaaccgtttaaacggaaaaaacttccggaaacggttacgaaacggggttaacggggttacggggaacgggttaccggttaggggtaaaggggttacggtttaaggggttttaacgggttaaacgttttttaaggtttaccgtgggtaaccttaaacgg

SEQ ID NO: 248963 - DNA, 327 bp, Homo sapiens
  misc_feature: GYAE6OF01ERCFR.35.71.G05.1.454.CMB.1.raw
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (315)..(315): a, c, t, g, unknown or other
  misc_feature (315)..(315): n is a, c, g, or t
  modified_base (321)..(327): a, c, t, g, unknown or other
  misc_feature (321)..(327): n is a, c, g, or t
tcagtacagatcgtcacgaccggtgctcgatttagtgtcgtcgcaagagagaggggggtgaggtgaaagatgagctggaggaccgcaataggggtaggtccctgacaggttcagtggcagtggatcaggcacagattttacactgaaaatcagcagagtggaggctgaggatgttggagtttatactgcatgcaaactctacaagctcctcggacgttcggccaagggaccaaggtggaaatcaaacgactgtgctgcaccatctgtcttcatccttccgcatctgaacgntctgtacngagcggctggcaggcncatagnnnnnnn

SEQ ID NO: 248964 - DNA, 545 bp, Homo sapiens
  misc_feature: GYAE6OF01EEZAE.35.71.G05.1.454.CMB.1.raw
  modified_base (542)..(542): a, c, t, g, unknown or other
  misc_feature (542)..(542): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagacttttgtgtttctcgtaggctccctgctcagctcctggggctgctaatgctctgggtctctggatccaggtggggatattgtgatgactcagtctccactctccctgccccgtcacccctggagacgccggcctccatctcctgcaggtctagtcagacgccctcctgcatagtaatggatacaagtatttgattggtacctgcagagccgagggcagtcctccacacgctcctagattcttagtttcgggttactaacgtccggggcccgtccggggtccctggtacgtacggttcgtagtggcgtaggtggatcgacggcaactagtattttaacactagtaaatcgagcgaggaggtgggaggcgtggaggtagttggttagtagtttattacgtgntag

SEQ ID NO: 248965 - DNA, 537 bp, Homo sapiens
  misc_feature: GYAE6OF01C2PDH.35.71.G05.1.454.CMB.1.raw
  modified_base (368)..(368): a, c, t, g, unknown or other
  misc_feature (368)..(368): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgcccgtcaccctggagacgcccggcctccatcctcctgcaggtctagtcagacgcctcctgcatagtaatggatacaagtatttagaattgtacctgacagaacgcagggcagtctaccgancgctcctgacttcttatttgggtactaagtccgggccgttccggggtccctgactacggttcaggtcgcgtagtggactcgaggcaagtagtattttacactagaaactcgacgcgaggaggtgggagtcgtaggaggtattaggttaggtagttttatacgtgctaag

SEQ ID NO: 248966 - DNA, 226 bp, Homo sapiens
  misc_feature: GYAE6OF01BBSZ6.35.71.G05.1.454.CMB.1.raw
  modified_base (209)..(226): a, c, t, g, unknown or other
  misc_feature (209)..(226): n is a, c, g, or t
tcagtacagatcgtcacgaccggtgctcgatttagtgtcgtcgcaagagagagggggcacttctccctctaacactctcccctctacaagctcctcggacgttcggccaagggaccaaggtgaaatcaaacgactgtggctgcaccatctgtcttcatcttcccgccatctgaacgatctgtactgagcgggctggcaaggcgcatagnnnnnnnnnnnnnnnnnn

SEQ ID NO: 248967 - DNA, 720 bp, Homo sapiens
  misc_feature: GYAE6OF01DZ3HF.35.71.G05.1.454.CMB.1.raw
  modified_base (586)..(586): a, c, t, g, unknown or other
  misc_feature (586)..(586): n is a, c, g, or t
  modified_base (666)..(666): a, c, t, g, unknown or other
  misc_feature (666)..(666): n is a, c, g, or t
tcagtacagatcgtcacgaccggtgctcgatttagtgtcgtcgcaagagagaggggcacttctccctctaacactctcccctgttgaagctctttgtgacggcgagctcaggccctgagtgggtgacttcgcaggcgtagtactttgtgtttctcgtaggcctcctgctcagctcgtgggctgctaatgctcgtggtctcgtggactccgaggtgggattagttgtgatcgactcacgttcctccacttcctcccgtcgtccccgtccaaccccgtggacgaccgcccgtcctccatcctctcgacgtagtctacgtcagccgtcctcgtagacaattaacgtaagtaggaacttaacgtaagttatttagaacgttcggtacctagacgtaacggtaacgcccggaggtactacgtccaaccgtacacgtccttacgtacgtaactttacgtttacgggttttcggtaaccttacggtcccggggtcccgttacccggggtccctaggtaaccgtcgggttacgtgggaccgtgtaagggttcgaacgtccggaacgtacgtaaccggttatttaaccgtttaanaaaccgtttaagaaagtccgtaagggtaaaccgtaaggggtacggtacgggtaacgggtacggttacgggtaacgggttntttaacgggggtttaacgtttaaggttttaccttaacgggacgtcgtaaaaacg

SEQ ID NO: 248968 - DNA, 686 bp, Homo sapiens
  misc_feature: GYAE6OF01CLS2G.35.71.G05.1.454.CMB.1.raw
  modified_base (515)..(515): a, c, t, g, unknown or other
  misc_feature (515)..(515): n is a, c, g, or t
  modified_base (599)..(599): a, c, t, g, unknown or other
  misc_feature (599)..(599): n is a, c, g, or t
tcagtacagatcgtcacgaccggtgctcgatttagtgtcgtcgcaagagagagggggtcaggctggaactgaggagcagggtgggggcacttctccctctaacactcctcccctgttgaagcttctttgtggacggggcgagctcaggactgatcaggacctcctcagttccaccttctcaacaatgacgcctccctgctcacgcctccgtgggctgactatgctcgtggtctcgtgactccgtaggtgggtattagttgtgtatcgtactcgtacgttccctaccctaccttccctcccgtccggtcccccgtcccgtaccccggtagggaccggaccggtcccggtaccctcctacttccctaccgtcgaccgtaggtcctacgtcaacggcctcccgtccgtgtactaagttaacgtaagtacgtaactaaacgttaagtttagttacgtaagttcggtacctagacgaacggacgccgagggtacctacgtacccacctacacgttccctnttagtactttacgtttaggtttcggtaccttaccgggtccggttcccggttccgggtactagggtaccgttaggtcgaggtcgngttaggcgtacacggacgtactaagtactttaaccgttacaacgttaaataacgcgacgtacggtaggtacgggttgggaagtcggg

SEQ ID NO: 248969 - DNA, 545 bp, Homo sapiens
  misc_feature: GYAE6OF01C2E2R.35.71.G05.1.454.CMB.1.raw
  modified_base (532)..(532): a, c, t, g, unknown or other
  misc_feature (532)..(532): n is a, c, g, or t
tcagtacagatcgtcacgaccggtgctcgatttagtgtcgtcgcaagagagagggggtcaggctggaactgaggagcaggtgggggcacttctcctctaacactctcccctgttgaagctctttgtgacgggcgagctcaggactgatcaggactcctcagttcaccttctcacaatgaggctccctgctcagatcctggggctgctaatgctctgggtctctggatccagtgggatattgtgatgactcagtcctccactcctccctcgccccgtccacccctggacgcgcccggcctccatcctcctgcaggtctagtcagcgcctcctgcatagtaatggataacaagttattgtattcggtactgacaggaacgccgagggctagtcctcccacgagtcctcctgtacttcttagtttcgggttaccttagtccgggtcccgttccggggtcctggacgtggttcaggtcgactaggtgactcgaggtcacgtagttatttaacgataagaaactcgaacgacaaggnggtgggaggtacg

SEQ ID NO: 248970 - DNA, 536 bp, Homo sapiens
  misc_feature: GYAE6OF01AXIVE.35.71.G05.1.454.CMB.1.raw
  modified_base (477)..(477): a, c, t, g, unknown or other
  misc_feature (477)..(477): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactcctccctgcccgtcaccccgtggagacgcccggcctccatcctcctgcaggtctacgtcagacgcctcctgcatagtaatggatacaagtatttgaattggtacctgcaagaagccgagggcagtcctccacacgctctgattcttagtttgggttactaagtccgggtccgtcccggggtcctggacctagggttctaggtcgcaggtggatcgaggccagtagtactttacatanaaacgtcagcaggagtggagtgtggaaggtattggttaggtaattttactacgtgatag

SEQ ID NO: 248971 - DNA, 375 bp, Homo sapiens
  misc_feature: GYAE6OF01BVLQP.35.71.G05.1.454.CMB.1.raw
  modified_base (365)..(375): a, c, t, g, unknown or other
  misc_feature (365)..(375): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcacgtctcgtcagcctccaccaagggcccatccgtcttcccctggcaccctcctccaagagcacctctgggggcacagcggccctgggctgcctggtcaaggactacttccacgatctgtactgagcgggctggacgaaggcgcatagnnnnnnnnnnn

SEQ ID NO: 248972 - DNA, 719 bp, Homo sapiens
  misc_feature: GYAE6OF01DBVYC.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctcgtgggtctcgtggatccgaggtggggattagttgtgatgactcacgtcctccactctccctcgccccgtccaaccccgtggacgacgcccggcctccatcctcctgcgtaggtaactagtacgagacgtccctcctgactagtaagtagtaggataacgtaagttattagtaagtttacggtactagacgaagtaacgaccgagggacacgtcctaccgactacgtcctaccgtagtacttacgtttaacgtttcgggttaacctacgggttcccgggtccccgtttcccggggtacccttcggtaaccggttcgggtttaccgaggttcggaccgttagggtagggtacgttaccgaaggtacccttaaacgtagtttaaacgttttaaccaaccgttaaggtaaaaacttccggtaaaggaccggtaagggtaacgggttacgggaaacgggttcgttaaggggtagggttaagttttcgggtaaggttttaaacggtttataaccgtgggtacttaaaccgg

SEQ ID NO: 248973 - DNA, 705 bp, Homo sapiens
  misc_feature: GYAE6OF01C215P.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctggtctctggatccagtggggatattgtgatgactcagtcctccactcctcccgcgcccgtccaccccgtggacgacggcccggtccctcctactccctccgtcgccgtaggttctacgtcgaacgaccgtcccctccgtagttaagttaacgtaaagtaggtaacttaacgtaaagtttattagtaagttcggtacctgacgagaacgcgaggctacgtcctaccacgtacgtcctcgtagtacttcgtttaggtttccgggtttaactaccgggttcccgggtcccgttcccggggttacctaggtacgttacggttcgagggtcggacgttaggtcggtacttcggaacggacctaagtaacgtttaacttttaaccgaacgtttaaaggaaaccttcggaaacgtacgaagggttaagggtacgggacggttacgtaaggggtagggttacgttttagggttaacgggtttaaacgttttaacgtaccgtacggtattacgtaaaccg

SEQ ID NO: 248974 - DNA, 676 bp, Homo sapiens
  misc_feature: GYAE6OF01C2O3E.35.71.G05.1.454.CMB.1.raw
  modified_base (246)..(246): a, c, t, g, unknown or other
  misc_feature (246)..(246): n is a, c, g, or t
  modified_base (455)..(455): a, c, t, g, unknown or other
  misc_feature (455)..(455): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagcttctttgtgacgggcgagctcaggactgatcaggactcctcagttcaccttctcacaatgagctcctgctcagctccgtgggctgctaatgcttcgtggtctcgtggctcgaggtgggatagttgngatgactcgacgttcctcctaccttcctccctcgccccgtccaccccgtggacggaccgcccggcctacctactccctccgtgcgtacgggtctagtcgacgtaccgtccctccgtgactaagtaagtaagttaggaacttaactaagtttaattcgtaaagttcggtactagacgaacgacgaccgtacgggactacgtcctaccacncgtctaccgtatacttacgtttagtttacggtttacgtaacgggttcccggtcccggtttaccggggtcccttacgggtaacggttacgggtttacgagggttcggacgttagggtacggtacgtccgaacggtactaacgttaacgtttaacttttaaccgaaagttaaacgtaaacttcgaaacggtacggttaaggtaacggtgggacggttaacggg

SEQ ID NO: 248975 - DNA, 673 bp, Homo sapiens
  misc_feature: GYAE6OF01D5AL2.35.71.G05.1.454.CMB.1.raw
  modified_base (531)..(531): a, c, t, g, unknown or other
  misc_feature (531)..(531): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagacttttgtgtttctcgtaggctccctgctcagctccgtggggctgctaatgctcgtgggtctctggactccgaggtggggattagttgtgatgactcagtcctccactcctcctcgcccgtccacccgtggacgccggcccggtcctccactcctccgtcgacgtacggttctagtccgacgtaccgtcccttccgtagactaagttaacgtaacgtacggtaacttaacgtaagtttacgttaggtaacgtttcggtaacctgacgtaaggaacgccggtaggactacgtcctaccgaacgtcgtcctacgtgtactttacgtttaaggttttcggttaacttacggtcccgggttcccgttccgggtcctaggtacgttcggttacgnggtcggcgtaggtcgactcgacggtacaacgttacgtttaacttaccgaagtaacgaaactcgaagacggtaaggtaggtacgggagtgttaagggtacggttagtttagggtttacggttaacttttacgcgtgcgtaacg

SEQ ID NO: 248976 - DNA, 561 bp, Homo sapiens
  misc_feature: GYAE6OF01BVOXF.35.71.G05.1.454.CMB.1.raw
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgcccgtcaccccgtggacgacgcccggcctccatcctcctgcaggtctagtcagacgcctctgcatagtatggatacaagttattgattgtactgcagacgcaggcagtcncacngctctgattctagtttggttactagtccggtcccgtccgggtccctgacgtggttcaggtggactagggtcgactcgaggtcaagtagttactttacgactaagaaacttcgaagacgaagggtacggtaggggtacggcgttacgggaggttagtttagggtttagggttaagttttaacgtttagtgggtcttaacgg

SEQ ID NO: 248977 - DNA, 218 bp, Homo sapiens
  misc_feature: GYAE6OF01D7888.35.71.G05.1.454.CMB.1.raw
  modified_base (210)..(218): a, c, t, g, unknown or other
  misc_feature (210)..(218): n is a, c, g, or t
tcagtacagatcgtcacgaccggtgctcgatttagtgtcgtcgcaagagagagggggcacttctccctctaacactctcccctctacaagctcctcggacgttcggccaagggaccaaggtggaaatcaaacgactgtggctgcaccatctgtcttcatcttcccgccatctgaacgatctgtactgagcgggctggcaaggcgcatagnnnnnnnnn

SEQ ID NO: 248978 - DNA, 620 bp, Homo sapiens
  misc_feature: GYAE6OF01DXAUT.35.71.G05.1.454.CMB.1.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctcgtgggtctctggatccaggtggggattagttgtgatgactcagtctccactctccctcgcccgtccaccccgtggacgacgcccggtcctcactcctcctgccnggtctagtcagcgcctccngcatagtanggtatacgaagttattagaagttcgtactgacagaacgccgaggcagtcctccacgacgtcttaccgtgtacttacgtttagtttcgggtttactaacggttcccggggtacccggttcccggggtacccttacgtaaccgtagggtttccgaaggttcggacgtaggttacgggactacggaaggcctaacgtaagtttaacttttacaacttaagaaacttcgagtaaccgaggtaggtagggaggtctagggaggtagttaggttaggttaagtttatacgttgaagtacg

SEQ ID NO: 248979 - DNA, 746 bp, Homo sapiens
  misc_feature: GYAE6OF01BVSYX.35.71.G05.1.454.CMB.1.raw
  modified_base (501)..(501): a, c, t, g, unknown or other
  misc_feature (501)..(501): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtggacgggcgagctcaggactgatcaggactcctctagttccaccttctcaacaatgacggcctccctgctcacgcctccgtggggctgacttaatgtctcgtggtctcgtggactcgaggtgggtatagttgagtatcgactcagtcctccacctcctccctcgtccccgtaccaccccgtggacgaccgcccgtcctcctacttcctccgtgtaccgtaggtacgtacgtcaacgtaccgtcccgtaccgtcgacgtaacgtaagttaagtaggtaactaaaacgtaagtttacgtttaagtaacggtttacgttaaccgtagaccgaagtaaccggacgggtaacggaccgtaacgtacccttaccggaacnccggtacttccggtattacgtttaccgtttagttttacgggtaccgttaacggtccccggggttcccccgttaccgggttaccctacgggttaccgttacggtaccgttacgggtacgtacgagggtttaccggaataccgtaacggtactaacccgttaaaggtttaccttttaaaccgaaagttaaacgtaaaaacgttcgaaacgggaacgttaaggtaacgggttaagggacggttaaagg

SEQ ID NO: 248980 - DNA, 367 bp, Homo sapiens
  misc_feature: GYAE6OF01CQVVF.35.71.G05.1.454.CMB.1.raw
  modified_base (363)..(367): a, c, t, g, unknown or other
  misc_feature (363)..(367): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactgggccagggaaccctgctcaccgtctcgtcagcctccaccaagggccatcggtcttccccctggcgccctgctccaggacgcacctccgagagcacagcggccctgggctgcctggtcaaggactacttccacgatctgtactgagcggctggcaaggcgcatagnnnnn

SEQ ID NO: 248981 - DNA, 807 bp, Homo sapiens
  misc_feature: GYAE6OF01C32G6.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctccgtggggctgactaatcgcttcgtgggtctcgtggactaccgaggtggggtattagtttggtagtaagttcggtaccttcgtaacggttccctaccctacccttcccgttccccgtccgtccccccggtacccgtaccccccgttgggaaccggaccggtccccgggtccccttacctaccgttcccttcccgtacgtaccggtacggtttccgtacggttccgaacggtaccggtcccttccgtcggacctaagttaaagttaacgtacggtaaacttaaaccgttaaagtttaacgttttagtaaacggtttacggttaaccgttaggaacgtaaacgggaacggtacccggaacgggtaccgtacggttaccctaacccgaacgtacgtccttaccgttgtaactttacgtttaggtttcggttaacgttacggttccgggtcccggtttcccgggtacctaggtaccgttacgggttacgagggttacgtacgtagggttacggacgttaccggacgtacgaaacggttagttaactttttaaccgacgtttaaacggaaacttacggaacgtacgtagggtaacggtacgggtacggttaacggg

SEQ ID NO: 248982 - DNA, 644 bp, Homo sapiens
  misc_feature: GYAE6OF01ASO4V.35.71.G05.1.454.CMB.1.raw
  modified_base (325)..(325): a, c, t, g, unknown or other
  misc_feature (325)..(325): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctcgtgggtctctggatccgaggtggggattattggtgatgactcagtcctccactcctcccgtcgccccgtccaccccgtggacgacgcccggtcctccactcctcctgcgtacggtctagtcagacgcctcngacataagtaagtaggaataactaagttagtttagaagttcggtacctgacagaacgccgaggcacgtcnccanacgcctcgtagtacttacgttagtttcggttactacggtcccgggtcccgttcccggggtcctaggtaccgttagggttaccagggtccgtacgtagggtgaacgtcggtaacggcctaagtaacgttaactttaaccgaagtaacgaaaacgtcgaacggacgtaagggaacggtcgggtacggtacgttagggagggttacttagggtttacggttaacgttttaactacgtggcttaaacgg

SEQ ID NO: 248983 - DNA, 652 bp, Homo sapiens
  misc_feature: GYAE6OF01AZZY3.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctctgggtctctggatccagtgggatattgtgatgactcagtctccactcctccctgcccgtcaccccgtggagacggcccggcctccatcctcctgcacggtctacgtacagacgtccctcctgactaataagtaagtaggaataacgtaagttagtttagaagtttcggtactgactaaggaacgccgagggcacgtcctaccactacgccttccgtagtacttacgtttacgttttcggggttaccttaacggttcccggggtccccgtttcccggggggttaccctacgggtaccggttacggttcgtacggtcggacgtaggtcggatcgaacggctaacgtagtttaactttaaccgaagtaacgtaaaacgtcgaaggtacgagggtaggtcgggaggtacgtagggtaaggtgtttacgggttaggttaagttttagtaccgtgtaacgtacg

SEQ ID NO: 248984 - DNA, 644 bp, Homo sapiens
  misc_feature: GYAE6OF01CPZH2.35.71.G05.1.454.CMB.1.raw
  modified_base (363)..(363): a, c, t, g, unknown or other
  misc_feature (363)..(363): n is a, c, g, or t
tcagtacagatcgtcacgaccggtgctcgatttagtgtcgtcgcaagagagagggggcacttctccatctaacactctcccctgttgaagctctttgtgacgggcgagctcaggccctgatgggtgacttcgcaggcgtagactttgtgtttctcgtaggctccctgctcagctcctggggctgctaatgctcgtgggtctctggatccgaggtggggattattgtgatgactcagtctcccactcctccctcgccccgtcaccccgtggacgacggcccggtcctccactcctcctgctaggtctagtcagacgccctctgcaataagtaatggataacaagttatttagaattcggtaccngacagacgccgagggctagtcctaccacgacgtcctccgtgtaactttcgttaagttttcggggttaccttaacggtcccggggtacccgttcccggggtacccttaggtaaccggttacggttacgagggttcggacgtaggttaggacgtacgaacggtactacgtaagtttaacttttacgactaagaaactcgaagtacgtaagggtacggtaggggtacggtcgttaggggaaggttacgttagggtttagggtttagttttaacgtacgtgtacg

SEQ ID NO: 248985 - DNA, 695 bp, Homo sapiens
  misc_feature: GYAE6OF01AMSU5.35.71.G05.1.454.CMB.1.raw
  modified_base (362)..(362): a, c, t, g, unknown or other
  misc_feature (362)..(362): n is a, c, g, or t
  modified_base (686)..(686): a, c, t, g, unknown or other
  misc_feature (686)..(686): n is a, c, g, or t
tcagtacagatcgtcacgaccggtgctcgatttagtgtcgtcgcaagagagagggggcacttctccctctaacactctcccctgttgaagctctttgtggacgggcgagctcaggccctgatgggtgacttcgcaggcgtagactttgtgttttctcgtaggcctccctgctcagctcctggggctgctaatgctcgtgggtctctggatccgaggtggggattattgtgatgactcgagtcctccacttcctccctcgccccgtaccaccccgtggacgacgcccgcctcactcctccgtgcctaggtctacgtcacgacgtccctctgactaatagtaagtggtaaactacgtaaagttntttagaaagtttcggtacctgacaaggacgtccggaaggcctagtcctaccactacgtccttaccgtgtactttacgtttacggtttacgggtttaccttaacgggtcccggggtcccggtttacccggggttccctacggtaccgttaacgggttccgtaagggttacggtcgtaacggttacgggactaccgaacggtacgtaaacgtaacgtttaacgtttaacgaacgttaaaggtaaactcgaacggtacgaagggacggttaggggacgttacgtacgggtaggttaggttgtttaacgggttattttaagtacggtntacgtaacg

SEQ ID NO: 248986 - DNA, 640 bp, Homo sapiens
  misc_feature: GYAE6OF01B58QX.35.71.G05.1.454.CMB.1.raw
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttccaccttctcacaatgaggcctccctgctcagctccgtggggctgctaatgctctgggtcttctggatccgaggtggggattagttggngtatgactnagtctccacttcctccctcgccccgttcaccccgtggacgacgcccgccnccatcctctgcagtctacgtcagcnccgttccngnaacttagtaagtaggtactaagtaagtttacgtttagtaattggtaacctgacgtaagacgccgaggcgacgtcctacccaactacgccgttacctagtacgttacgtttacggttttagggttaccgttaacgggtcccgggtcccgtttacccggggttcccgttacggtacggtacggttccgaaggttcggtacgtaggtacggcgttacggacggtacctaacgtaacgttattaacctaacgtagtaaaacgttcgaacgtacgaacggtaggtagggtaggtacgg

SEQ ID NO: 248987 - DNA, 215 bp, Homo sapiens
  misc_feature: GYAE6OF01ETP73.35.71.G05.1.454.CMB.1.raw
  modified_base (211)..(215): a, c, t, g, unknown or other
  misc_feature (211)..(215): n is a, c, g, or t
tcagtacagatcgtcacgaccggtgctcgatttagtgtcgtcgcaagagagagggggcacttctccctctaacactctcccctctacaagctcctcggacgttcggccaagggaccaaggtggaaatcaaacgaactgtggctgcaccatctgtcttcatcttcccgccatctgaacgatctgtactgagcgggctggcaaggcgcatagnnnnn

SEQ ID NO: 248988 - DNA, 681 bp, Homo sapiens
  misc_feature: GYAE6OF01C7GG8.35.71.G05.1.454.CMB.1.raw
  modified_base (353)..(354): a, c, t, g, unknown or other
  misc_feature (353)..(354): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagtacttttgtgtttctaaaaacgtggcctccctgctcagctccgtggggctgctaatgctcgtgggtctcgtggactccgagggttgggggtaattagtttggtgaagttcggaccttcgacgttccctccctaccttccctcccgtcgccccgtccaccccgtggacgccgcccgcctccatcctcctgctaggtctagtcagacgcctccnnctaagttagtaagtaggaattaacgtaagttatttaggtaacttcggtactgacgagaacgcgaggctagtcctaccacactctacctgtactttcgttagtttcggttactacggtccgggtcccgtccgggtacctcggtacgtacggttcgagggttcggacgtagggtacgtacgtacggtacgtacgtaacgtaacgtttactttaacgaacgttaagaaactcgaaagcgtaaggtaggggtacgggtacggtacggtaagggtaagggttacgtttagggtttaacgggtttattttaaacgttcggtgtacgtaaacgg

SEQ ID NO: 248989 - DNA, 608 bp, Homo sapiens
  misc_feature: GYAE6OF01DVGXJ.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctcccctgccccgtcacccctggacgacgcccggccctccatcctcctgctaggtctagtcagacgcctcctgcatagtaatggatacaagtatttgaattgtacctgcagaacgcgaggcagtctccacagtcctccgtagtacttcttagttttgggttacctaacgtccgggacccgttccggggtccctaggaccgtaggttcaggtgcgtaggtcggtaatcgaaggcctaacgtaggttaactttttaaccgaacgttagaaaaactcgtaagaccgtaagtaagggttcgggaagggtcttcgggaagggttagttagggttttagggttaaacgtttttattacgttaggtccttaaagg

SEQ ID NO: 248990 - DNA, 914 bp, Homo sapiens
  misc_feature: GYAE6OF01AVAUK.35.71.G05.1.454.CMB.1.raw
tcagtacagatcgtcacgaccggtgctcgatttagtgtcgtcgcaagagagagggggtcaggctggaactgaggagcagggtgggggcacttctccctctaacactcctcccctgttgaagctctttgtggacgggcgagctcgaggactgatcaggacctcctcagttccaccttctacaacaatgacggcctcctgctcgagcctccggtcggggtctcgactaatcgtcttcgtcggtctcgtggactccggaggtaggggtattagttgtgtagtcgtacctctacgttcctccctaccttcccgttccccgtccggtccccccgttaccctaccccccgggtacggggtaaccggacccggtcccccggtccctacccttaccgttcccccttaccggtaccggtaccggttaccggttaccgttaccggtaccgaaacggtcccgtaccccttccgtacgtaaccgttaaagttaaacggtaacgttaagggtaaaccttaaacggttaaagttttaacggttttaacggtaaaccggtttaccgggtaacccgttacggaaaccggtaacgggtaccggtacccgggtacggtaccttaacccggttcccaaacccgtcgtaccgtacccgtttaacctagtttaccgttttacccgggttttagggtttacccggggtttaaccgacccggggtttccccggggttaccccgggttttccccgggtaaaccgttaccgggttaaccgttaccggggttaccggaggggttacccggttaacggtagggttaccgggtaaccgcggtaaaccgggtaccttaaagttaaccgttttaacgttaaaccgtaaagaaacgtaaccggtcggtaaacgcggggaaaggttcgggacgggtaacgggtagg

SEQ ID NO: 248991 - DNA, 712 bp, Homo sapiens
  misc_feature: GYAE6OF01AZOQE.35.71.G05.1.454.CMB.1.raw
  modified_base (329)..(329): a, c, t, g, unknown or other
  misc_feature (329)..(329): n is a, c, g, or t
  modified_base (437)..(437): a, c, t, g, unknown or other
  misc_feature (437)..(437): n is a, c, g, or t
  modified_base (698)..(698): a, c, t, g, unknown or other
  misc_feature (698)..(698): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagtactttgtgtttctcgtaggctccctgctcagtcctccgtggggctgactaatcgtctcgtgggtctcgtggactccgaggtgggtattagttgtacgtagtcgtacctcgtacgttcctaccctaccttcccgttcccgtccgtcccccgtacccgacccggtggacgaccggcccggtccctaccncttcccgttaccgtcggtaccgtacggtacgtacgccgaacgaccgtccctcgtacgactaagttaacgtagtagtaactaagtaagttattaggtagttacgtactnaacgaagaccgacggtaggactacgtcctacacgactcctcgtgtaactttcgttagtttacggtacgttaccggtccgggtcccggttaccggtcctaggtaccgtacgttcgacgggttcggacggttacgtggaccggtcgtaaccggtagtacgttaaccgtttagttaacctaaggtaacaaacggttacgaacgaggtaaggtagggtacggaggtacggaggttacggttagttagggttacgttacggtttanacgtgttactaacg

SEQ ID NO: 248992 - DNA, 795 bp, Homo sapiens
  misc_feature: GYAE6OF01DYCTZ.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagcttctttgtgacgggcgagctcaggactgatcaggactcctcagttcaccttctcacaatgaggcctccctgctcacgtcctccgtgggctgactaatcgtcttcgtggtctcgtggtactccgaggtgggtattagttgtagtagtcgtactactacgttcctacccgtacctcccttcccgtccgtccccgtaccgtaccccggtggaacgtccggtccccgtcctcctacgtccctccgtcgacgtcgttacgtacgtcgaacgtccgtccgtaccgtagtacgtaaagttaacggttaaacgtacggtaaattaaaccgttaaggtttaagtttaacgtaacggtttacgttaaccgttacggaacgttaacggaacgtacccggaagggtacctacgtttaccccgaacctacggtaccgttaccttaccggttaagttacgttttacggtttacggttttacgggttaacccgttacgggttcccgggttcccccgggtttaccgggtcctacgggtaaccgttccggggttacgtacgggtaagtcggttaacgtgggtaacctaccggacgttaaaccgtacgtttaacgtttaacctttaacggaaactttaacggaaaactccgggtaaactaccggtaaagggtccggttaagggcggttaacgg

SEQ ID NO: 248993 - DNA, 523 bp, Homo sapiens
  misc_feature: GYAE6OF01B3OAJ.35.71.G05.1.454.CMB.1.raw
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctgggggctgctaatgctctgggtctctggatccagtggggatattgtgatgactcagtctccactctccctgcccgttcacccctgggacgagcccggcctccatcctcctgcaggtctagtcagacgcctccngccatagtaatggatacaagttatttgaattcggtacctgcagaagccgaggcagtctccaangctctgacttnttagtttgggttctaagtccggccgtcgggtcctgcngtcagtgcngtgntcgagcacgtatactttacactagaaactcgagcgaagtagtggaggtcgtagggagtagttggttaggtagttttaatgtgctaacgg

SEQ ID NO: 248994 - DNA, 641 bp, Homo sapiens
  misc_feature: GYAE6OF01BDN86.35.71.G05.1.454.CMB.1.raw
  modified_base (302)..(302): a, c, t, g, unknown or other
  misc_feature (302)..(302): n is a, c, g, or t
tcagtacagatcgtcacgaccggtgctcgatttagtgtcgtcgcaagagagagggggcacttctccctctaacactctccctgttgaagctctttgtgacgggcgagctcaggccctgatgggtgacttcgcaggcgtagactttgtgtttctcgtaggctccctgctcagctcctggggctgctaatgctcgtgggtctctggatccaggtgggatattgtgatgactcagtctccactctccctcgcccgtccaccccgtggagacgcccggcctcatctcctgcaggtctagtcagacncctctgcatagtaatggaatactaagttatttgaagtttcggtacctgacaacggaagccgagggcacgtctaccacgacgccttcctagtacttacgtttagttttcgggttacttaacgtcccggggtcccgttcccgggggtcccctaggtaccgtacgggttccagggttcggacgtagggttcggaacttccggaggtacctaacgttaaggtttaacttttaaccgaactttaaggaaaaacttcggaacgtaccgtaagggtagggtggggacggtacgtagggtaacgggtagttagggttacgggtttaacttttagtacgtgtataacg

SEQ ID NO: 248995 - DNA, 770 bp, Homo sapiens
  misc_feature: GYAE6OF01EQ1VO.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggcctccctgctcagcctccgtggggctgctaagtgctcgtgggtctcgtggactccgaggtgggattagttgtcgtatcggtacctcgtacgtccctacctaccttcctccccgtcgtcccccgtacctaccccgtgggaacggccgccccggtctaccctcgtttcccgtaccgttcggtaccgtaaggtttccgtaacgttaccgaggtacccgtccccttccgtaagacgtaaacgttaggttaaacgtggtaaacttaaacgtaaagttttacgtttagaaacgttttcggttacctacggaacgtaagggtaacccggccggtaaacgggtctaaccgttccgtaacccgtaaacgtactaccgttccttacgtaacgtttcgtttaggttttacggttaccgtaacggttccccgggtaccggtttccgggtaccctgggttaacgtcggttacggtacgggtacggttgtaagggttccgacgggttacaacggtaccaacggttaacgtttaacgtttactaaacggaaagtaaacgtcccgtaagggaacgtaagggtaccggtagggttccggtaaggg

SEQ ID NO: 248996 - DNA, 644 bp, Homo sapiens
  misc_feature: GYAE6OF01EG2T2.35.71.G05.1.454.CMB.1.raw
  modified_base (335)..(335): a, c, t, g, unknown or other
  misc_feature (335)..(335): n is a, c, g, or t
  modified_base (637)..(637): a, c, t, g, unknown or other
  misc_feature (637)..(637): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccaggtgggattattgtgatgactcagtctccactcctcccgtgccccgtccacccccgtggacgacggcccggccctccacttcctcctgcaggtctagtcagacnccctctgcaagtagtaatggaataactaagttatttagaagtttcggtacctgacgtaagaacgccgtaaggggcctacggttacctacccgaacgtacgtccgttcccttaggttacctttacgttttaagttttcggggttaccttaacggtcccggggtacccgttccccggggttcccttagggaaccgttagggttccagggttcggcgtaggtggacttacggacggtaccgaacgttaagtttaacttttaacgacgttaaacgtaaaattccgagtacgtaaggaggtacgggnggtacgg

SEQ ID NO: 248997 - DNA, 723 bp, Homo sapiens
  misc_feature: GYAE6OF01B9E31.35.71.G05.1.454.CMB.1.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (708)..(708): a, c, t, g, unknown or other
  misc_feature (708)..(708): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagtactttgtgtttctcgtaggctccctgctcagctccgtgggctgctaatgctcgtggtctcgtggactccgaggtgggattagttgtgatgactcagttcncctactcctccctgccccgtccacccgtggacgcgcccgtcctcgtactctcgcgntacggtctagtcngacctcctcgtagcaagttaacgtaagtggtaactaacgtaagtttagttagtaacggttcgtactaggacaacggtaacgccggtacgggtactacggtccctaaccccgagtacgtacccttccggttagttacctttacgtttaacggttttaccgggtttaacgttaaccgggttcccggggtccccggtttacccggggtacccggttacggtaaccgggttacgggtttaccggtaacgggttcgggtaacgtacgggttacgggtaacgtacggaaccggtacgtaacggttaacgttaacgttttaacgacgttaagtaaacgtacgaaggtcgaaacgggtggtacggtagtacggttggtaagggttctaagggtttcgtaagtttntacgtgtacgtaacg

SEQ ID NO: 248998 - DNA, 707 bp, Homo sapiens
  misc_feature: GYAE6OF01D5TU6.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctcgtgggtctctggatccaggtgggatattgtgatgactcagtctccactctccctgcccgtccaccccgtggacgacgcccggcctccatcctcctgcgaggtctagtcagacgtccctccgtgcaattagtaactggaataacaagttactttagaatttcggtacctgacaagaacgcccgagggctacgtccaccaacgacgtcctaccgtgtaacgttctttaggttttcggttaaccgttaaacggttcccgggtacccgttcccgggggtaccccttaggaaccggttacgggttccgtaacgggttcgggtacgtacgggttacgggtaacgttaccggaacgggtacccgtaaacgttaacggtttaaaccttttttaaccgaaacgtttaacgaaaaacgttccgaacgtaaccggtaaggtaccgggttaggggacggttcggtagggaacggttagttacgggtttagggttaaacgttttaagttacgtggtacgttaaacgg

SEQ ID NO: 248999 - DNA, 647 bp, Homo sapiens
  misc_feature: GYAE6OF01EGKIH.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagcttctttgtgacgggcgagctcaggactgatcaggactcctcagttcaccttctcacaatgacgcctcctgctcagcctccgtgggctgctaatcgctcgtggtctctgactccgaggtggtatagttgtagatgactctagtcctcctactcctcccgtcgccccgtcaccccgtggacgaccgtccgcctcactctcctgcacgtctagtcgagccgtcctctgactaatagtaatgaactaacgtaagttacttagacgttacggtactgacgagaacgaccggacggactacggttacctaccacgtcgtacctcgtagttactttacgtttaggttttacggtaccttaacgggttccccgggttacccggttcccggggtaccttaacgggaccggtttacggttaccgtaacgggttcggacgtagggttacggtacgtaccgacggtacgtaacgttaacgtttactttaaacggacgtaaacgaacctacgaacgtacgaaggtcggtaggcgtaacgg

SEQ ID NO: 249000 - DNA, 692 bp, Homo sapiens
  misc_feature: GYAE6OF01EACC5.35.71.G05.1.454.CMB.1.raw
  modified_base (218)..(218): a, c, t, g, unknown or other
  misc_feature (218)..(218): n is a, c, g, or t
  modified_base (655)..(655): a, c, t, g, unknown or other
  misc_feature (655)..(655): n is a, c, g, or t
  modified_base (681)..(681): a, c, t, g, unknown or other
  misc_feature (681)..(681): n is a, c, g, or t
tcagtacagatcgtcacgaccggtgctcgattttagtgtcgtcgcaagagagagggggtcaggctggaactgaggagcagggtgggggcaccttctccctctaacactctcccctgttgaagctctttgtgacgggcgagctcaggactgatcaggacctcctcagttcaccttctcacaatgaggcctccctgctcagcctccgtgggctgctaatnctcgtggtctctggtatccgaggtgggattattggtagatcgacctgacgtcctccctactccgtccctccgcccctccaccccgtggacgacgccccgtacctcgactctccgtcgcgtacggtcttagccgacgtacgtcccctaccgtagactaagtaaggttaagtagggtaaacttaacgtaagtttacgtttaagtaacggtttacggtaaccgtcgaacgtagggtaacgccccggtaggggaccctaacggttccctacccaacggtacctcccgtttacctagttaccgttttaaccgttttagggttttcgggtaaccttacggggttcccccggggtacccggttcccgggtacctagggtacgttacgtagcggttcgaggtcgtaagcacggacgacgtaagttagtactttaaccgagtaaanaaacgtcgtacgacggaggttacggngggtagtacgg

SEQ ID NO: 249001 - DNA, 695 bp, Homo sapiens
  misc_feature: GYAE6OF01ATP00.35.71.G05.1.454.CMB.1.raw
  modified_base (410)..(410): a, c, t, g, unknown or other
  misc_feature (410)..(410): n is a, c, g, or t
  modified_base (454)..(454): a, c, t, g, unknown or other
  misc_feature (454)..(454): n is a, c, g, or t
tcagtacagatcgtcacgaccggtgctcgatttagtgtcgtcgcaagagagagggggcacttctccctctaacactctcccctgttgaagctctttgtgacggcgagctcaggccctgatgggtgacttcgcaggcgtagactttgtgtttctcgtaggctccctgctcagctccgtgggctgactaagtgctcgtggtctgtggactccgaggtgggattagttgtgatgacctcgacgtcctcctacttcctcccgtcgtccccgtaccacccgtgggaactacggccggccctcctactcctccgtagccgtaggtaccgtagtacgacgtaccgtccctcgtagtactaaggttaagtaacgtacggtaataaacgttaagttatttacgtaaacgttcgtaaccnggacgaaggaacgccgaggctacgtacctacactcgcttacgtntacgtctttaggtttcggtacgttaacggtcccgggtccggttacccgggtacctacgggtaacgttacgggtacgtagggtaccgtaggtacgtaccggtagtaccggacgtacgtaacgtaagtttaactttaacgaagttaacaaacgtcgaacgtagaagggtacggtacggtacggtacggtaagttacgggaagtttaggttaacggttaatttacggtacttaggacttaacgg

SEQ ID NO: 249002 - DNA, 618 bp, Homo sapiens
  misc_feature: GYAE6OF01AQQJ6.35.71.G05.1.454.CMB.1.raw
  modified_base (607)..(607): a, c, t, g, unknown or other
  misc_feature (607)..(607): n is a, c, g, or t
  modified_base (612)..(612): a, c, t, g, unknown or other
  misc_feature (612)..(612): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgagtgggtgacttcgcaggcgtagtactttgtgtttctcgtaggcctccctgctcagctcgtgggctgactatgctcgtggtctcgtggactcgaggtgggtatgttgtagatcgactcacgtcctaccacttcctcctcgccctccacccgtgacgacgccgcctcacttctccgtgactcggtctacgcgaacgcgtccctacagactacgtaagtacgtagtaactaacgtaaagtttacgttagtacgttcgtacctagagtaacgacgaccgaagtaccgtactccaaccgactacgtcctacgttacgtacttacgttgttttacggtaacgttacggccgttaccggtccggtacagtacggtagtacgtagtcgacgtagtccgagtaccgcgactacgtagttacttacgaacgtaacaactcgagtaccgaaggtacggcggagtcgaggtaagtgttagggtacttaagttacgtacncggtnttaacg

SEQ ID NO: 249003 - DNA, 827 bp, Homo sapiens
  misc_feature: GYAE6OF01BYXU1.35.71.G05.1.454.CMB.1.raw
  modified_base (780)..(780): a, c, t, g, unknown or other
  misc_feature (780)..(780): n is a, c, g, or t
tcagtacagatcgtcacgaccggtgctcgatttagtgtcgtcgcaagagagagggggtcaggctggaactgaggagcagggtgggggcacttctccctctaacactctcccctgttgaagcttctttgtgacgggcgagctcaggactgatcaggactcctcacgttcacccttctcaacaatggaggcctcccgtgcctcacgcctccggtggggctgacttaagtgtccgttcgttgggtcctcgtaggtactccgagggtaggggtattagttgtagtagttagacgttcgacgttcctccctacctcccgtccctaccggtacccccgtacccgaccccggtggaccggtaccggtccccgtccctaccgtaccgttccgtccgtcggaccgtacggttactacgtacgacgtccgtcccttccgtagtacctaagtaagttaacgtacggtaacttaaacgttaagtttatttacggtaacgtttcggttaccgagtaaccgaggaaccggccggtacgggtacctaaccgtcctaaccccgacgtacgttcccttcgtacgttaactttaccggtttacggttttaccgggttaacccgtacgggttccccccggggtaccgggtttaccccggggttaaccttgggtaacccggtttacggtacgggttaccggttaccgggtacgttaaccgggtcgggtaactacccgggtacgtaaccgtaaccgttaagtttaaccggttaaaccctaaagggtaacgttaaaacccgngtaaccggtaaacgtaaggggtttacggtacgggtaaggttaacggg

SEQ ID NO: 249004 - DNA, 743 bp, Homo sapiens
  misc_feature: GYAE6OF01AXFP6.35.71.G05.1.454.CMB.1.raw
  modified_base (321)..(321): a, c, t, g, unknown or other
  misc_feature (321)..(321): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctccgtggggctgctaatgctcgtgggtctcgtggatccgaggtggggtatattgtgatgactcagtcctccactcctcccgtcgccccgtccacccccgtggacgacggcccgcctcactcctccngcagtctagtcagacgtcctcctgactacgttaagtaatggaactaacgtaagttagtttagaagtttcggttacctacgtacgtaaggaacggaccgacggggtaacctacggttaccctacccgtaaccggacgttacccttccggtacgtaaccttttacggttttaacggttttttcggggttaccctttaaacggggttccccgggggtttacccccgggttttcccggggggtaaccccctttagggaaccccggtttacggggtttaaccggtacggggtttacggtaccggtagggttacgggaacgtccgtaaacgggacctacggttaaacgttaacttttaaccgaaacgtttaacgtaaaacgtaccgtaaacggacgtaaagggtagggttacggggtaaggtacgggg

SEQ ID NO: 249005 - DNA, 799 bp, Homo sapiens
  misc_feature: GYAE6OF01BZMSX.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagtactttgttgtttctcgtaggcctccctgctcagcctcgtgggctgactaatgctcgtggtctcgtggactccgaggtgggattagttgtgatgactcgtacgtcctccacctcctcccgcgtcccctaccgaccccgtaggacgaccggccccggtccctacctacttcccgtccctacggtaccgtacggtacgtacggtccgaagtcccgtcccttccgtacggtactaagtaaaggtaaggtaggtaaactaacgttaaagtttatttaaggtacgtttcgtaaccgtgtaaacggtaacggaacggcccggtaaggtcctacgttacccgtaacctaccgtactcccgttacgttacgttaacgtttaccggttttaagggttttaccgggttaaccgttaacccgggtccccgggttacccccggggttccccgggttaccgttaccgggtaaccggtttcgggtaccggtacgggttacggtaccggttaggtaaccggttcgaaccggtaacggtacgtaacggttaaactttaacgttacgtaaacgaaagttaaactcggaccgtaggtaaggtaccgggtagggtaacgtggttaggaacggttgttacgggtttagttaagtttacggtactcggttaagtaaccg

SEQ ID NO: 249006 - DNA, 623 bp, Homo sapiens
  misc_feature: GYAE6OF01DPVF3.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagtactttgtgtttctcgtaggctccctgctcagctccgtggggctgctaatgctcgtgggtctcgtggatccgaggtgggattagtgtgatgactcacgtctcctactcctcctcgtcccgtaccgaccgtggacgaccgcccgtacctacctctcctacgtcgtacgtaggtacgtagacgacgtaccgtcctacgtgtactaataagtagtagtactaagtagttagtagtagtacgtactagacgaagacgacgtagtactacgtccacacgcgtctcgtactacttcgtttagtttcggtacgtacggtccggtaccgtccggtccgtacgtacgtacggtacgtaggtcggagtacggtagacgtacgacgtaactaagttagttaacttacgtaagtaacgtaacgtacgagaggtaagtacggtaggtagtacggtaggtaggtagttaggttagttaacgttagtagcgtagtaa

SEQ ID NO: 249007 - DNA, 649 bp, Homo sapiens
  misc_feature: GYAE6OF01A83TY.35.71.G05.1.454.CMB.1.raw
  modified_base (89)..(89): a, c, t, g, unknown or other
  misc_feature (89)..(89): n is a, c, g, or t
  modified_base (254)..(254): a, c, t, g, unknown or other
  misc_feature (254)..(254): n is a, c, g, or t
tcagtacagatcgtcacgaccggtgctcgatttagtgtcgtcgcaagagagagggggcacttctccctctaacactctccctgttgaanctcttgtgacgggcgagctcaggccctgagtgggtgacttcgcaggcgtagtactttgttgtttctcgtaggcctccctgctcagctccgtgggctgtctaatgctcgtggtctgtgatccgaggtgggtattagttgtgatgactcagtcctccactcctcccncgtccctccacccgtggacgcgccgcctctactcctctcgctcgtctacgtcacgcgcctctgactataagtatacgataatagttattagtactcgtactgacagagccggaggcctacgtccaccacgtcgtcctacgtgtacttcgttaggtttcggtactaccgggtcccgggcccgttcccgggtacctaggtacgttacggtcgtagtcgggtacttagggcgtaactcggaagtccaaggttaaacttttaccgtaacgtaactaagtaaactcggtaaacggaggtaacggggtaaggtacgggtacgggttacgtaagggttaacggtttcgggtttaaagggtttaccggtttaaaggtttaacgttcgaaggttaacgtaaacg

SEQ ID NO: 249008 - DNA, 220 bp, Homo sapiens
  misc_feature: GYAE6OF01ECYY5.35.71.G05.1.454.CMB.1.raw
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (208)..(220): a, c, t, g, unknown or other
  misc_feature (208)..(220): n is a, c, g, or t
tcagtacagatcgtcacgaccggtgctcgatttagtgtcgtcgcaagagagagggggcacttctccctctaacactctcccctctacaagctcctcggacgttcgcaagggaccaaggtgaaatcaaacgactgtggctgcaccatctgtcttcatccttcccgcatctagaacgntctgtactgagcgggntggcaaggcgcatagnnnnnnnnnnnnn

SEQ ID NO: 249009 - DNA, 682 bp, Homo sapiens
  misc_feature: GYAE6OF01A3Z01.35.71.G05.1.454.CMB.1.raw
  modified_base (370)..(370): a, c, t, g, unknown or other
  misc_feature (370)..(370): n is a, c, g, or t
tcagtacagatcgtcacgaccggtgctcgatttagtgtcgtcgcaagagagagggggtcaggctggaactgaggagcaggtggggcacttctccctctaacactctcccctgttgaagctctttgtgacgggcgagctcaggactgatcaggacctcctcagttcaccttctcacaatgaggcctcccgtgcctcagcctccgtggggctgtctaatgctcgtggtctcgtgactccgaggtgggtattagttgtgatcgactctagtcctccactcctcccgtacgccccgtccaccccgtgggacgaccggcccgtaccctccgtactcccgtccgtgccgtcgtactacgtcgaacgccgtcctcgngtactaagtagtaacgtagtaacttaacgtaagtttagttaagtacgtttacggtacctagacgaacggaccgaccgtaggtactaacggtcctaacccgaccgttgccctttacgtagtttaaccgtttacgtttacggttttcggtaccttaccgggttcccggtaccccggttccgggtccctaggtaccgtacggtcgtaggttacgcgttaggtacgcgtacggaacgtcgtaacgttacgttaccgtttaacgaacgttaagaaaccttgaaacggtacgaaggttcgggagggtccgttaaaggg

SEQ ID NO: 249010 - DNA, 947 bp, Homo sapiens
  misc_feature: GYAE6OF01CUDJO.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagcttctttgtggacgggcgagctcgaggactgatcgaggacctcctcgtaacgtttccaccttctcaacaatggacgcctcccgtgtcctcgacgtccgtccggtggggtctcgtaccttaagtcgtccgtcgttgggttcctcggtagtacgtaccgtaagggtggggtaagtttagtttgtagtagtacgtactccgtaacgttcctaccctaccttcccgttcccgtccggtccccgtacccgacccccggtagggacggcccggtccccgcccttaccgtcctaccttccgtcgtacgtacgttacgtacgaccggtacgtacccgtccttaccgtataaccgttaaagtaaggttaacggttaacggtaaacgttaaacgtaagtttttaaaccggtttaagttaaacggtttaccggtaacccgtacgggtaacgaaaccgggttacccgggaccggtaacggggttacccctaaccgttacccccgacccgttaaacggacccgttacccgttaccgtttaacggttacgttttttaacccgggttttacgggtttttaacgggtttacccgttaacccgggttccccggggggtttaccccgggttacccccggggttcctaaacggttacccgggtttaggggttaccgttacggggttcgggtaacggttaccgggttaacggaaccggttaccggacccggggttaaacaccggttttaaacgtttaaacgtttaaaccccgaaagggtttaaaacccaacgggttaggaaccgggtaacggttaaggggtaacgggttcgggggtaacttaacgggg

SEQ ID NO: 249011 - DNA, 878 bp, Homo sapiens
  misc_feature: GYAE6OF01DJ31R.35.71.G05.1.454.CMB.1.raw
  modified_base (105)..(105): a, c, t, g, unknown or other
  misc_feature (105)..(105): n is a, c, g, or t
  modified_base (162)..(162): a, c, t, g, unknown or other
  misc_feature (162)..(162): n is a, c, g, or t
  modified_base (351)..(351): a, c, t, g, unknown or other
  misc_feature (351)..(351): n is a, c, g, or t
tcagtacagatcgtcacgaccggtgctcgatttagtgtcgtcgcaagagagagggggtcaggctggaactgaggagcgagggtggggcacttcctccctctaacnctcctccctgttgagtcttctttgcggacgggcagctgaggctgactcagactcctntacgttcctaccttctaccaaatagtcggacggtccctcccgtgtctccgacgtcccgttcggtacggggcttagtacctagtcgtcgttcggtacgggttcctggtacgtaccgtcggtagggtagggtatttaggtggtagtaacgtcggtactacgtcctccttacctaccttccgtcccgtaccnccccgtaccgtaccgggtggaaccgtccgtccccgttacctaccgtccttcccgtcgttacgaccggttacggttacctacgtaccgggactcccctccggttactaacggtaacgttaaagtttaagaccgggttataaaccggttaaagtttaacgggtttaagttttacgtaaacgggtttccggaaaccgtttaccaaaggggttaaccggaccggtaaccggggtaccgttaaccggtaacccgttaccccgtaaccgttaccggaacccgtttccgtttaaccgtacgtttaacgtttacgggttttaacggtttacgggtttaccccggttaaccggggttcccggttaccccgggttacccgggttccgttaacgggtaaccgttaccggggtacggacggttccgagggttacgtacggtaacgtacccggacgtaagttaaccgttaacggttaaacctacggtaacgtaaacgtacacccggtataaccgggagggttcggaacggtaggtaaggg

SEQ ID NO: 249012 - DNA, 697 bp, Homo sapiens
  misc_feature: GYAE6OF01EMSQY.35.71.G05.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (368)..(368): a, c, t, g, unknown or other
  misc_feature (368)..(368): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggcctccctgactcagcctcgtggggctgctatncgtcgtggtctcgtgactcgaggtgggattgtgtagntgactctacgtcctcctacctcctcccgtcgtcccctccaccccgtggacgaccggcccgccctccacttccgtacctggccgtacggtctacgtaccgaagtcccgtccttccgtnacctaagtacgtaagtgtaacttaaacgtaagtttacgttagtacgtttggacctgacgtaggacgccgtaggactactccgaccaacgtcgtactcgttagtacttacgttttaacggtttacgggtttccgtaacccgggtttcccggggtacccggttccccgggttacccttagggttaaccgttccggttacgtaacgggttcggtacgttagggtttaccgggacgttaccggtaaaccgtcgttaaaccgttaggtttaacccttaacgtaacgtaaacggttaacgacgtgtaacggaagggttacgtgggtacggttagg

SEQ ID NO: 249013 - DNA, 818 bp, Homo sapiens
  misc_feature: GYAE6OF01BDY6U.35.71.G05.1.454.CMB.1.raw
  modified_base (809)..(809): a, c, t, g, unknown or other
  misc_feature (809)..(809): n is a, c, g, or t
tcagtacagatcgtcacgaccggtgctcgatttagtgtcgtcgcaagagagagggggcacttctccctctaacactctccctgtgaagctctttgtgacggcgagctcaggccctgagtgggtgacttcgcgaggcgtagtactttgttgtttctcgtaggcctccctgctcagtcctccggtggggctgtctaatcgtctcgtgggtctcgtggactcgagggtgggtattagttgtgatcgtactcgtcgtcctacctccttccctcccgtccgtaccccgttacccgacccggtagggaccggccggccccggtaccctccaccttcctcccgtagtccggtacggttacctaaggtccgtacgcccgtcccgtcttaggaacctaaggttaagtaacgtaacggtaaacttaaacggttaagtttagtttaacggtaacgtttaccggtacgtacggaaacccgtaagggaaccggaccgggtaacggtcttacccgttaccgaaccgtaaacgtccggtttaccttaacgtttaccgttaacgtttttaccgggttttacgggttttaaccgggttaaccccgttccgggggttcccccggggtacccccggggtttacccgggttaaccgtacgggttaaccgggttcgttaccgggtaccgggttgaacgggtacgtcgtaacgtcggaacgttcgaatttacgttacttaacgagtaaaacgtctgacggtagtaacgggagggtccgtaggtagtggggaattccgggtttagttaacgggttctttaaagcgtaacggngttaaaacg

SEQ ID NO: 249014 - DNA, 833 bp, Homo sapiens
  misc_feature: GYAE6OF01BK3GQ.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactcctcccctgttgaagcttctttgtgacgggcgagctcaggactgatcacggacctcctctacgttcctacctttctacactaagtcgacgtcccttcccgtcgtcctccgcgtccgttcccggtggggtctcgtacttaagtcgtccttcggttgggttccttcgtaggtaacctcggtaagggttggggtaattagttggtagtacgttcggtacctacgtacgtcccttacccgtaccttcccgtcccggttccgtccccgtaccccgtaaccccggtcgggaccgtaccggtccccgtaccctcctaccgttccgccgttcgacgtacgtcgtacgtcgacgtaccgtccctacgtcgactaagtaacgtagacgtataagttaacgttatttaacgtacggttcggtaaccgtggaacgaacgggaccgtacggacgtacgtaccttccaccgtaacgtcgttaaccgtccttagtttcgttacgtttacggtttacggttaccgtacgggtaccccggtcccgggttaccgtccgtaagttcggtccggtacgtagggtacccggttagacggttacggtaaccggtaggtaccgtaaacccgtttaggttaaaccgtttaacccgtttaaaggtaaacggttaaacccgtaaaaacccggtggttaaaccggtacggggttaacccggggtagggttaaaacccggttcgggttaaaggggg

SEQ ID NO: 249015 - DNA, 688 bp, Homo sapiens
  misc_feature: GYAE6OF01BAEXZ.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagcctccgtggggctgacttaatgtcctcgtgggttctcgtaggactccgaggtgggtatattgtgatgactctagtcctccactcctccctcgccccgtccaccccgtggacgaccgcccggcctccacttcctccgtgccgtaggtctagtcacgacgtccctctacgactaagtagtaaacgtaggtaacttaacgtaaaggtttacttttaaggtaacgttttacggttacccgtaggtaccgtaagggaaccggtaccggtaacggggccttaacgtaccctaccccgaactacgtccttaccgtagttacctttacggtttaggtttttcgggtaccgttaacggttccccggggtccccgtttaccggggtccctacgtaaccggttaggttccgtagggtcggtacgtaggtcggtatccgaggcaacggttagttactttacagttaaacgaacgtacgaacgacgaagggtcgggaggtcgtaggg

SEQ ID NO: 249016 - DNA, 740 bp, Homo sapiens
  misc_feature: GYAE6OF01A3EFC.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcgaggactgatcgaggactcctcagttcaccttctcacaatgagcctcctgctcagctccgtgggctgctaatgctcgtggtctcgtggactcgagggtgggtattagttggtgtatagtacctcgtacgtcctccctacctcctcccgtccgtccccgtccgaccccgtggacgccggcccgtccctcctacttcctccgtgtaccgtaggtctacgtacacggacctcccgtacctcgactaagtaaggtaactacggtaactaacgtaagtttagttagtaacgttcgtactagtacgaagacgcggacggtctacgtaccaccgaacgtctaccttccgtagttaacctttggtttacggttttacggtaaccgttacccgggttcccggggtaccccgggtttcccggggttacccttaacggtaaccgggtttaccgggttacggtacgggttaccggtaggttacggtaacgggttaccgtaacggaccggttaacgtaacgggtttaactttaacccgtttaaacgaacgttaaaacgttaaacgtaccggtacggaaaggtaacggggtcgggttaagggtcgggtaacggg

SEQ ID NO: 249017 - DNA, 865 bp, Homo sapiens
  misc_feature: GYAE6OF01B4TS5.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagcttctttgtgacgggcgagctcaggactgatcaggacctcctcagttccaccttctcaacaatgacggtcctccctgtcctcacgtcctccggtggggctgctaatcgtctgtggtctcgtgactcgagggtggtattagtgtgatcgactcacgttccacctaccgttcctcccgtaccgccccgttacctaccccgtagggacggaccggcccgtacccctccgtaccttccgttaccgtggaccgttagttaccgtacgtacgtacgtcccgtaccctcgtacgactaacgttagtaagtaacggtaacttaaacgttaagttttacgtttaagtaaaccggtttcggtaccgtaagtagaaccggacgttaccggacgtctacggtttacccaacgtaaccgcgttacccgttacgttaattaccggttttacggtttaacggttttcgggttaaacccgtttacccggggtccccggggttaccccgggttaccccggtccgtttaaacgggtaacccggtttacggggtttacccgtaggggttacccggtaccgggtttaacggggtaacgttaacccgggcggtttaaaccggaaaccccggtttaggtttttaaacccggttttaaaaaccggtttaacccgttaaaacgttaaaaacggtaaccccgggttagtaaaaacccggggttaggggaaacggggtttaccgtaagggggtaacccgggttttaaagggg

SEQ ID NO: 249018 - DNA, 568 bp, Homo sapiens
  misc_feature: GYAE6OF01A12WH.35.71.G05.1.454.CMB.1.raw
  modified_base (375)..(375): a, c, t, g, unknown or other
  misc_feature (375)..(375): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctctgggtctctggatccagtgggatattgtgatgactcagtcctccactctccctgcccgtcaccccgtggagacgcccggcctccatcctcctgcaggtctagtcagacgcctcctgcatagtatggatacaagttatttgaatttcggtaactgactagagccgaaggctagtcctcgacncgctcctagtattcttagtttcggttctaacggtccgggtacccggttcccggggtccctcggacgttacggttcgtaggtacggcgtacggtggtactcgacggcacgtagttactttacgactagaaactcagcaggtagtacggaggtagtcggagtagttaggttaggtaactttagtactgtacgtag

SEQ ID NO: 249019 - DNA, 662 bp, Homo sapiens
  misc_feature: GYAE6OF01BI47D.35.71.G05.1.454.CMB.1.raw
  modified_base (653)..(653): a, c, t, g, unknown or other
  misc_feature (653)..(653): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgagctccctgctcagctccgtggggctgactaatgctcgtgggtctcgtggactccgaggtcggggattagttgtcgtatgacctcgacgtcctacctactccgtccctcgccccgtccaccccgtggacgaccgccggtccctaccacttccctcgtcgaccgtacggtcgtacgtcgacggacgtcccgttcctacggactaacggttaacgtaacgtagggtaacttaacgtaaagtttaagtttacgtaacggttcggtaacctgaccgaaggtacgccgtagggcctaacggttcccacgacgtaccggtccttcgtacgttacttacggttagttttacgtaccggtaagttccccggggacccgttcccgggtcctaaggccgttaggttacgacggttgacgtaaggtgactacgcggtacaggttacttaactttacgacgtaacgtaatcgacgtagaagtgggnggtatacgg

SEQ ID NO: 249020 - DNA, 760 bp, Homo sapiens
  misc_feature: GYAE6OF01BFH3Y.35.71.G05.1.454.CMB.1.raw
  modified_base (129)..(129): a, c, t, g, unknown or other
  misc_feature (129)..(129): n is a, c, g, or t
  modified_base (211)..(211): a, c, t, g, unknown or other
  misc_feature (211)..(211): n is a, c, g, or t
  modified_base (710)..(710): a, c, t, g, unknown or other
  misc_feature (710)..(710): n is a, c, g, or t
  modified_base (728)..(728): a, c, t, g, unknown or other
  misc_feature (728)..(728): n is a, c, g, or t
tcagtacagatcgtcacgaccggtgctcgatttagtgtcgtcgcaagagagaggggtcaggctggaactgaggagcagggtgggggcacttctccctataaccactcctccctgttgaatcttctttgngacgggcagctcgacggactgatcgaggtaccttcctctacgtttccacctttctacactaagtgacgcctcctagcgtacngtccgtccggtggggtctcgtacgtatcgtctcgtcggttcacggtggtactcggaaggttgggtatttattggacgtagtcgtacttacgtacgttccctaccctcgtccttcccgtccgtccccgtccgtaaccccgtggaacggtcccggccgtacccgtacctccttccctccgtcggtacgttacggttaccgttacgtacgacgtaccgtccctcgttacgacgttaagtaacgtatcgtaaacgtaagttacttaagggttctaaagggttttccgactttacgaacgtaggaaaccggtcgtaaacggtccgtaacgttaccacgtaccggtaactaccgtttacggtacttaccttacggttttaacggtttaaccgtttcccggttaaccggggttccccgggtcccgttttaacgggccgtaacgtcggtacgttcggtaggtcgtaaggtcgaacggcctaggtcgtaaccgttgtaaacccggttntaaactacgtagtaaccncgttaacgccggtaagtcggtaggtaggtacg

SEQ ID NO: 249021 - DNA, 694 bp, Homo sapiens
  misc_feature: GYAE6OF01BY8JI.35.71.G05.1.454.CMB.1.raw
  modified_base (174)..(174): a, c, t, g, unknown or other
  misc_feature (174)..(174): n is a, c, g, or t
  modified_base (648)..(648): a, c, t, g, unknown or other
  misc_feature (648)..(648): n is a, c, g, or t
  modified_base (683)..(683): a, c, t, g, unknown or other
  misc_feature (683)..(683): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcgaggcgtagtactttgtgtttctcgtaggcctccctgctcngctccgtggggctgctaatgctcgtgggtctcgtggactccgaggtgggattagttgtgatgactcagtcctccacctcctcccgtcgtccccgtccacccgtgggacgacggcccggtccctcctactcctccgtcgaccgtacgggttacctaacggtccgacggaccggtccccttaccgtcgacttaagtaagttaagtggtaataacgttaagttatttacggaaagttcggttaacctaggaacgtaacgaacggaccggtaagggacctacgtccctaccaaacgtcgtaccttccgtagtactttacgtttaggttttacgggtacttaacgggtcccggggtcccgttcccggggtacctggtaaccggttaggttcgagggtcgacgtagggtcgaacgtcgacggtacaaggtactttacttaacgactaaagaacgtcgagacgaaggtagtcgggagttanacggtaggtgttacgggttagttaactttagtacnggtaataacgg

SEQ ID NO: 249022 - DNA, 663 bp, Homo sapiens
  misc_feature: GYAE6OF01A6IE7.35.71.G05.1.454.CMB.1.raw
  modified_base (205)..(205): a, c, t, g, unknown or other
  misc_feature (205)..(205): n is a, c, g, or t
  modified_base (374)..(374): a, c, t, g, unknown or other
  misc_feature (374)..(374): n is a, c, g, or t
  modified_base (469)..(469): a, c, t, g, unknown or other
  misc_feature (469)..(469): n is a, c, g, or t
  modified_base (599)..(599): a, c, t, g, unknown or other
  misc_feature (599)..(599): n is a, c, g, or t
  modified_base (608)..(608): a, c, t, g, unknown or other
  misc_feature (608)..(608): n is a, c, g, or t
  modified_base (627)..(627): a, c, t, g, unknown or other
  misc_feature (627)..(627): n is a, c, g, or t
  modified_base (656)..(656): a, c, t, g, unknown or other
  misc_feature (656)..(656): n is a, c, g, or t
tcagtacagatcgtcacgaccggtgctcgatttagtgtcgtcgcaagagagagggggtcaggctggaactgaggagcaggtgggggcacttctccctctaacactctccctgttgaagtcttcttgtgacgggcgagctcgagactgatcgaggacctcctactagttccaccttcctacaactaaagtggacggtccttcccgngccttcgacgtccgtccggtggggctacgtaccttagtcgtcttacggtgggtcctgtcggtactcgtagggtgggtattagtgtacgtagtcgtaccgtctaccgtcctaccgtacctcctcccgtcgtacccggttcccaccgtgggaccgccgacccgtccctacntcccgtgcgtaacggccgtttagacgtcgaagtccgccctgcgtataaggtactagaccgtaattacgtaagttcgttaacgtagttccgacgtnacgaggtccgaggtcgacgtcgtacctacgacgcgttactcgtacgttcgttaagttttaccggttacggttacgtccggtcccggtaccggttccggtacgttacgtcgttagggtcgtaggccgtagnggaccgtgngactagacgtcgtacttanacgtactagccgatacggaggtcgtaggnggtaacg

SEQ ID NO: 249023 - DNA, 877 bp, Homo sapiens
  misc_feature: GYAE6OF01BX3YP.35.71.G05.1.454.CMB.1.raw
  modified_base (208)..(208): a, c, t, g, unknown or other
  misc_feature (208)..(208): n is a, c, g, or t
tcagtacagatcgtcacgaccggtgctcgatttagtgtcgtcgcaagagagagggggtcaggctggaactgaggagcaggtgggggcacttctccctctaacactcctccctgttgaagcttctttgtggacgggcgagctcgaggactgactcgaggacctcctctacgttccaccttcacacaatgacggtcctcccgtgcctacncgtcctccggtggggtactcgtacttaagtcggtccgttcggttcggtccttcgtcggaacctcggtagggtaggggtaattggttggtagtatacggaccttcgtaccgttccctcccttaccgtcccgttacccgccggttaccccgtacccccttaaccgggacggaccggtacccggtccccggtccccttaccgttaccgttccccgttaccggttccgtaaccgttaccggtttccgtaacggtacgaccgtacccggtcccttaccgtacgtacttaaacgttaacgtacggtaacggtaaacttaacggtaaaggtttacgttttaacggtaacggtttacccggtaacgtacggtaaccggaacggtaaccggtcgggtacggtaaccgtcccggttaccaccgtaaacgttccggtcctttaccgtacgttttacgttttacggttacggtttaccggttaaccggtcgggtttaccccggtcccggtttcccggggtacgttacgggttaaccgtgggttaccgggtagggttaccgttacgggacggttacgaccgtaacggtacgggttaaccctagtttaaacgtttaacttaaccgggttaataaacggaactaccggtaactaagggaggttacggtaccgggtaagtaaggg

SEQ ID NO: 249024 - DNA, 776 bp, Homo sapiens
  misc_feature: GYAE6OF01A0DGB.35.71.G05.1.454.CMB.1.raw
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
tcagtacagatcgtcacgaccggtgctcgatttagtgtcgtcgcaagagagagggggcacttctccctctaacactctccctgttgaagctctttgtgacggcgagctcaggccctgatgggtgacttcgcagggcgtagtactttgttgtttctcggtaggctccctgctcagtcctccgtgggctgctatcgctcgtggtctcgngactcgaggtgggactagttgngtatacgactcgtacgtctaccactcccgtccgccgtacccgtccacccggtaggacgccggaccgccctactactccgtcctagtccgtagttaccttacgcgacgtaccgcctaccgtgaccgtaataggtagtacgtaactacggttaattagttagtaacgtttcggtacctaggaacgagtaccggaccgtacgtccgtacgtaaccgtcctaaccgtacgtcctaaccgtagtttccgtttacggttttcgtttaccgggttacccgtttacccggggcccgggtttaccccggttacccgggttcccgtaacggttacgggtaccgttttaccgggagttaaccgggtcggttaacgggtacgtccggtaacgtaccggttaccgaagggtttaccgtttttaaaaccctcgtaaacgtaaccggtaacgttaacgaacgggtccgggaagggtaccgttcggggtaaagggcggttaagtagggtttaccggtttcggggttaattaacggtttaacgtcgggaattttccggaaacgg

SEQ ID NO: 249025 - DNA, 667 bp, Homo sapiens
  misc_feature: GYAE6OF01BLYRU.35.71.G05.1.454.CMB.1.raw
  modified_base (135)..(135): a, c, t, g, unknown or other
  misc_feature (135)..(135): n is a, c, g, or t
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
  modified_base (601)..(601): a, c, t, g, unknown or other
  misc_feature (601)..(601): n is a, c, g, or t
  modified_base (637)..(637): a, c, t, g, unknown or other
  misc_feature (637)..(637): n is a, c, g, or t
tcagtacagatcgtcacgaccggtgctcgatttagtgtcgtcgcaagagagagggggtcaggctggaactgaggagcaggtgggggcacttctccctctaacactcctccctgttgaagctctttgtggacgggngaggctcgaggactgatcgacgactcctctacgtcaccttctcacatgacgctccngtctcacgtctcgngggctgactagtcgtcgtcgtcggtctcgtgtactcggtaggtaggtagttgttacggtntacgttacgtaacttccgcgttacccttcccgtacccttaccgttcccctccggtcccctacccccggtaccggtgggtaacccggtccggtcccccgtacctcctaacgttcccgttccgcggtacgtacctcgttacgaccgaccgtccgtccctacgagtaacgtaggtaaagttacgaacgtatttaacggagttttagtaccgttaagttcccgatcggaaccgaacgtacggacgtacgtacgtacgtccaacggactaccgtcctgttactgtacgttgttacgtactcgggtcgtcccgtgtcgtagtcgtcgtgtgtcgacgtggtnacgtacgctagaagttctaacgtagtacaacgttanacggtacgtagtagacgagggtccgtaagg

SEQ ID NO: 249026 - DNA, 801 bp, Homo sapiens
  misc_feature: GYAE6OF01BWLH6.35.71.G05.1.454.CMB.1.raw
  modified_base (190)..(190): a, c, t, g, unknown or other
  misc_feature (190)..(190): n is a, c, g, or t
tcagtacagatcgtcacgaccggtgctcgatttagtgtcgtcgcaagagagagggggtcaggctggaactgaggagcagggtgggggcacttctccctctaacactcctcccctgttgaagcttctttgtgacgggcgagctcaggactgatcagactcctcagttcaccttctcacaatgagcctcccngtctcgacgtccgttccgtggggctcgacgttaatcgcttcgtcgggtccttcgtaggacttccgagggtagggtattagttgtagtaagtgtactacctacgtccttaccctaaccttccttccccgtaccgtccccgtacccctaaccccggtgggaacgaccggcccccggttaccctacccgtaactcccgttccctaggaccgtacgggtaccttaacggtcgaacgacccgtcctccgtagtacgtaacgtaaaggttaacgtaaggtaactttaaactaaacgtttagtttaagaaacggttttacggtaaccgtagtaccgtaaacggtaacgaccgggtacggaacgtaccgttaccgtaccaacgtacctaccgtacggttacgtacttacgtttacgttttacggtaccgttaacggttacccggtccccgttacccggggttaccctaaggtaccgttacgggtacgtaacgggttcggagtaaccggtggtaaacgtaccggaacgtaaccgaacgttaacgtttaaacttaccgtaaacggttaaagtaaaacgttcaaacgggtacgtaagtaggggtccggtaagggtaaaccgg

SEQ ID NO: 249027 - DNA, 920 bp, Homo sapiens
  misc_feature: GYAE6OF01CR7KA.35.71.G05.1.454.CMB.1.raw
  modified_base (121)..(121): a, c, t, g, unknown or other
  misc_feature (121)..(121): n is a, c, g, or t
  modified_base (131)..(131): a, c, t, g, unknown or other
  misc_feature (131)..(131): n is a, c, g, or t
  modified_base (385)..(385): a, c, t, g, unknown or other
  misc_feature (385)..(385): n is a, c, g, or t
  modified_base (900)..(900): a, c, t, g, unknown or other
  misc_feature (900)..(900): n is a, c, g, or t
tcagtacagatcgtcacgaccggtgctcgatttagtgtcgtcgcaagagagagggggtcaggctggaactgaggagcgagggtgggggcacttcctcctctaacactcctccctgttgaancttctttggngacgggcgagtctcgaggctgatcgagacctcctcgtacttccaccttctacaactaagtggaacggtccctcccgtcgtccgtacgtaccgtccgttccgggtaggggtctacgtacttaagtcgtcgttcgtcgggtctcgtcggtacgtccggagggttagggtatttagtggtagacttacgtactcgtacgttcctccgttacctccgtcccaccggttcccaccccgcggtcggaaccgccggtcccnccttaccgtcttcccgtcggtcgcgttaacgttgtacgtacgtaccggccctcgttacgtacgtaagtaacgttaataaacggtacgtttaaaccgttaagtttacgttttaaacgtttacggttaaagtttccccggttaacacggaaccggtaaggaacccggtaccgggtaacggtaccccggtttaccgttaaacccgtacccgtaacccggttaaccgttcccggttaccgtttacggttacccgtttttaagggtttttaaccccgggtttacggtttaaccgggtttacccccggggttcccggggtttacccgggttttacccccggggtaaccgtttaaccggggtaccggtttacggggtacgggtttacccggtagggttacccggtaaggggtaccgttacggtaacgggtacccggtacttaaacggtttccgttaaaagtttaacccggtaagttaaaaccgttaagacccggttaagggtacggtaaccgggggtttaanacgggggttctaaacggggg

SEQ ID NO: 249028 - DNA, 596 bp, Homo sapiens
  misc_feature: GYAE6OF01BVV27.35.71.G05.1.454.CMB.1.raw
  modified_base (170)..(170): a, c, t, g, unknown or other
  misc_feature (170)..(170): n is a, c, g, or t
  modified_base (284)..(284): a, c, t, g, unknown or other
  misc_feature (284)..(284): n is a, c, g, or t
  modified_base (355)..(355): a, c, t, g, unknown or other
  misc_feature (355)..(355): n is a, c, g, or t
tcagtacagatcgtcacgaccggtgctcgatttagtgtcgtcgcaagagagaggggcacttctccctctaacactctcccctgttgaagctctttgtgacgggcgagcgtcaggccctgatgggtgacttcgcaggcgtagactttgtgtttctcgtaggctccctgctnagctccgtgggctgctaatgctcgtggtctctggatccgagtggggtatattgtgactgacgtcagtctccactctcctgccctcgacccgtggacgagccgcctcatcctcgngacgtaggtctaggtcgagactcctacctgactagtagtaatggaataactaagttattagaatttgaccngacgagacgcgaggctacgtccacacgatctactagtattcgtacgtttaggtacgttaacgtccgggtccgtccgggtacctagtaccgtaggtacgagtgggtacgtagtcggtaacgtcgaggtacctagtacgttaactttagaacgtaacgtaaaacttcgaacggactaggtaacggtcggtaagcggttagaaggttacgttagttacggtaagtttactacgtgtacgtaacg

SEQ ID NO: 249029 - DNA, 723 bp, Homo sapiens
  misc_feature: GYAE6OF01CSKID.35.71.G05.1.454.CMB.1.raw
  modified_base (207)..(207): a, c, t, g, unknown or other
  misc_feature (207)..(207): n is a, c, g, or t
  modified_base (667)..(667): a, c, t, g, unknown or other
  misc_feature (667)..(667): n is a, c, g, or t
  modified_base (680)..(680): a, c, t, g, unknown or other
  misc_feature (680)..(680): n is a, c, g, or t
  modified_base (710)..(710): a, c, t, g, unknown or other
  misc_feature (710)..(710): n is a, c, g, or t
tcagtacagatcgtcacgaccggtgctcgatttagtgtcgtcgcaagagagagggggtcaggctggaactgaggagcagggtgggggcacttctccctctaacactctcccctgttgaagctctttgtgacgggcgagctcgacggccctgatgggtgacttcgcgaggcgtagtactttgttgtttctcgtaggcctcctgtctcngtctccgtggggctgctatgctcgtggtctcgtggactccgaggtagggtattagtgtgtagtcgactcgacgttcctcctaccttcctccctcgtccccgtccaccccggtaggaccggtaccgcccggtcctcctacttcccgtccgtcggacgtacgggttacctacgtaccgtacggtaccgtccttacccgtggaaccttaacgttaaggtaagtagtaaacttaaacgtaacgtttaacgtttagtaacgtttaccggtacgtacgaacgtagggtaaccgccggtaagggcctacgttacccacacgtaacgtcccgtactgtactttagttacggttcgttaactccgggtaccgtcccgggttcccggtactacggtaaccgttagtacgggtatcgggtaacgtggtacgaaccttaggccgtaactaacggttacttttaacccgtaanaaccgggttaaanaaccgttagacggtaacgtacggtaagggngttaacggtacgg

SEQ ID NO: 249030 - DNA, 213 bp, Homo sapiens
  misc_feature: GYAE6OF02JAKRY.35.71.G05.1.454.CMB.1.raw
  modified_base (186)..(186): a, c, t, g, unknown or other
  misc_feature (186)..(186): n is a, c, g, or t
  modified_base (210)..(213): a, c, t, g, unknown or other
  misc_feature (210)..(213): n is a, c, g, or t
tcagtacagatcgtcacgaccggtgctcgattagtgtcgtcgcaagagagaggggcgacttctcctctaacactctccctctacaagctcctcggacgttcggccaaggaccaaggtggaaatcaacgaactgtggctgcaccatctggtcttcatcttccgccaatctgaacgatctgtactgancgggctggcaaaggcgcattacgnnnn

SEQ ID NO: 249031 - DNA, 491 bp, Homo sapiens
  misc_feature: GYAE6OF02IY2HU.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgatgggcgagctcaggactgatcaggactcctcagttcaccttctcacaatgaggctccctgctcagctcctgggctgctaatgctctgggtctctggatccagtggggatattgtgatgactcagtctccactctccctgcccgtcacccctggagacgccggcctccatcctcctgcaggtctagtcagagcctctgcatagtaatggatacaagtattgaattggtacctgcagaacgcagggcagtcctcacagctcctgatcttatttggttctagtcgggtccgtccgggtccctgactaggttcagtggctagtgatcgaggcacagtatttacactagaatcagcagagtggacgg

SEQ ID NO: 249032 - DNA, 493 bp, Homo sapiens
  misc_feature: GYAE6OF02HHUHS.35.71.G05.1.454.CMB.1.raw
  modified_base (408)..(408): a, c, t, g, unknown or other
  misc_feature (408)..(408): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaagtatttgaattggtacctgcagaagccagggcagtctcacagctcctgatctatttggtctaagtcgggcctccggggtccctgacngttcagtgcagtggatcaggcacagtatttacactagaaatcagcagagtggagctgagatggttaggtagtttatacgtgctag

SEQ ID NO: 249033 - DNA, 602 bp, Homo sapiens
  misc_feature: GYAE6OF02I4H99.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtgggatattgtgatgactcagtctccactctccctgcccgtcacccctggagacgcccggcctccatcctcctgcaggtctagtcagacgcctcctgcatagtaatggatacaagtattgtaattggtacctgacagacgcgaggcagtctaccacacgctcctgatacttagtttcgggttactaacgtccgggtcccgtcccggggttccctcggaccgtacggttcgagggttcgggaccgtaggtacgggatccggagggacctaacgtaggttaactttttaaccgaacttaagtaaaaattccgaaggacaaggtaagggtcgggaaggtacgtaggtaggagtttggtttacgggttaagtttacgtttacggttagactaacgg

SEQ ID NO: 249034 - DNA, 495 bp, Homo sapiens
  misc_feature: GYAE6OF02GQSXA.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcctgcatagtaatggatacaagtatttgaattggtacctgcagagccagggcagtctccacacgctcctgattctatttgggttctaagtcgggtcctccggggtccctgactaggttcagtgcagtggatgagcacgagtatttacactagaaatcagcagagtggagtcg

SEQ ID NO: 249035 - DNA, 368 bp, Homo sapiens
  misc_feature: GYAE6OF02ILJ3B.35.71.G05.1.454.CMB.1.raw
  modified_base (360)..(368): a, c, t, g, unknown or other
  misc_feature (360)..(368): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatcgtcttcccctggcacctcctccaagagcacctctggggcacagcggccctgggctgcctggtcaggactacttccacgatctgtactgagcgggctggcaaggcgcatagnnnnnnnnn

SEQ ID NO: 249036 - DNA, 602 bp, Homo sapiens
  misc_feature: GYAE6OF02HMSC0.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctcgccctccacccgtggagacgccggcctccactcctcctgcgacggtctacgtacagacgtcccttccgtgactagttaagtaagtaggtaactaacgtaagttagtttagtaagttcgtactgacaagaacgcggaggactacgtcctaccacgtacgtcctcgtagtacttcgtttaggttttcggttactaacggtccgggtcccggttcccgggtcctaggacgttacggttcaggtcgacgtaggtcgtactcggacgctaacgtagtttactttacacgtaaagaaactcgagcgaagtggtaggacggtacgtaggagtgttacggttaggttactttatcgtgatacg

SEQ ID NO: 249037 - DNA, 496 bp, Homo sapiens
  misc_feature: GYAE6OF02GNWZH.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaagtatttgaattggtacctgcagaagccagggcagtctccacagctcctgattctatttggtctaatcgggcctccggggtcctgactggttcagtggcagtggatcgaggcacgagtaactttacacttagaaatcagcaggagtggagtacg

SEQ ID NO: 249038 - DNA, 592 bp, Homo sapiens
  misc_feature: GYAE6OF02G1KOF.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctgggctgctaatgctctggtctctggatccagtgggatagttgtgatgactcagtctccactctccctcgccccgtcaccccgtggacgacgcccggcctccactcctcctgctaggtctagtcagacgcctctgcatagtaatggatacaagttatttagaattggtactgacagaacgccgagggcagtcctaccacgacgccttctgtacttcgttagtttcgggttacttaacgtccgggtcccgttcccggggtccctaggtaccgtagggttcgagggttcgaccgtaggtcggacttccgagggtcctaacggtaagttaacttttaaccgaacgttaacgaaaacgttcgaacggtaccgtaagggtacggttacgggaaggtcgg

SEQ ID NO: 249039 - DNA, 562 bp, Homo sapiens
  misc_feature: GYAE6OF02F1777.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagacgcctcctgcatagtaatggatacaagtatttgaattggtacctgcagagccgagggcagtctcacacgcctcctgattcttagttttgggttctaagttccgggtccgttccggggttccctggtacgtacggttccgaggttcggctaggttggacttacgacgggcctaacgtaacggttaatttttaaccgaacgttaagaaaagttccgaaggtacgaaggtaggtagggaggtacgg

SEQ ID NO: 249040 - DNA, 508 bp, Homo sapiens
  misc_feature: GYAE6OF02GMV3M.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgccccgtcacccctggagagccggcctccatctcctgcaggtctagtcagagcctcctgcatagtaatggatacaagtatttgaattggtacctgcagaagccagggcagtctccacagctcctgatctattgggttctaagtcgggcctccggggtccctgacaggttcagtggcagtggatcgaggcacagattttacactacgaacatcgagtagggtgaggtctggaggtatggttggtagtttattactgtacatcg

SEQ ID NO: 249041 - DNA, 490 bp, Homo sapiens
  misc_feature: GYAE6OF02JD4F6.35.71.G05.1.454.CMB.1.raw
  modified_base (487)..(487): a, c, t, g, unknown or other
  misc_feature (487)..(487): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaagtatttgaattggtacctgcagaagccagggcagtctcacagctcctgatctatttgggtctaatcggcctcgggtccctgacaggttcagtggcagtggatcgaggcacagtattttacactagaaaatcagcagagtggagctgagatgtggtatttatactgntag

SEQ ID NO: 249042 - DNA, 601 bp, Homo sapiens
  misc_feature: GYAE6OF02I13T1.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggattattgtgatgactcagtctccactcctccctgcccgtccaccctggacggcgccgcctccactcctcgcgcgtagtctacgtcgacgacgtcctcgtcgactaagtaagtagtagtaataacgtaagttattagtaagttcggtactgacgaggacgacggaggctacgtccaccaagacgtcctcgtagtactttcgtttaggtttcggttaccttacggtccgggtacccggttcccgggtctacggaccgttcggttacgtaggtcggacgtaggtacgacgtacgacgacctacgtaagtttacctttaacgaacgttaagaaactcgaaggtacgtaggtaacggtgggacgtacgg

SEQ ID NO: 249043 - DNA, 525 bp, Homo sapiens
  misc_feature: GYAE6OF02IDNEJ.35.71.G05.1.454.CMB.1.raw
  modified_base (458)..(458): a, c, t, g, unknown or other
  misc_feature (458)..(458): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgccccgtcacccctggagacgccggcctccatcctcctgcaggtctagtcagacgccctcctgcatagtaatggatacaagttattgaattggtacctgcagaagccagggcagtctccacagcctcctgacttcttagttttgggtactaagtccgggtcccgtcccggggtccctggactaggttcaggtggctaggtggatcgaggcanagttatttacatagaaatcagcagagtggagctaggaggtattggttaggtagtttatactgactag

SEQ ID NO: 249044 - DNA, 401 bp, Homo sapiens
  misc_feature: GYAE6OF02IA7HN.35.71.G05.1.454.CMB.1.raw
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (386)..(401): a, c, t, g, unknown or other
  misc_feature (386)..(401): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattcgatatgtggagtggttattacacggaaaactactgggggccaagggaaccctgctcaccgtctcgtcagcctccaccaagggccctatccggtccttccccctggccaccctcctccaagacgcaacctcgtgggggcacagccggcccctgggctgcccgtaggccaaagggctaacgttcccacgatcngttaacgngacgcggctggacaaggcntanagnnnnnnnnnnnnnnnn

SEQ ID NO: 249045 - DNA, 538 bp, Homo sapiens
  misc_feature: GYAE6OF02HRNH6.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagacgcctcctgcatagtaatggaatacaagttatttagaattggtacctgacagaagccgagggcagtctccacacgcctcctgacttcttagtttgggttactaagtccgggccgttccggggtccctaggaccgtaggttcaggtggcgtaggtggatcgaggccacgtagtacttttacacgttaagaaactcgaagacaggtaggtaggaggtcgg

SEQ ID NO: 249046 - DNA, 559 bp, Homo sapiens
  misc_feature: GYAE6OF02HGHSS.35.71.G05.1.454.CMB.1.raw
tcagtacagatcgtcacgaccggtgctcgatttagtgtcgtcgcaagagagagggggcacttctccctctaacactctccctgttgaagctctttgtgacgggcgagctcaggccctgatgggtgacttcgcaggcgtagactttgtgtttctcgtaggctccctgctcagctcctggggctgctaatgctctgggtctctggatccagtgggatattgtgatgactcagtctccactctccctgccccgtcacccctggagacgcccggcctccatcctcctgccaggtctagtcagagccctcctgcatagtaatggaatacaagttatttgaatttggtacctgctagaacgccgagggcagtctccacagctctgattctagttttgggtactaagttccgggccgttccggggtcctggactaggttcaggttggctaggtggatcgaggcaacgagtaacttttacaacgtagaaaatcgaagaccgaaggtacggtaggaggtctaggacggtagttaggttaggtaagtttttactaacgttggactaagg

SEQ ID NO: 249047 - DNA, 372 bp, Homo sapiens
  misc_feature: GYAE6OF02FF6LK.35.71.G05.1.454.CMB.1.raw
  modified_base (366)..(372): a, c, t, g, unknown or other
  misc_feature (366)..(372): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaacccctgctcaccgtctcgtcagcctccaccaagggcccatcggtcttccccctggcaccctcctccaagagcacctctgggggcacagcggccctgggctgcctggtcaaggactacttccacgatctgtactgagcgggctggcaaggcgcatagnnnnnnn

SEQ ID NO: 249048 - DNA, 608 bp, Homo sapiens
  misc_feature: GYAE6OF02F3BXP.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggatattgtgatgactcagtctccactcctccctgccccgtccacccctggagacgcccggcctccatcctcctgcaggtctagtcagacgcctcctgcatagtaatggactaactaagttatttagtaattcggtactgacgagaacgccgagggcagtcctccacgacgcctccgtgtacttcgttagttttcgggttaccttaacggtccgggtccccggttcccggggttccctacggtaccgtacgggtttccgaagggttcgggcgtacggttggtactcggtacggacctacgtaacgttaacttttaaccaacgttaacggtaaaacttcgaacgtaccggaggtacgggttagggacggtacgg

SEQ ID NO: 249049 - DNA, 551 bp, Homo sapiens
  misc_feature: GYAE6OF02FO157.35.71.G05.1.454.CMB.1.raw
  modified_base (322)..(322): a, c, t, g, unknown or other
  misc_feature (322)..(322): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagacncctcctgcatagtaatggataacaagttatttgaatttggtacctgacagaagccgagggcagtcctccacacgcctcctgacttcttagttttcgggtttacttaagttcccgggtcccgttcccggggttccctaggtaccgtagggttcgaggtcggcgtaggtggactcgaggcacgtagtacttttacacgttagaaactcgagacgaggaggtaggaggtacg

SEQ ID NO: 249050 - DNA, 502 bp, Homo sapiens
  misc_feature: GYAE6OF02G8Q32.35.71.G05.1.454.CMB.1.raw
  modified_base (478)..(478): a, c, t, g, unknown or other
  misc_feature (478)..(478): n is a, c, g, or t
  modified_base (499)..(499): a, c, t, g, unknown or other
  misc_feature (499)..(499): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgccccgtcaccccctggagagccggcctccatctcctgcaggtctagtcagagcctcctgcatagtaatggatacaagtatttgaattggtacctgcagaagccagggcagtctccacagctcctgatctatttggttctaagtcgggcctccggggtccctgcaggttcagtggcagtggatcagggcacgagtattttacactagaaatcagcagagtggaggctgaggnttggttggtagtttatactgntag

SEQ ID NO: 249051 - DNA, 669 bp, Homo sapiens
  misc_feature: GYAE6OF02GRKSX.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctccgtggggctgctaatgctcgtgggtctctggatccgaggtgggatattgtgatgactcagtctcctactctccctgaccgtccaccccgtggacgacggcccggcctccactcctccgtgcgtacggtctagtcagacgtcctccgtgactaagttaagtaagtaggtaactaacgtaagttatttagtaagtttcggtaccgtgacgaaggtaacgccgagggactacgtcctaccacgacgtccttccgtagtacttcgtttaggttttcgggttaccttaacggttcccgggtcccggtttcccgggggttccccttaggtaacccggttacggtttcgtaacgggttcgggacgtagggttacgggacgtaccggtaggacctaacggtaagtttaaaccgttttaaccgaacgtttaaacgtaaaacgtcgaacggtaccgtaagggtagggtacggggaaggtcgg

SEQ ID NO: 249052 - DNA, 386 bp, Homo sapiens
  misc_feature: GYAE6OF02IXJQT.35.71.G05.1.454.CMB.1.raw
  modified_base (377)..(386): a, c, t, g, unknown or other
  misc_feature (377)..(386): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactgggccagggaaccctgctcaccgtctcgtcagcctccaccaagggcccatccggtcttccccctggccaccctcctccaagagcacctcgtcgggggcacaggccggcccctggggcctggcctggtacaagggactacttccacgactctgtactgagcgggctggcaaggcgcatagnnnnnnnnnn

SEQ ID NO: 249053 - DNA, 535 bp, Homo sapiens
  misc_feature: GYAE6OF02FKMRW.35.71.G05.1.454.CMB.1.raw
  modified_base (434)..(434): a, c, t, g, unknown or other
  misc_feature (434)..(434): n is a, c, g, or t
  modified_base (482)..(482): a, c, t, g, unknown or other
  misc_feature (482)..(482): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgcccgtcacccctggagacgccggcctccatcctcctgcaggtctagtcagacgcctcctgcatagtaatggatacaagtattgattgtacctgcagacgcgaggcagtctccacagctccgtgtactcttagtttgggtactaacgtccgggtcccgttccgggtcctgacgtacggtcgaggtcgntaggtggactcgaggcacgtagttactttacacgttagaaactcgagngagtaggtggagtcgtaggagtagttggttaggttagtttaagtcgtgatacg

SEQ ID NO: 249054 - DNA, 543 bp, Homo sapiens
  misc_feature: GYAE6OF02F3FR2.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatcctcctgcaggtctagtcagacgcctcctgcataagtaatggataacaagtatttagaattcggtacctgacagaacgccgagggcagtctccacagcctcctgtattcgttatttcgggttctaacgtccgggtccgttcccggggttccagtcgtaggttcaggtgcaggtgatcgaggcacgtaagtacttttacaacgttaagtaaaacgtctaagccgtaaggtacggtaggaggtcg

SEQ ID NO: 249055 - DNA, 373 bp, Homo sapiens
  misc_feature: GYAE6OF02IVA9M.35.71.G05.1.454.CMB.1.raw
  modified_base (288)..(288): a, c, t, g, unknown or other
  misc_feature (288)..(288): n is a, c, g, or t
  modified_base (365)..(373): a, c, t, g, unknown or other
  misc_feature (365)..(373): n is a, c, g, or t
tcagtacagatcgtcacgaccggtgctcgatttagtgtcgtcgcaagagagaggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatcggtccttccccctggccaccctcctccaagacgcacctcngggggcacagcggccctgggctgcctggtcaaggctacttccacgatctgtactgagcggctggcaaggcgcatagnnnnnnnnn

SEQ ID NO: 249056 - DNA, 530 bp, Homo sapiens
  misc_feature: GYAE6OF02FKGNX.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccaggtggggatattgtgatgactcagtctccactcctccctgccccgtccaccccgtggacgacgcccggcctccatcctcctgcaggtctagtcagacgcctctgcatagtaatggatacaagttatttagaattggtacctgacagacgcagggcagtctccacagcctcctgtattcttagttttgggttactaacgtcgggcccgttccgggtccctaggaccgtaggttcagtcggctaggtgatcgagcacgtatactttacacgttagaaatcagacaggacggtaggagtacg

SEQ ID NO: 249057 - DNA, 373 bp, Homo sapiens
  misc_feature: GYAE6OF02HEPKE.35.71.G05.1.454.CMB.1.raw
  modified_base (280)..(280): a, c, t, g, unknown or other
  misc_feature (280)..(280): n is a, c, g, or t
  modified_base (365)..(373): a, c, t, g, unknown or other
  misc_feature (365)..(373): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatccggtcttccccctggccaccctcctccaagngcacctctggggcacagcggccctggctgcctggtcaaggactacttccacgatctgtactgagcgggctggcaaggcgcatagnnnnnnnnn

SEQ ID NO: 249058 - DNA, 374 bp, Homo sapiens
  misc_feature: GYAE6OF02HKH4D.35.71.G05.1.454.CMB.1.raw
  modified_base (365)..(374): a, c, t, g, unknown or other
  misc_feature (365)..(374): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatcggtcttccccctggcaccctcctccaagagcacctctgggggcacagcggccctgggctgcctggtcaaggactacttccacgatctgtactgagcgggctggcaaggcgcatagnnnnnnnnnn

SEQ ID NO: 249059 - DNA, 373 bp, Homo sapiens
  misc_feature: GYAE6OF02HS9IO.35.71.G05.1.454.CMB.1.raw
  modified_base (356)..(356): a, c, t, g, unknown or other
  misc_feature (356)..(356): n is a, c, g, or t
  modified_base (361)..(373): a, c, t, g, unknown or other
  misc_feature (361)..(373): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcacgcctccaccaggcccatcggtcttcccctggcacccctcctccaagagcacctctggggcacagcggccctgggctgcctgtcaaggctacttccacgatctgtactgagcgggctggcaaggcgnatagnnnnnnnnnnnnn

SEQ ID NO: 249060 - DNA, 625 bp, Homo sapiens
  misc_feature: GYAE6OF02HXHI5.35.71.G05.1.454.CMB.1.raw
tcagtacagatcgtcacgaccggtgctcgatttagtgtcgtcgcaagagagaggggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccaggtggggatattgtgatgactcagtctccactctccctgcccgtcaccccgtggacgacggcccggcctccactcctcctgcaggtctagtcagacgtcctctgcatagtaagtggaatactaagttatttagtaagtttcggtacctgacaagaacgccgagggctaagtcctaccacgtacgccttcctaggtacttacgtttagttttacggggtttacctaaaggttcccggggtcccgttcccgggggttaccctagggaccgtacgggttcgagggttcgggtacgtaacggtggtactcggacgggcctaacggtaacgttaactttttaaccgaacgttaaagtaaactcgaacggtacgaagggtaaggttagggaggtacggg

SEQ ID NO: 249061 - DNA, 678 bp, Homo sapiens
  misc_feature: GYAE6OF02JLTSP.35.71.G05.1.454.CMB.1.raw
  modified_base (282)..(282): a, c, t, g, unknown or other
  misc_feature (282)..(282): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctcccctcgccccgtcaccccctggacgagcccggtaccccntcccactctcctgtcaggtctagtcacgtacgtcctacctgtactagtagtaatacggtaattaacgtaagttaatttaggtaacttcgggtaacctaggaccgaacggaacggccgtaagggtcctaacgtacctaccgactacgtaccttaccgtagttaacgtttcgtttaacgtttcgggttaccgttaaccggttcccggggtacccgttaccggggtaccctaggttaccgtaggttcgaggtcggacgtacggtacggacgtaccgaacggtacgtaacttacgttaactttaacgaacgtacgaaacgtaccgagtacggtaagggtaggtaggacggtacgttaggtaggttacggttaggttaggttagttacgttacgtagtacg

SEQ ID NO: 249062 - DNA, 576 bp, Homo sapiens
  misc_feature: GYAE6OF02HFP50.35.71.G05.1.454.CMB.1.raw
  modified_base (498)..(498): a, c, t, g, unknown or other
  misc_feature (498)..(498): n is a, c, g, or t
tcagtacagatcgtcacgaccggtgctcgatttagtgtcgtcgcaagagagaggggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactcctccctcgcccgtccaccccgtggagacgcccggcctccatcctcctgcaggtctagtcagacgcctcctgcatagtaatgatacaagttattagaagttgtacctgacaagaacgcgagggctacgtcctaccacgacgtctcctgtacttcgttagttttgggtactaacggtccgggtccgttccggggtccctggacctagggttcaggttggctaggtggactcgacggtcagtagttactttacacgtanaaaatccgagacgaggtaggtggaggtacgtagggaaggtagttagggtttaggtaagttttagttactggtactaag

SEQ ID NO: 249063 - DNA, 604 bp, Homo sapiens
  misc_feature: GYAE6OF02F79HX.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtggggatattgtgatgactcagtctccactctccctgcccgtccaccccgtggacgacggcccggcctccactcctcctgcgtacggtctagtcagcgcctcctgctatagtaatggatactaagtatttagtaattcggtactgacagaacgcgagggacagttcctccgactcgctccgtagtattcttagtttcgggttactaacgtccgggtccgttcccgggtcctaggtacgtacggttcgtaggtgtacgtaggttcggacgttcgacggacgtaacgtaacggttaactttttaaccgaacgtttaacggtaaaaccttcggaacgggtaccgtaagggtacgggttaccggggaggttacggg

SEQ ID NO: 249064 - DNA, 667 bp, Homo sapiens
  misc_feature: GYAE6OF02GKK0S.35.71.G05.1.454.CMB.1.raw
tcagtacagatcgtcacgaccggtgctcgatttagtgtcgtcgcaagagagaggggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtgggatattgtgatgactcagtctccactctccctgcccgtcacccctggagagcccggcctccatctcctgcaggtctagtcagacgcctcctgcatagtaatggatacaagttattagaattggtacctgacaagaacgccgagggactagtcctaccacacgtcctccgtgtacttctttaagtttcgggtttactaagtccgggtcccgtcccggggtccctaggaccgttaggttccgtacggttgggacctagggtacggtacgtccggagggacctaacgtacggttaacttttaaccgaaccgttaacgtaaaaacgttccgaacggtacccgaagggtaacgggtacggggtaaacgggtccgttaaggggtaacgggttaggttttaggggttttagggtttaaacggttttttaacgtttaacggttcggtaacccgtttaacgg

SEQ ID NO: 249065 - DNA, 693 bp, Homo sapiens
  misc_feature: GYAE6OF02JN00R.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtgggctgctaatgctcgtggtctctggactccgaggtgggattattgtgatgactcacgtctccacttcctccctcgcccgtcaaccccgtggacgacgccggccctacgactcctcctgacgtacggtctacgtccagccgtcctcctagactatagtatcggactaacaagttacttagtaacgttcgtacctgacgaggtaacgcggaggcaagtcctacgaacgcgtctcctagacttacctagttttcggtacttacgtcccgggtaccgttccggggtacctacggtacgttcggttacgacggtccggtagaggtcgggtaactccggaaggtacctaaccgttaaaggtttacttttaaaccgacgttaaagtaaaccttacgggtaacggacgtaaacggtacggggtacgggtaaacgggttccggttaaagggaacggggtttaagtttaccggggtttaagggttaaacggtttttacgtaaacgtttccggaaccgtttaagg

SEQ ID NO: 249066 - DNA, 649 bp, Homo sapiens
  misc_feature: GYAE6OF02IR8S1.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccaggtggggatattgtgatgactcagtctccactctccctgccccgtcacccctggagacgcccggcctccatcctcctgctaggtcctagtcagacgccctccgtgcaataagtaatggaacttactaagtattagaattggtacctgacaagaacgcgagggctaagtcctaccacacgtcctcagtactacgttacgttttgggttacttaacgttccgggtcccgggttcccggggtcccgtacgtaacgtacgggtttacgtacggtcggtacgtaggtcggtaacgttccgaacggtacctaacgtaacgttaactttaaccgtaaccgtaaaggtaaaaacgtcgtaacggacgtaaggtacgggtacggaggtaccgttaaggaacggttaggttaggttacggtttagtttaaaccgttgttacgtagtaacg

SEQ ID NO: 249067 - DNA, 642 bp, Homo sapiens
  misc_feature: GYAE6OF02G8KGG.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgatgggcgagctcaggactgatcaggactcctcagttcaccttctcacaatgaggctccctgctcagctccgtggggctgctaatgctcgtgggtctcgtggatccaggtggggatagttgtgatgactcagtctccactctccctgcccctcaccccgtggacgacgcccggcctccactcctcctgcgtaggtctacgtcacgacgcctcctgcatagtaagtggactaacgaagttatttagaatttcggtacctgacaagaacgccgaagggcagtcctacacgtacgtcctccctagtacttacgttacgttttgggttaccttaacggttcccggggtaccccgttcccgggggttacccttacggtaccggttacggttaccgttacgggtcggtacgtacggggttacggacgtacggacggtacctaacggtaaccggtttaacttttaaccgtaacgttaacgtaaacgttacgtacgtacggaacggttaggtacggtaacggg

SEQ ID NO: 249068 - DNA, 384 bp, Homo sapiens
  misc_feature: GYAE6OF02HPM90.35.71.G05.1.454.CMB.1.raw
  modified_base (370)..(384): a, c, t, g, unknown or other
  misc_feature (370)..(384): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaagggcccatccggtcttccccctggccacccctcctccaagacgcacctcgtggggcacgagccggccctgggctgcctggtcaaggctacttcacgatctgtactgagcggcgtggcaaggcgcagtagnnnnnnnnnnnnnnn

SEQ ID NO: 249069 - DNA, 615 bp, Homo sapiens
  misc_feature: GYAE6OF02G1DSF.35.71.G05.1.454.CMB.1.raw
  modified_base (186)..(186): a, c, t, g, unknown or other
  misc_feature (186)..(186): n is a, c, g, or t
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
  modified_base (394)..(394): a, c, t, g, unknown or other
  misc_feature (394)..(394): n is a, c, g, or t
  modified_base (429)..(429): a, c, t, g, unknown or other
  misc_feature (429)..(429): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
  modified_base (545)..(545): a, c, t, g, unknown or other
  misc_feature (545)..(545): n is a, c, g, or t
tcagtacagatcgtcacgaccggtgctcgatttagtgtcgtcgcaagagagaggggcgacgttctccctctaacactctccctcgttgaagctcttgtgacggcgagctcaggccctgatgggtgacgttcgcaggcgtagacttgtgttctcgttagctccctgctcagctcctgggctgctaangctcgtggtctcgtggatccgagtgggatagttgngatgatcagttcnccgactctccgtcgccccgtactacccccgtgaacggcggcccggtacccttaccgnttccctccgttcgaacgacccggttctaaccgtccgaggtaccgtccctcggtcactagtaagtagtacggtataaccgtaattatttagaacttagggtacngacctaagaagtccgagggtcaagttcaccacgancgtcagatctagttggtctaacgtcgggtccgtaccggtcccnggtactacgtgtacgngtcgagtcggntcgaggttcacgtaagttctttaggaaacctggtaaaatacgacgngaacggtaggtacgggcaggtacggagggtaattggttaaggtaaccgtttaagttccggtatcggtaac

SEQ ID NO: 249070 - DNA, 651 bp, Homo sapiens
  misc_feature: GYAE6OF02IQC4O.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctggtctctggatccagtggggatattgtgatgactcagtctccactctcccctgccgtcacccctggagacgcccggctccatctcctgctaggtctagtcagagcctcctgcatagtatgatacgaagtattgattgactgacagaagcagggcagtctaccacagcctctgtatactagttttggtactaagtccggggtcctaccgggggtccctgtacgtacggtttacacgggttggtaccgtaggtcgggtacgtaccgtacggggtacctaaccgaacggttaacgtttttaaccgtaacgttaaacggtaaaaaactccggaacggtacgaacgggtttaagggtacgggggtaacgggttccggtaggggtaaaggttaacggtttacggggttttaggggtttaacggttttttaacggttttaaacggttcgggtaccgttaaccgg

SEQ ID NO: 249071 - DNA, 712 bp, Homo sapiens
  misc_feature: GYAE6OF02H6FLK.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtggggatattgtgatgactcagtctccactctccctgcccgtcacccctggagacgccggcctccatcctcctgcaggtctagtcagacgcctcctgctatagtaactggaactacgtaagttatttagaagtttcggtaacctgtaccgaaggtaaacgtccggaagggtcctaagttccctacccaacgacggtcccttcctaggtactttcgttaacgtttttcggggttaaccttaaacggttcccgggggtccccgttacccccggggggtttccctacgggtaaccggttacgggtttaccgagggttacgggtacgtacgggtagggaacttccggaacgggtcctaacgttacggtttaaactttttaaccgaacgttaaacgtaaaacgtcgaacgtagacggtagggtagggacggtacggttaagggtaacggttacgtttaggggtttacggtttaacggtttttaacgttaacgttcggtacttaacgg

SEQ ID NO: 249072 - DNA, 386 bp, Homo sapiens
  misc_feature: GYAE6OF02HZNKH.35.71.G05.1.454.CMB.1.raw
  modified_base (370)..(371): a, c, t, g, unknown or other
  misc_feature (370)..(371): n is a, c, g, or t
  modified_base (373)..(386): a, c, t, g, unknown or other
  misc_feature (373)..(386): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactacgtggggccagggaaccctgctcaccgtctcgtcagcctccaccaagggcccagtcggtcttccccctggccaccctcctccaagagcacctcgtgggggcacgagcggccctgggctgcctggcaaggctacttccacgatctgtactgagcgggtctggcaaggcgacatagnngnnnnnnnnnnnnnn

SEQ ID NO: 249073 - DNA, 653 bp, Homo sapiens
  misc_feature: GYAE6OF02HRW5Y.35.71.G05.1.454.CMB.1.raw
  modified_base (482)..(482): a, c, t, g, unknown or other
  misc_feature (482)..(482): n is a, c, g, or t
tcagtacagatcgtcacgaccggtgctcgatttagtgtcgtcgcaagagagagggggcacttctccctctaacactctcccctgttgaagctctttgtgacgggcgagctcaggcccctgatgggtgacttcgcaggcgtagacttttgtgtttctcgtaggctccctgctcagctcctggggctgctaatgctcgtgggtctcgtggatccaggtggggatagttgtgatgactcagtcctccactcctccctcgccccgtccacccctggagcgcccggcctccatcctcctgcgtaggtctacgtcagacgccctctgctagtagtaagtggatactaagttattagtaattcggtacctgacagaacgccgagggctagtcctaccacacgtcctacgtgacttcttagttttcggttacgttaacgtcccggggtcccgtccggggttccctggtacgtaggtttccgaggtcgganaggtggattcggaacggtacgaacgtagtttaaccttttaacgaacgttaaacggaaaacttcgaacggtcgaaagggtagggtacgggtaacggttcggtaagggaacgggtttaggttttacggtttagggtttaaagttttacgtttaacggttaggacccgttaagg

SEQ ID NO: 249074 - DNA, 691 bp, Homo sapiens
  misc_feature: GYAE6OF02GKFOR.35.71.G05.1.454.CMB.1.raw
  modified_base (626)..(626): a, c, t, g, unknown or other
  misc_feature (626)..(626): n is a, c, g, or t
  modified_base (643)..(643): a, c, t, g, unknown or other
  misc_feature (643)..(643): n is a, c, g, or t
  modified_base (682)..(682): a, c, t, g, unknown or other
  misc_feature (682)..(682): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctgggctgctaatgctcgtggtctctggactccaggtgggattattgtgactgacctcacgtcctccaccttcctccccgtcgcccctcaccccgtggacgcgcccggccctccactcctcctgctacggtctagtcagacgtcctcgtgactaagttacgtaaacgtcggtaacttaaccgtaagtttacgtttacggtaacgttttacggggtaaccctggaccgaacgggtaaccgtcccggaacggggtcctaacggttccctacccaccgtaccgtccttaccgtgtacgtttccgttaaggtttttccgggttacctaacggtcccgggtccccgttccggggtccctaggaccgttacggttccgtaggtcggactacgggttcggactaccggacggtacctaagtaacgtttactttaaccgaactaacgaaactcggaacncgtaagcgggtaacggnggtaccgtggacgtagttggtacgttaacgtttctacgngtactaacg

SEQ ID NO: 249075 - DNA, 633 bp, Homo sapiens
  misc_feature: GYAE6OF02I0G8U.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctcctggggctgctaatgctctgggtctctggatccagtgggatattgtgatgactcacgtctccactctccctgcccgtcacccctggagacggccggcctcatctcctgcaggtctagtcagacgtcctcctgacatagtaacgtaggtataactaagttactttagtaacttcggttaaccgtcgacgtaagaacggtacccgaacggggacgtacggtcctcccgtaacacgtaccgtcccgttagtacttactttagttttcgggttactaacggttccgggtcccgttcccgggggttccgtacggtaccgtacgggtttcgtacggtcggtacgtaggtagggacgtcgacggtacgaacgtagttaactttttaaccgaaccgtagtaaacgtacgtaacgaccgtaacggagggttacgggtaggtacgg

SEQ ID NO: 249076 - DNA, 763 bp, Homo sapiens
  misc_feature: GYAE6OF02JIBJC.35.71.G05.1.454.CMB.1.raw
  modified_base (306)..(306): a, c, t, g, unknown or other
  misc_feature (306)..(306): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagcctccgtggggctgctaatgctcgtggtctctggatccgaggtgggattattgtgatgactcagtctccactcctccctcgccctccaccctggagacgccgcctccatcctcctgacgagtctagtcacgacncctacctgactaagttaagaattaggaactaacgaagtttattagaaacgttcggtacctggacaaggtacgaccgagggactacgtcctaccacgactcctaccgtagtacttcgtttaagttttcgggttaccttaaacggtcccggggttacccggttcccggggtacccttacggtaaccgtacgggttttaccgagggttacgggtacttacgggtaccggtacgttacccgggaacggtacgttaacccgtaaacgggttttaaccttttttaaaccgaaccgggttaaaacgttaaaaaaccgtttccgggaaaacgtttaccggaaaggggtaaccgggggttcgggtaaaccgggtcgggttaagtaacggggggtttaaacgtttcgggggtttttaaaggggttaaccttttttaaacggtaccggtttaggaaccgggttaacgg

SEQ ID NO: 249077 - DNA, 814 bp, Homo sapiens
  misc_feature: GYAE6OF02H3QCO.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccgaggtgggatattgtgatgactcagtctcactcctccctcgcccgtccaccccgtggacgacggccggcccttaccacttctcccgtagcctaggtctagtcaggacgccctcctgaccaattagtaaactggtaactaactaagttaatttacgaaagtttgggtaaaccctgaacctaggaaacgtacccggaagggtccaagttaccctacccgaacgacggtacccttacccgtcgtaacgtttaccgtttaaggtttttacgggtttaaccgttaaacggttccggggtacccccggttcccggggggtttccccgttaacgggttaaccgtaaccgggttttacggtaacgggttacgggtacctagggttacgggtaaccgtaacggtaacggtccgtaaacccgtaaaggttaaacccgttttttaaaccgaaaccgttaaaagttaaaaaccgtaacgtaaacggtaccgtaaacgggtacgggttacgggggaaaccgggtaccggggttaagggaaccgggttagggtttacgggttttaaggggtttaaacggttttttaaccgttttaaacggttcggtaacggttaaaccgg

SEQ ID NO: 249078 - DNA, 623 bp, Homo sapiens
  misc_feature: GYAE6OF02G16JB.35.71.G05.1.454.CMB.1.raw
  modified_base (409)..(409): a, c, t, g, unknown or other
  misc_feature (409)..(409): n is a, c, g, or t
tcagtacagatcgtcacgaccggtgctcgatttagtgtcgtcgcaagagagaggggggtgaggtgaaagatgagctggaggaccgcaatagggtaggtcccctgtggaaaaagggtcagaggccaaaggatgggagggggtcaggctggaactgaggagcaggtgggggcacttctccctctaacactctcccctgttgaagctcttgtgatcaggactcctcagttcaccttctcactaatgaggcctcctgctcagctcctggggctgctaatgctcgtgggtctcgtggactccgaggtgggatattgtgatgactcagttcctccactcctcccgtcgcccgtccacccgtggacgacgcccgcctcctatcctcctgcgtacgtctacgacagtccgtcctctnctatagtagtcgtataactagttattggaatttcggtactgacgaggacgtacggacgggtactacggtacctaccgtacctagtcccttactacgtactttacggtttagttttacgggttaccgttaacggttcccgggttaccccggttcccgggttacccgtcggttaacggtcggttaccggtaacggtcccggtaggtacggtaccgg

SEQ ID NO: 249079 - DNA, 535 bp, Homo sapiens
  misc_feature: GYAE6OF02JB05A.35.71.G05.1.454.CMB.1.raw
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgttttctcgtaggctccctgctcagctcctggggctgctaatgctctgggtctctggatccagtggggatattgtgatgactcagtctccactctccctgcccgtcacccctggacgacgccggcctccatctcctgcaggtctagtcagacgcctctgcatagtaatggatactaagtatttagaattggtacctgcagagcgaggcacgtctaccacacgctctgattcttagtttggttactaagttccgggccgttccggggtcctgacgtcggtcgagtggctaggtagactcgagacagagttatttacagtaanaaactcgancgaggtaggtaggaggacgtggagtagttggttaggttagtttatacgtacgatacg

SEQ ID NO: 249080 - DNA, 459 bp, Homo sapiens
  misc_feature: GYAE6OF02F2JV9.35.71.G05.1.454.CMB.1.raw
  modified_base (436)..(459): a, c, t, g, unknown or other
  misc_feature (436)..(459): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacaacggaaaactacgtggggccagggacctgctcaccgtctcgtcacgcctccaccgaacgggcccagtccgtccttccccctcggccacccctcctaccaagacgccaccctcggtcgggggcaccgacggccgggtccccgtcggggcctcggccgttcgggtaccgaaacgggtaccttaacccgttcccaacgtaacttccttaggttactcggacggccggggtccgtggacgaacggcgactagtgnnnnnnnnnnnnnnnnnnnnnnnn

SEQ ID NO: 249081 - DNA, 1030 bp, Homo sapiens
  misc_feature: GYAE6OF02HY48X.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggcctcctgctcacgctccgtgggctgctatgctcgtggtctctggactccgtaggtgggtattagttgtgtagttcgaccttacgtacgttccttacccctaccttcccctccccgtccggtcccccgtaccctacccccggtgggaacggtcccggccccggtcccttaccgtacgttcccgttcccgtacggtaccggtacggtttaccgtaacggttacccgaacggtacccgtaccccgttcccgttacggtaccctaaaaggtttaaacggtttaaacggttacgggtaaaacctttaaaacggttaaaacggtttttaacgtttaacgggtttaaaaccggtttttcccggggtttaaacccgttacgggtaaacccggttaaacggggtaaaccccgggtcccggggtaaaccggggttacccgttaacccggtttaccccttaacccgaaaaccgggtcccttacccgttaacccggttagtttacttttaaccccggttttttaagggtttttacccgggggttttaaaaccctttacccgggggtacccccggggggtttacccccggttttaaccccgggggggttcccccttaaacgggggttaacccggttttacgggggttttacccggtaagggggtttaccgggtaaccgggtttaacggggttaaccgggttaacccgtaaccggggtaacccggttaaccgttaaaccggggtttaaacgtttttaaacccgttttaaacccgtaaacgggttaaaacggtttaaaacccgtcggaaaccgggtttaccggaaaacgggggtttcggggtaacggggttacggtaaccggg

SEQ ID NO: 249082 - DNA, 723 bp, Homo sapiens
  misc_feature: GYAE6OF02FY685.35.71.G05.1.454.CMB.1.raw
  modified_base (221)..(221): a, c, t, g, unknown or other
  misc_feature (221)..(221): n is a, c, g, or t
  modified_base (313)..(313): a, c, t, g, unknown or other
  misc_feature (313)..(313): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtgggatattgngatgactcgagtctccactctccctgccccgtcaccccctggacgacgcccggcctccatcctcctgctaggtctagtcagacgccctccgngcatagtaatgggattaacgaagttatttgaatttggtaccttgactaagaacggcccgagggtacacgttccctaccgacgtacgtccttccctggtaacttctttaagttttcgggtttacttaagtcccggggtacccgttcccgggggttcccctaggtaaccgttacgggtttaccagggttcgggtacccgtaggtttacgggtactccggtacgggtacctaaccgtaacgttaaccgttttaaccgaaacggttaacgtaaaaacgttccgaacggggtactaacggggtaaccgggttaggggtaaaccggtccgggttaagggaacgggttaacgtttcggggttttaacgggtttaaggtttttaaccgtttaaccggttacgggtaccttaaaccggg

SEQ ID NO: 249083 - DNA, 698 bp, Homo sapiens
  misc_feature: GYAE6OF02FX80W.35.71.G05.1.454.CMB.1.raw
  modified_base (223)..(223): a, c, t, g, unknown or other
  misc_feature (223)..(223): n is a, c, g, or t
tcagtacagatcgtcacgaccggtgctcgatttagtgtcgtcgcaagagagagggggcacttctccctctaacactctcccctgttcgaagctctttgtgacggcgagctcaggccctgatgggtgacttcgcaggcgtagactttgtgttctcgtaggctccctgctcagctcctggggctgctaatgctctgggtctctggatccgaggtgggattattgngatgactcagtctccactctccctgccctcacccctggacgacgcccggcctccatcctcctagctacggtctacgtcagacgcctctgctagtacgtaatggactacgtaagttacttagagttcgtaactggcaaggacgcgagggcctaggtcctaccgaacgacgtaccgttcccgtatacgttactttagtttacgggtttacctaaacggttcccggggtcccggttaccccgggggtccctacggtacggttacggtttccgtacgggtcggtaccgtacggttcggacttccggaacggtcccgtaacgttaacgttaacgtttttaaccgaaccgttaagtaaaaaccgttccgaacggtacgaacgggttaacgggtacggggacgttacccggtaggtacgggttaacgtttcgggttaacggtttaacggttttaacggtacccggttcggtacgttaaccgg

SEQ ID NO: 249084 - DNA, 578 bp, Homo sapiens
  misc_feature: GYAE6OF02IZ7JS.35.71.G05.1.454.CMB.1.raw
  modified_base (453)..(453): a, c, t, g, unknown or other
  misc_feature (453)..(453): n is a, c, g, or t
tcagtacagatcgtcacgaccggtgctcgatttagtgtcgtcgcaagagagaggggggcacttctccctctaacactctcccctgttgaagctctttgtgacgggcgagctcaggcccctgatgggtgacttcgcaggcgtagactttgtgtttctcgtaggctccctgctcagctcctggggctgctaatgctctggtctctggatccaggtgggatattgtgatgactcagtcctccactcctccctcgccccgtccacccccgtggacgacgcccggtctccatcctcctgcaggtctagtcagacgcctcctgcatagtaatgatacaagttattagaattggtacctgcaagaacgccgaggacacgtcctaccacgcgtctccgtgtattcgttagtttcgggttactaacgtccgggtcccgttccgggtcctggacgtggttacnggtcggtcgtaggtgacgtcgacggtcagtagtactttacactagtaaactcgagcgagggtaggtcgggaggtcgtaggaggttagttggtttacgggttaatttacgttacgttggataacgg

SEQ ID NO: 249085 - DNA, 531 bp, Homo sapiens
  misc_feature: GYAE6OF02GG5KW.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtgggatattgtgatgactcagtctccactctccctgccccgtcacccctggagacgccggcctccatctcctgcaggtctagtcagacgcctcctgcatagtaatgggatacgaagttatttgaatttggtacctgacagagccaggcagtctccacagctcctgacttcgttatttgggttcctaagtccggggcccttccggggtccctggacgtaggttcacggtggcaggtggactcgaggcacgagtattttacgactagtaaatcagcaggtggtcggagcgtggagtagtgttggtagtttattacgtgcgtag

SEQ ID NO: 249086 - DNA, 584 bp, Homo sapiens
  misc_feature: GYAE6OF02HOXKI.35.71.G05.1.454.CMB.1.raw
  modified_base (404)..(404): a, c, t, g, unknown or other
  misc_feature (404)..(404): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgagctccctgctcagctcctgggctgctaatgctctggtctctggatccagtgggatattgtgatgactcagtctccactcctcccctcgccccgtccacccctggacgacgccggtccctccatcctcctgcacggtctagtcagacgtcctcctgcatagtaatggaataacaagttatttagtaattcggtacctgacgaagaagccgaggcagtcctaccanacgcttccgtagtacttcgtttagtttcgggttactaacggttccgggtacccgttcccggggttaccctggtacgtacgggtttcacggttggacctaggtcggactcgaggactaacgtaaggttacttttacgaactaggtaaaatcgaagtccgaagggtagttagggaggtacgg

SEQ ID NO: 249087 - DNA, 622 bp, Homo sapiens
  misc_feature: GYAE6OF02GH4II.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctccgtggggctgctaatgctcgtgggtctcgtggactccgaggtgggattattgtgatgactcagtcctccactcctccctcgtccccttccaccccgtggacgacggcccggccctccacttcctcctgcgtacggtctagtcaggacgtccttccgtcgactagtaagtaagtaggtaataacgtaagttatttagtaagtttcggtactgacaagaacgaccgacggacgtacgtctaccacacgtcctcctgtattacccccccccctttagtttcggtttacgtaacgtccgggtcccggttcccgggttccgtacgtacgtacggttcgtacgtcggtcgtacggtagtacgtacgacgacgtacgtacgttactttacgtaacgtaagtaactacgagacgaggacggtaggaggtacgg

SEQ ID NO: 249088 - DNA, 898 bp, Homo sapiens
  misc_feature: GYAE6OF02FMZ3T.35.71.G05.1.454.CMB.1.raw
tcagtacagatcgtcacgaccggtgctcgatttagtgtcgtcgcaagagagaggggggcacttctccctctaacactctcccctgttgaagctctttgtgacgggcgagctcaggccctgatgggtgacttcgcaggcgtagactttgtgttctcgtaggctccctgctcagctcctggggctgctaatgctctgggtctctggatccaggtggggattattgtgatgactcagtctccactctcccctgcccctccacccctagggacgacggccccggtcccttcccgacttccctccgtcgtccgacggttcctagtccgaggtacgtccctccgtgacgtaattaaggtaagtacggtacttaacgtaagtttaacgttttaacggtaaacgtttacgggtaacccttaggaccgtaaacgggtaacggaccggtacggggtacctaacgggtttcccctaacccgaccggtaccgtaccctttacccggtacggttaactttccggtttttaacgggtttttaccggggtttacccgttaaaccgggtttccccgggggttaacccccggttccccgggggggtttacccctacgggttaacccgggttacggggttttacccgtaacggggttcgggtaaccggtacgggtttacgggtaccgtttacggaaccgggtacctaacggttaacgttttaacgtttaaaccggtaaccgttaaacggtaaaaccgttccgggtaacggtaccggttaaggggtaaccgggttttggggggaaaccgtttaccgggtaacggggttaaggttaaccgggtttagggtttttaaccggggttttaaaccggtttttttaacggttaaaccggtttccgggttaacttaaaccgggg

SEQ ID NO: 249089 - DNA, 759 bp, Homo sapiens
  misc_feature: GYAE6OF02H5VK2.35.71.G05.1.454.CMB.1.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
tcagtacagatcgtcacgaccggtgctcgatttagtgtcgtcgcaagagagagggggtcaggctggaactgaggagcaggtgggggcacttctccctctaacactcctcccctgttgaagctctttgtgacgggcgagctcaggctgatcaggactcctcagttcaccttctcacaatgaggctccctgctcacgtctccgtgggctgactaatgctcgtggtctcgtaggactcgaggtgggaatnttgtgatcgactcagtctccacgtcctccgtcgtcccgtcaccccgtggacgacgccggtccctacacgttcctccgngacgtagtcctagtcagtacgtccctcgngactatagtaatacggaataaacgtaagttacgtttagtaacgtttaccgggttaccgtagtaaccgtaaggaaccggtacccggtaaggggaccctttacgggtaacccttaacccgaacgtacccggttacccttacgtacgttaaccgttttaccgttttaacggttttacgggttaacccgtttaaaccgggtcccggggttaaacccccgtttcccgggggttacccccgtaaggtaccggtttaccggggttactaacgggttcggtaaccgtaagggtacgttaaccgtacggaacggtaccgttaaacggtagtttaaacctttcgaaaccggttaaagtaaaccgttcggaacggacggttaaaccgggtaggttaccgggggtacttaaccgggg

SEQ ID NO: 249090 - DNA, 574 bp, Homo sapiens
  misc_feature: GYAE6OF02GRCX1.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctggtctctggatccagtgggatattgtgatgactcagtctccactctccctgcccgtcacccctggagacgccggcctccatcctcctgctaggtctagtcagacgcctcctgcatagtaatggatactaagttatttgaattcggtacctgcaaggaacgccgagggcagtcctaccacacgtacctccgtgtacttcttagttttcgggttcttaacggtccgggtcccgttcccggggtccctggtaacgtggttacgagtcggcgtaggtggactcgacggtacacgtagttactttacaacttacgaaatcagctaggaggtggacggtcgtaggaggtagttaggttacggttattttacgtacgtcgtactacg

SEQ ID NO: 249091 - DNA, 685 bp, Homo sapiens
  misc_feature: GYAE6OF02G49QI.35.71.G05.1.454.CMB.1.raw
  modified_base (543)..(543): a, c, t, g, unknown or other
  misc_feature (543)..(543): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctctgggtctctggactccaggtggggattagttgtgactgaacctcacgtcctccacttccctccctccgccccgtccaccccgtggacgacgcccgtccctccacgtcctccagcctaggttctacgtcacggccgtccctcgtagctagtaagtataggaattaccgtaagttatttgaacgtttcggtacctggacgaagaacgccggaggctacgtcaccacgactcctacgtcgactttcgtttagttttacgggttacgtaacggttcccggggtacccgttccccggggtcctacgggttcgttacgggtttacgtacggcggtactagggtcgtagtaccggngacccgtaagtaacgttacgttttacgaacgttaacgaaacgttcgaacgttacgaaggcggggttaggggacctacggttagggacggttaagttggggtttaacgttaccgggttttattacccgggattaacccggtag

SEQ ID NO: 249092 - DNA, 728 bp, Homo sapiens
  misc_feature: GYAE6OF02GU2LN.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctactcagctccgtgggctgctaatgctcgtgggtctcgtggatccgaggtgggattattgtgatgactcagtctccactcctccctcgcccgtccaccccgtggacgacgccggcctccactcctcctgctaggtctagtcagacgcctccgtgactaataagtaagtcggaataacgtaagttagtttagtaaacgttcggtaacctgactaacgaaacgtcccgaagggtctaacgttacctacccgaaacgtacgtacctaccgttagtactttacgtttaacggttttacgggttaaccttaaacgggtcccggggtaccccggtttccccgggggttaccctacgggtaaccgttaacgggtttccgaagggttcgggtacgtaagggttacggaacgttcggaacggtacctaacgtaacgtttaacttttaaccgaaacgttaaagaaaaacgttccgaacggtaccgaagggtacggtacgggtaagggtacctaagggtaaggtagtttagggtttacggttaagtttttaagtaccgtagtaccgtagtaacg

SEQ ID NO: 249093 - DNA, 654 bp, Homo sapiens
  misc_feature: GYAE6OF02HOZHQ.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccaggtggggatattgtgatgactcagtctccactcctccctcgcccgtccaccccgtggacgacgcccggtcctccatcctcctgcaggtctagtcaagcgtcctcctgctagtagtaatggtactaacaagttatttagtaagttcgggtacctggacgagtaaacggcccgaaggggacctagtccctacccgaacgtacgtccttccgtagtactttaccgtttaggtttttccgggtacttaacggtccggggtcccggttaccccgggggtccctagggtaccgttacgggtttcgacggtttcgggacgtagggtcggtactcggaacggcctaagtagttaacgttttaaccacgtaaagtaaactcgaacgctaggtaaggtgggacgtagtagggaggttagtttgggttagttagttttacgttacgtagtagtacg

SEQ ID NO: 249094 - DNA, 720 bp, Homo sapiens
  misc_feature: GYAE6OF02FGBLU.35.71.G05.1.454.CMB.1.raw
  modified_base (325)..(325): a, c, t, g, unknown or other
  misc_feature (325)..(325): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgttctcgtaggctccctgctcagctccgggctgctaatgctctgggtctcgtggatccaggttggggatattggtgatgactcagtctccactcctccctcgcccgtcacccctggagacgccggcctccatctcctgcgtaggtcctagtccagacgtcctcctgcaatagtaagnggaactactaagttattagaaattcggtactgacaagacgccgaaggggcacggtcctacccgacgtacgacctcccgtagtacgttcgttaagttttcgggttaccttaaacggttcccggggtaccccgtttacccgggggttacccctacgggtaaacgttacgggtttaaccgacggggtttacgggaccgtaaggggttacggacgtttaccggaagggtacccaaacgttaaggtttaaccgtttttaaccgaccggttaacgtaaaaacgttcgaacggtaccggtaggggtaacggtacggggtaaccgtcggttaacgggaaacgggtttagtttacgggttaggttaacgttttaacggttacgtacgggttactaagttaaccg

SEQ ID NO: 249095 - DNA, 630 bp, Homo sapiens
  misc_feature: GYAE6OF02JJKS5.35.71.G05.1.454.CMB.1.raw
  modified_base (412)..(412): a, c, t, g, unknown or other
  misc_feature (412)..(412): n is a, c, g, or t
  modified_base (541)..(541): a, c, t, g, unknown or other
  misc_feature (541)..(541): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtgggctgctaatgctctgggtctctggatccaggtggggatagttgtgatgactcagttcctccacttccgtccctcgtccccgtcaccccgtggacgacggcccggcctccacttcctccgtgcgtacggttctagtcaggacgccctcctgactatagtaatggaactagaagttatttagaacgttgtacctgctaagacgccggaaggctagtcctacgacagcctcgtanattcgttagtttggtacctaacggtccgggtacccgtcggggtccctggtacgtacggttacgaggttcggactgggtacgagaccgagaccgtaacgtaagttaccgttttaacgactaagtaaaccncggaacgtacgtaggaggtgggtaacggtcggtaaggtacggtaagttgggttaacggtttacttttaacgtcggtacgtacttacggg

SEQ ID NO: 249096 - DNA, 858 bp, Homo sapiens
  misc_feature: GYAE6OF02H488J.35.71.G05.1.454.CMB.1.raw
  modified_base (190)..(190): a, c, t, g, unknown or other
  misc_feature (190)..(190): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacatgaggctcctgctncgctcgtgggctgctaatcgcttcgtgggtctcgtggactccgaggtgggtattagttgtgatggactgtacgtctccgtactcctaccgtcgcccccgttctaccccgtgggaccgtcggccccggtaccttacctactttccgtaccccgttggtacccgtacggtttaccgtacgggttacccgtaacggtaacccgtccccgtttacccgttaccgacccgttaaaggtttttaacggtaaacggtttacggggaaacgttttaaaaacccgtttaaaccggggttttagtttttaaacggttaaacggttttaccggggtttaaacccttacgggaaccggttaaaccgggtaaaccggtcccgggtaaaccgggtaccggttaaccggtacccgttaacccgtaagtacccggttacccggttacgtaccggttaacttaccggttttaacgtttttaccggggtttacgttaaacgggtcccgggtacccgggtttaccgggtcccttacgggtacgtaacgggtttccgacgggttacggacggttacggtacggttactacggtacgtaccgttaacggtaacgttaccttttaacggaaccgttaaacgtaaccgtcgtaacggttccgaagggtaccggttagggtacggtaacggg

SEQ ID NO: 249097 - DNA, 644 bp, Homo sapiens
  misc_feature: GYAE6OF02F5EZW.35.71.G05.1.454.CMB.1.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (310)..(311): a, c, t, g, unknown or other
  misc_feature (310)..(311): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctcgtgggtctctggatccaggtgggatattgtgatgactcagtcctccacctcctccctcgccctccacccctggagacgcccgcctcactcctcctgcnggtctagtcagcncctccnncatagtaagtggaactactaagttattagtaagttcggtacctcggactaaggaacgaccgagggacctaacgtcctacccgacgacgtccttccgtagtacttcctttaagtttcgggttactaacggtcccgggtacctacccgggcgtcccgtaggtaccgtacgggttcgtacggtcgtaccgtaggtacggtactacggtacgggtaccacgtaagtttaaccgtttaacaacgtaagtaaacctacgagacgtaggtaacgggtacggtaagtcgttacggtaggtacggtttaggtttaggttaagtttacgtttaccgtagtacg

SEQ ID NO: 249098 - DNA, 736 bp, Homo sapiens
  misc_feature: GYAE6OF02F8MW7.35.71.G05.1.454.CMB.1.raw
tcagtacagatcgtcacgaccggtgctcgatttagtgtcgtcgcaagagagaggggggtgaggtgaaagatgagctggaggaccgcaataggggtaggtcccctgtggaaaaagggtcagaggccaaaggatgggagggggtcagggctggaactgaggagcgagggtgggggcacttctccctctaacactcctcccctgttgaagtctcttgtgatcaggactcctcagttctaccttctacacatgaggcctccctgcctcagtcctccgtggggctgctaatgctcgtggtctctggactccgaggtgggattagttgtagatagactacgtacgttcctccaccttcctcccgtccgtccccgtcctaccccggtaggacgtacggcccgtaccctacctacgtacctccgtacgtacgtaaccggttacttaacggtccgtaacggaccgttcccgttaccgtacggacctaacgttaaacggttaacgtacggtaaactaaccggtaaaggtttaacgtttaaagttaacgttacggttaccgtagacgtaaacgaaccgggtacccggagggtaacctacgttaccccgtaccgaacgtaccgtaccgttaccgtattactttacgtttacggtttaccggttacttaaaccgggtcccgggttacccggttccccgggttacctacggttaacggttacggttaccgaggttcggacgtaggtacgg

SEQ ID NO: 249099 - DNA, 675 bp, Homo sapiens
  misc_feature: GYAE6OF02GEY6J.35.71.G05.1.454.CMB.1.raw
  modified_base (668)..(668): a, c, t, g, unknown or other
  misc_feature (668)..(668): n is a, c, g, or t
tcagtacagatcgtcacgaccggtgctcgatttagtgtcgtcgcaagagagagggggtcagactggaactgaggagcaggtgggggcacttctccctctaacactctcccctgttgaagctctttgtgacgggcgagctcaggactgatcaggactcctcagttcaccttctcacaatgaggcctccctgctcagctccgtggggctgctaatgctcgtggtctcgtggatccgaggtggggtattagttgtgatcgactcgacgtcctccactcctcccgtcgccccgtcccaccccgtaggacggaccggtcccggtaccctcctacttcctccgtcgacgtacggtctacgtacgaggtaccgtccctccgtgactaagtaagtagtaggactaacgtaagttattagtaagttcgtaccgtgacaggtacgaccgagggtactacgtcctacacgacgttcccgttcgtagtacgtttacgtttaggtttttaccgggtaccttaaccggggtccgggtaccccggttcccggggttacccgtaggtaaccgtttacgggttacgtagggttacggacgtcggtacgacgttcgtacggacgtagtacggtttaactttaaccgagttaacgtaattccgaagtaccgaaggtagtacggggtntaacggg

SEQ ID NO: 249100 - DNA, 694 bp, Homo sapiens
  misc_feature: GYAE6OF02JIZIV.35.71.G05.1.454.CMB.1.raw
  modified_base (259)..(259): a, c, t, g, unknown or other
  misc_feature (259)..(259): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctcctgctcagctccgtgggctgctaatcgctcgtggtctcgtggactccgaggtgggattagttgtggatgacctnagtcctccgactcctccctcgccccgtccaccccgtggacgtacggacccggtcccttaccacgttccctccgtgaccgtacgggttactacgtcgtaaggacctcccgttcctgactaacgttacgttagtacggtaactaacgtaagtttatttacggtaatttcggtaaccttcgacgtaaggaacgaccggacgggtactaccggtcctacccgacgtacgtaccgttccgtacgttacgtttacgtttacggttttacggttacgttaaacggttccgggtaccccggtttcccggggttacccgtacggtaccgtacggttacggtacggtcgtacgtacggttggtacgtacgtaggacgtacgtaacgtttaactttaactacgtaacgtaacgacgtacgtacgaaggtacggtcggtagtacggg

SEQ ID NO: 249101 - DNA, 682 bp, Homo sapiens
  misc_feature: GYAE6OF02GAEL0.35.71.G05.1.454.CMB.1.raw
tcagtacagatcgtcacgaccggtgctcgatttagtgtcgtcgcaagagagaggggggcacttctccctctaacactctcccctgttgaagctctttgtgacgggcgagctcaggccctgatgggtgacttcgcaggcgtagactttgtgtttctcgtaggctccctgctcagctcctggggctgctaatgctctgggtctctggatccagtgggatattgtgatgactcagtctccactctccctgccccgtcaccccgtggacgacgcccggcctccatcctcctgcacggtctagtcagacgcctcctgcatagtatggatacgagttattagagttcggtacctgcagacgcgagggctagtcctaccactacgtcctccgtgtacttcgtttagttttcgggttaccttaacggtccggggtcccgttcccgggggttacccctagggtaaccgttcgggtttaccgacgggttcgggtacgtgggttaggtaccttacggacgggaccctaacgtaaggtttaacctttttaaccgaaacgttaggtaaaaccgttccgaacggaccgttaagggtacggggttacggggtaaggtaccgggttaagggaacgggtttagtttacggggttttaagggttaacgtttttaggtttaaccgttggtaccttaaccgg

SEQ ID NO: 249102 - DNA, 1154 bp, Homo sapiens
  misc_feature: GYAE6OF02IKWBA.35.71.G05.1.454.CMB.1.raw
  modified_base (199)..(199): a, c, t, g, unknown or other
  misc_feature (199)..(199): n is a, c, g, or t
tcagtacagatcgtcacgaccggtgctcgatttagtgtcgtcgcaagagagaggggtcaggctggaactgaggagcaggtgggggcacttctccctctaacactctcccctgttgaagctctttgtgacgggcgagctcaggactgatcgaggactcctcagttccaccttctcactaatgacggcctccctgctcacnctccgtgggctgactatgctcgtggtctcgtggactccgaggtgggtattagttgtagatacgtacttcgtacgtccctacctacctccccgttaccccgtcccggtaccccccgttaccccgtaacccccggttacgggaccggacccggtccccccggttacccttaccccgtaaccgtttcccttacccggtaccgtacccggttaaccgggttaccgttaaccggtaccgtaaaccggtaccccgtccccgttacccggttacggtaacccgttaaaggttaaacgggttaaaacggttacgggttaaaaccgttaaaccgtttaaaaggttttaacgttttaaaacggttttaaacggttttaccggtttaacccgttaacgggttaacccggtaaaacgggttaaaccccgggtaaccggggttaacccggggtacccgtttaaaacccggtttacccccgttaaccccgggtaaacccgttaccccgggttaaccccttttaccgggtttaacccgggtttaaaccgttttttaaccccgggtttttaaccggggttttttaaaacccggggggtttttaaccccgtttaaaccccggggggttacccccgggggttttaccccccgggggttttaccccccggggtttaacccccgggttacccgggtttaaaacccgggggtttaccccggggttttaaaccgggttaccgggggtttaacccggggttaaccggttaaacgggggtttaacccgggtaacccgttaaccggggtaaccccggtaacccgttaaccggggtttaaaacgttttaaaccccggttttaaactaaaacccggggtttaaaccggttaaaaacccgggtttcccgggttaaacggttaaaccgggggttaaacggggttaacccgggggtttaaggggtaacccggggttaaacggggg

SEQ ID NO: 249103 - DNA, 730 bp, Homo sapiens
  misc_feature: GYAE6OF02GVMDG.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctcgtgggtctcgtggatccgaggtggggattagttgtgatcgacctacgtcgtcctacctcctccctccgtccgtccctaccccgaccggtaggacggccggcccgtcctcctactcctcgcgtacgtcgttacgtacgtacgacgtacctcccgtcgtacgtacgtaagttaagtaggtaacgtaactaacgttaagtttacgttaagttacggttacgtacgtacgacgtaacgtacggacggtacggtacgtaccgtaccgaccacgtctacctcgtagtacgttttacgtttagggtttacgtaccggtaccggggtcccgttaccccggggttcgactaccggtaggttccgtacggtcgcgggtaggtacggagttaccgaggaccctaagtagttttaacgttaaccttaagaaacgttaaaatccgaggtcgaaggttacgggtacgggtacggggttcaacggggtaagttacggtttaggtttacgggtttaacgttttaacgtacctaggtaccttaggttaaccgg

SEQ ID NO: 249104 - DNA, 670 bp, Homo sapiens
  misc_feature: GYAE6OF02GDG1X.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactctcagttcaccttctcacaatgaggctccctgctcagctcctgggctgctaatgctctggtctctggatccaggtgggatagttgtgatgactcagtctccactcctccctcgcccgtccacccctggacgacgccggtcctccactcctcctgcgtcgtctagtcagaccgtcctcctgtacaatacgtaagtgggtaacttacgtaaaggtttatttagtaaacgttttcgggtacctggaccgaaggaacgtaccggaacgggtctaacggttcctaccgaaccgagtcccttaccgtagtacttttcgttagttttcgggtttactaaacggttccggggtacccgttacccggggttcccttacgggtaaccgttacgggttacctacgggttcgacgtacgggttacgacgttacgacgggtctaacggtacgttaacgttttaccgtaacgttaacggtaaacttccggtaaggccgaaagggttcgggtaggtaccggttaacggg

SEQ ID NO: 249105 - DNA, 758 bp, Homo sapiens
  misc_feature: GYAE6OF02JASEN.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgtctcagctccgtggggctacgtaatgctcgtgggtcctctgggatccaggtgggatacgttgtgatgactcgacgtctccactcctacccgtcgcccgtccacccccgttggacgacgccggcctccgatcctaccgtgtacggttcgtagcgaagaccgtcctccgtgactacgtaagttaacgtggaacttaacgtaaagttacgtttagaacgtttaccggtacgtagtaccgaacggtaacggtacccgtaagggtccgtaacgttccgtaacccctacgttacggaccttacccgtaggtaaccttttacgttttaacggttttacgggtttaaccgttaaaccggtcccggggtacccgttcccgggggtacccttacggaacgtacggtttaccgaggtacggtccgtagggtacgagtcccgaggactaacgtaacgttaagttttaacccgaacgttaagtaaacgttacccgagtaaccgttaggtacggtaggggtaacgtcgggttaaggaacggttaggttacgggttaaggtttaacggtttttacgtaccggtaggttcctacgttacggtaaacc

SEQ ID NO: 249106 - DNA, 739 bp, Homo sapiens
  misc_feature: GYAE6OF02H5N3J.35.71.G05.1.454.CMB.1.raw
tcagtacagatcgtcacgaccggtgctcgatttagtgtcgtcgcaagagagagggggcacttctccctctaacactctccctgttgaagctctttgtgacgggcgagctcaggccctgatgggtgacttcgcaggcgtagactttgtgtttctcgtaggctccctgctcagctcctgggctgctaatgctcgtgggtctcgtggactccgaggtggggacttagttgtgagtgactcagttcctcctactcctccctcgtccccgtccaccccgtggacgaccggtcccggcctcctactcctccgtcggactacggttcctagtaccgaagtaccgtcccgttcctagcctaagttaacggttaagtacgggtaataaacgttaaaggtttacgttttagtaacgtttaccgggttacttacgacgtaacgaacgtccggaagggtacctacgttccctaccgacgacgtccgtaccttaggtctttaccgtttaaggttttccggttaaccgtaacggtttccggggtaccccggttcccgggggtttaccctacggttaacgttccgggttacgtaagggtcggtacgttagggtcggtaacgtccggaacggtaccaagttaacgttaattttacccgaaacttaagaaacgtcgaaggaccgaggtacggtagggtccgtagtgggtaagttaggttcggttaacggttagttttagtaccgtagtactaacgg

SEQ ID NO: 249107 - DNA, 623 bp, Homo sapiens
  misc_feature: GYAE6OF02H70HZ.35.71.G05.1.454.CMB.1.raw
  modified_base (617)..(617): a, c, t, g, unknown or other
  misc_feature (617)..(617): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggacctcctcagttcaccttctcacaatgaggcctccctgctcagcctccgtgggctgctaatgctcgtggtctcgtggactccgaggtgggattagttgtagatcgactcgtacgtcctaccactcctcccgtcgccctcacccgtgacgcgccgtcctccatcctctacgcgtacggtctagtcaggacgtcctcgtgactagtaagtagtggaacttaacgtaagtttatttagaacgtttcgacctgaccgtaagaccggccgagggtcctagtcctaccgagtcgtccgttactagtacttacgtttaggtttacggtacttaaccggtcccgggtacccgttcccgggtcctagggtccgtacggttccgtaggttcgacgtaggttacgacgtcacggtacaagttcgtttaacctttacgaagttaaacgaactcggtaacacgtaggtaaggtcggngtacgg

SEQ ID NO: 249108 - DNA, 395 bp, Homo sapiens
  misc_feature: GYAE6OF02FMFPV.35.71.G05.1.454.CMB.1.raw
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (382)..(395): a, c, t, g, unknown or other
  misc_feature (382)..(395): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattacgatatgtggagtggttattacacggaaaactacgtggggccagggaaccctgctcaccgtctcgtcagcctccaccaacgggcccagtcggtccttccccctggccacccctccctccaagacgccacctcgtcgggggcacgagccggcccgtgggcctgccgtggtcaaggactactcccgacgntctgtactgagcgggcnggcaaggcgcatagnnnnnnnnnnnnnn

SEQ ID NO: 249109 - DNA, 1028 bp, Homo sapiens
  misc_feature: GYAE6OF02F3PWX.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagcttctttgtgacgggcgagctcaggactgatcaggactcctcagttcaccttctcacaatgaggcctcctgctcagctcgtggggctgctatcgctcgtgggtctgtggactccgaggtggggtattagttggtgtatgaccttacgaacgttcctaccctaccttccctccccgtccggtcccccgttcccctaccccggtgggacggtaccgggccccggtacccctaccctacttcccgtaccgttcggaccgtaacggttccgttacggtaccgtaacggtacccgtcccttccgtaggtacctaaagtttaacggttaaacgttacgggtaaacttaaaccggttaaaggtttacgtttttaacggttaaacggttttccgggttaacccgtcggtaaccgtaaagggtaacccggaaccggggtacggggttaacctaccgggtttaccctaacccgtaaccggtaaccgttacccggtttacccgtacggtttaacgtttttacggtttttaacgggttttttccgggggttttaaacccgtaaccggggttttccccccgggggggttaccccccgggttttacccccgggggggtttttacccctaacggggggtttaaacccggggttttaacccggggtttttacccggtaacggggggtttacccggttaaacccgggtttaagggggtttaaacccggggttaccgtaaccggggttaaccgggtacccgttaaaaccccggttttttaaagggggtttaaacccttttttttaaacccggggaaaacggttttaaaaccgttaaaaacgggtttaccccggaaggggggttaaacccgtaaaggggggtttaacgggggggtttaacccggggtaacggggtttaaacccggggg

SEQ ID NO: 249110 - DNA, 722 bp, Homo sapiens
  misc_feature: GYAE6OF02F5Z3D.35.71.G05.1.454.CMB.1.raw
  modified_base (192)..(192): a, c, t, g, unknown or other
  misc_feature (192)..(192): n is a, c, g, or t
  modified_base (232)..(232): a, c, t, g, unknown or other
  misc_feature (232)..(232): n is a, c, g, or t
  modified_base (711)..(711): a, c, t, g, unknown or other
  misc_feature (711)..(711): n is a, c, g, or t
tcagtacagatcgtcacgaccggtgctcgatttagtgtcgtcgcaagagagagggggtcaggctggaactgaggagcaggtgggggcacgttctccctctaacacgtctcccctgttgaagctctttgtgacgggcagctcaggactgatcaggactcctcagttcaccttctcacaatgacggtcctccgngctcgacgctccgtgggctgactagtcgctcgtggtctgngatcgaggtcggattgtgtgtagtgtactacgtacgttcctaccgtacttcccgtcccgtcgtaccccgtacccgtacccgtaggtacgaccggtcccggtcctaccgtactccgtccgtcgacgtacggttacctacggtaccgaacggtcctccgttccgtaacgtacgtaagtttaacgttaacgaaccggtttaaactaaaacggttaaacggtttaactttaaaggtaaccggttttacggttaacccgtcggtaacgtaacggaacccggacggtaacgggtacctacggtaccctaccgtagtaccgggtcccttacggtacgtaaccgtttactttagggtttaaccggtacttaccgggttccgggtacccggttaccggtccaacgggttaccgttcggtaacgtgggtacgacgtaggtcacggttcagactacgtacgtattacgaactagactgagtacgagggtntacggtagacg

SEQ ID NO: 249111 - DNA, 635 bp, Homo sapiens
  misc_feature: GYAE6OF02GGOHF.35.71.G05.1.454.CMB.1.raw
  modified_base (330)..(330): a, c, t, g, unknown or other
  misc_feature (330)..(330): n is a, c, g, or t
  modified_base (553)..(553): a, c, t, g, unknown or other
  misc_feature (553)..(553): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctctgggtctcgtggactccgaggtgggattagttgtgatgactcagtcctccacctctccctcgcccctccaccccgtggacgacgcccggtcctccgactcctccgtgcgtacggtctacgtcgagaccgtccctcncgactagtagtagtagactaacgtaagttagttagtaacgttcgtacctgacgtaagacgcgaggctacgtccacacgtcgtctacgtgtacttcgttaggtttcgtacttacgggtccggtcccggttccgggtacctggtaccgttacggttcgtacgtcggacgtaggtcgtactacgaggtacctagttacgttacgtttaacgtaactaaagtaaccnggacgtagtacgtaggggtcgacggtagtaaggtacggtttacgttagggttagtttacgttaggtccgtaggacttaacgg

SEQ ID NO: 249112 - DNA, 629 bp, Homo sapiens
  misc_feature: GYAE6OF02FZFXJ.35.71.G05.1.454.CMB.1.raw
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggacctcctcagttcacccttctcacaatgaggcctccctgctcagctcgtggggctgctaatgtctctgggtctctggactcaggtgggattattgtgatgactnacgtctccnctcctccctcgcccgtccaccccgtgagacgccggcctcactctccngcgtagtctagtcagtccgtcctccngcatacgtaagtagataacgtagttaattagtaagttacggtactacgacgtaagacggaaccgtggacctagtcctaccgactacggctcccgtagttacttcgttacgttttacgggttaccttaccgggtcccgggttccccggttaccccggggtcctaccgggtaccgttagggttcgtaacgggttcgacgtaggttcgagttacgacggtacccagttaacggtaacctttacgaaccgttaagaacgtaccaaggtcgaagggtacggtagggacctaaggg

SEQ ID NO: 249113 - DNA, 667 bp, Homo sapiens
  misc_feature: GYAE6OF02GJT43.35.71.G05.1.454.CMB.1.raw
tcagtacagatcgtcacgaccggtgctcgatttagtgtcgtcgcaagagagagggggcacttctccctctaacactctcccctgttgaacgctctttgtcgacgggcgagctcaggccctgatgggtgacttcgcaggcgtagactttgtgtttctcgtaggctccctgctcagctccgtggggctgctaatgctctggtctctggatccaggtgggattagttgtgatgactcagtcctccactcctcccgtcgcccgtcacctcccgtaggacgacgcccggcctccacttcctcccgtgaccgtaggttccgtagttcgacggacgtcccgttcctacggcctaattagtaaagtcggaataacgtaagttatttagtaacgttcggtacctgacgagaacgccgaagggctacgtcctacaccgtagtcctctagtacttcgttagtttggttactaacgtccgggtccgttcccgggtcctacggtacgtacgggttcgtagtggacgtaggtgtacgtcgcggtaccacgtaacgtttaatttacgtaacgtaaacgtaaagtcgaacgtagtaacggtaggttacgggacggtacggtaagggtacggttaagggttaggtttaagggtttaagttttacgtttacggtgttaaaccggg

SEQ ID NO: 249114 - DNA, 641 bp, Homo sapiens
  misc_feature: GYAE6OF02FM2WV.35.71.G05.1.454.CMB.1.raw
  modified_base (316)..(316): a, c, t, g, unknown or other
  misc_feature (316)..(316): n is a, c, g, or t
  modified_base (368)..(368): a, c, t, g, unknown or other
  misc_feature (368)..(368): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatgctcgtgggtctctggatccgaggtgggatagttgtgatgactcagtcctccactcctccctcgaccccgtcacccctggacgacggcccggcctccatcctcctgcgagtctagtcagcgtcctcngcatagtatggataacgtaattattagattcgtacctgacagacgcgaggcngtccacacgacgtctcgtagtactacttggtttacggtacttacggtccgggtacccgttcccggggtacctacggtaacgtcggttacgagggtcgtcgtaggtcggactccggtacggacctaacgtaaggttaccttttaacgaacgttaaaggtaaactcgaaaccggtcgtaaggtaacgggtgggtaccggtaacgggtacggtagggtttaacgtttagggtttacggtttaaacggttttaacgtcggttaccggtacttaacgg

SEQ ID NO: 249115 - DNA, 470 bp, Homo sapiens
  misc_feature: GYAE6OF02HYOSR.35.71.G05.1.454.CMB.1.raw
  modified_base (210)..(210): a, c, t, g, unknown or other
  misc_feature (210)..(210): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (420)..(421): a, c, t, g, unknown or other
  misc_feature (420)..(421): n is a, c, g, or t
  modified_base (423)..(423): a, c, t, g, unknown or other
  misc_feature (423)..(423): n is a, c, g, or t
  modified_base (426)..(470): a, c, t, g, unknown or other
  misc_feature (426)..(470): n is a, c, g, or t
tcagtacagatcgtcacgaccggtgctcgatttagtgtcgtcgcaagagagagggggcatactcaccatgaccgaggacacatctacagacacagcctacatggagctgcgcagcctgagatctgacgacacggccgtgtattattgtgcaacagaaaattacgatatgtggagtggttatacaacggaaactgtgggccagggaccctnctcaccgtctcgtcacgcctaccaccgaagggcccatccggtcccttcccctggccncccctcctaccgaagcncctaccgtcggtcggggcacgacggccggcccgtggggctcgccgtcggtacgaaacggtccttaccttaccgaacgtactcgtacgtacgtcggacgggccgggtacgcgggacgaacgggccgacgtagtacgnngncgnnnnnnnnnnnnnnnnnnnnnnnnnnnnnnnnnnnnnnnnnnnnn

SEQ ID NO: 249116 - DNA, 713 bp, Homo sapiens
  misc_feature: GYAE6OF02HH7O6.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctccctgttgaagctctttgtgacgggcgagctcaggactgatcaggactcctcagttcaccttctcacaatgaggcctccctgctcagctccgtgggctgctaatcgctcgtgggtctcgtggactccgaggtggggattagttgtagtatgactctacgtcctcctactcctccctcgcccctccaccccgtggacgcggcccggcctaccgactcctccgtcgcgtacgtcgtacgtcgaacgacgtccctccgtcgtacctaagttaagtaagtacggtaacttaaacgtaaggtttaatttaggtaaacgttttcggtaccgttgaaccgtaaggaacgtaccggacgggtaccgtacgttacctacccgaactacgtaccttaccgtgtactttacgtttaggtttacgggttacttaaccggtccggggtacccggttcccggggtcctacggtaaccgttcgggtttacgtacgggttcgtaccggtacggtagggtacttacgggacggtacgtaacggttaacgttaacgttttaaacacggttaaacgtaaacgttcggtaacggacgtaagggtacggttagggtacggtacgggg

SEQ ID NO: 249117 - DNA, 719 bp, Homo sapiens
  misc_feature: GYAE6OF02GS9B8.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctcctggggctgctaatcgctctgggtctcgtggatccaggtggggattagttgtgatcgactcagtcctccactcctccctcgcccgtccaccccgtggacgacggcccggcctccatcctccgtgcaggtctagtcgagacgtcctcgtcgctagtagtaatggaattaacaagttagtttagaagttcggtaacctgaaccgagaacgccgagggactacgtccgtaccaacgcgtacctccgtagtacttacgttagttttacgggtacctaaagggtcccggggtaccccgttcccgggggttacccctaggtaccggttaacgggttttcccgaagggttcggtaccgtagggttacggtaagtcccggttaaagggccctaacgttaaacgggtttaaccttttaaccgaaacgttaacggtaaaaacgttccgaacggtaccggaaggtagggtaccgggtacggtaacggtacgggtaacggttaaggttaccgggtttaagggttaaaccgttttacgtaacggtcgtacgtaacgg

SEQ ID NO: 249118 - DNA, 558 bp, Homo sapiens
  misc_feature: GYAE6OF02ITM9G.35.71.G05.1.454.CMB.1.raw
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (489)..(489): a, c, t, g, unknown or other
  misc_feature (489)..(489): n is a, c, g, or t
tcagtacagatcgtcacgaccggtgctcgatttagtgtcgtcgcaagagagagggggcacttctccctctaacactctccctgttgaagctctttgtgacgggcgagctcgaggccctgacgtgggtcgacttcggcaggcgtagtactttgtgtttcacgtaggcctccgtgctcacgtctccgtggggntcgctaagtgctcgtgggtctcgtggactccgaggtggtactntgtacgatnactcgagtctacctcttcctccgtacgtccctcacccgtggaacgcgtccgcctcatcctcgtnccgagtactgcagcncctngcatgtangaatcagttatncgttagaccngacaagtacgcgtcgancgttacncgangtacctntacgatcgtgttcacgtancgtaccgtcggctcgacgtagtacgagtacgcgngacgtnacgtacggcaacgtagtaacttacgacttaagaacgttnacgcgtaagcgaaggtacgtcgtaaggtacgaggtttgtaaccggtgtttaagtacgtagtacgtaacg

SEQ ID NO: 249119 - DNA, 721 bp, Homo sapiens
  misc_feature: GYAE6OF02H91RG.35.71.G05.1.454.CMB.1.raw
  modified_base (715)..(715): a, c, t, g, unknown or other
  misc_feature (715)..(715): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggcctcctgctcacgtctccgtggggctgctaatgctcgtcggtctcgtggactccgaggtgggattattggtagatgtacctcagtcctccactcctcccgtcgtcccgtcctaccccgtggacgaccgcccggtcctacctactcctccgtgccgtacgttacgtacgtacgacggtaccgtccttccgtacgactaagttaagttaaacggtaggtaaacttaacgtaaacgttttacgtttaaggtaacgttttagggtaccgttcggaaccgtaagggtaaacgtcgggtaacggacgtaacgttacctaacccgtagtaccggtaccttcccggtaagttacgttacgtttttagggtttccgggtttacttaaccgggttcccggggtcccgggttacccgggttacccgttacggacggtacgggtttcggtagggtccgggtaggtcggttaacggactacgacggtactacgtaacgtttaacgttaccgaataagtaacgtcgacgtagtacggtgggtacggnggtacg

SEQ ID NO: 249120 - DNA, 687 bp, Homo sapiens
  misc_feature: GYAE6OF02GQPOO.35.71.G05.1.454.CMB.1.raw
tcagtacagatcgtcacgaccggtgctcgatttagtgtcgtcgcaagagagaggggggtgaggtgaaagatgagctggaggaccgcaataggggtaggtcccctgtggaaaaagggtcagaggccaaaggatgggagggggtcaggctggaactgaggagcagggtgggggcacttctccctctaacactctcccctgttgaagctctttgtgatcaggactcctcagttcaccttctcacaatgacggcctccctgctcacgtcctccgtggggctgactaatcgctcgtggtctcgtggtactccgaggtgggattagttgtgatcgactcgtacgtctccactcctcctcgtccctccacccgtggacgtaccgccgtcctaccgactcctccgtgtaccgacggttctacgtcgacggtccgtccctccgtcgtacctaagttaacgtaagttacggtaacttaaacgtaacgtttagtttagttaacgttacggttacctcggacgtaacggaccgaccggtaacgggtaccgttaccgtcctacccgtacgtaccgtcctaccgtacgtacctttacgtttacggttttacggtttaccgtaacgggttcccgggttacccggttcccggggttccctacggttaccgttacggttcgtacggtcggtacggtagtacggg

SEQ ID NO: 249121 - DNA, 723 bp, Homo sapiens
  misc_feature: GYAE6OF02H1P04.35.71.G05.1.454.CMB.1.raw
  modified_base (363)..(363): a, c, t, g, unknown or other
  misc_feature (363)..(363): n is a, c, g, or t
tcagtacagatcgtcacgaccggtgctcgatttagtgtcgtcgcaagagagagggggtcaggctggaactgaggagcaggtgggggcacttctccctctaacactcgtccctgttgaagctctttgtgacgggcgagctcaggactgatcaggactcctcagttcaccttctcacaatgacgctcccgtgctcagtcctcgtgggctcgactaagtcgctcgttggtctacgtgtactaccggtggtagggtacttagttgtgtagttacgacttcgacgttcctaccaccttcccgtcccgtaccgaccccgttcccgacccgttaggaccgaccggccccgtacctcctacgtccgtaccngtaccgtaccgtacgtagtactacggtaccgtcctacgtcgacgttaacgtagtacgtacgggtactaacgtacgtttataacgtacgttcggtactagacgtagacgacggacgtacgtcgtaccgactacgaccgttctacgtagtacgttcgtttaggtttaccggttccgttaacgggttcccggttacccggttacccgggttcttaaccgggttcgtacggttcggttacgggacgtacgtacggtaggtacgttaccgacgttacttaccgggtaacttttaaccgtaacgttaaaccgtaacgtaaacccggtcgtaacggtaccggagggttaaccggagggtataccggg

SEQ ID NO: 249122 - DNA, 804 bp, Homo sapiens
  misc_feature: GYAE6OF02JJDWI.35.71.G05.1.454.CMB.1.raw
tcagtacagatcgtcacgaccggtgctcgatttagtgtcgtcgcaagagagagggggcacttctccctctaacactctccctgttgaagctctttgtcgacgggcgagctcaggccctgatgggtgacttcgcaggcgtagctttgtgttctcgtaggctcctgctacagctctgggctgctaatgctcgtggtctacgtggactccgaggtcgggatgttcgtgactgactcgagtcctacgactcgtccgtcgccgtactacccgtggactacggccggccttcgaattccgtccgtgaccgtagggttcccttagtaaccgtcgtacggtccttcgacgtgtaaccgttaggtactacggacttacgaacgtttagttacgtaagtttccgggaccttagtccgaacggtacgaccgtagggaccgtaggtacccttaccgacgttacgtaacccttccggttagtaacgtttaccgttacggggtttttccgggtaaccctttaaaggggtcccgggtacccggtttaccggggttacctacggggttaaccgttaacgggttaccggttagggtaaccgtacgggttaccggtaggtaacgtacccgggttagtaccggttaaaccgtacggtttaaccgttttaccgaaacccggtttaggtaaaaaccgttcggttaaacccgggacgtttaaccgggtaaggttccggggttaccgtacgggtttaggaaccgggttggttaacggtttacgggtttaaacggtttccgggtacttaacccggggtgttaaaccgg

SEQ ID NO: 249123 - DNA, 653 bp, Homo sapiens
  misc_feature: GYAE6OF02H2Q5D.35.71.G05.1.454.CMB.1.raw
  modified_base (577)..(577): a, c, t, g, unknown or other
  misc_feature (577)..(577): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcactaatgagtcctcctgctcagtctccggtgggctgtactaatcgtcttcggtggtctcgtaggtactaccgtagggtgggattagttgtgtatcgtactctacgtcctccactcctcctcgtcccgtaccacccgtggacgtcggccggtcctacgacttcctaccgtgcgtacgttctacgtcgaagtcctcctcgtacactagtaagtaagtacggaactaacgtaagttattagtaagttcggtaacgtgacgtaagacggacgcgggactacggttccacgagtaccgtcctcggtattacgttcgttaggttttcggttaactaccggtccgggtcccggttcccggggtcctacgggtacgttaccggttcggacggttcggactacgggtgtaacncggtacggacctagttaacttaccgtttaagaactaacgtaagcgaagggtcctaaggcgggttagacgtaacggg

SEQ ID NO: 249124 - DNA, 670 bp, Homo sapiens
  misc_feature: GYAE6OF02HGMWN.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctccctgctcagctccgtggggctgctaatgctcgtgggtctctggactccgaggtgggatattgtgatgactcagtctccactcctccctcgcccgtcaccccgtggacgacgcccgcctccactcctccgtcgctaggtctacgtctacgacgtcctcgtgactagtaacgtaagtggaattaacgtaagttactttagtaacgtttcggtaacctgtactaacggaaacgtcccggagggtccaacggttcccaaccgactacggtccttaccgtacggtatttaccgtttaggttttcgggttaactaacggttcccggggccccgtttacccggggtacccttagggaccgttacggttcgaacgggttcggtaccgtagggttacgaactccgggagccgtaacggtaacgtttaactttaaaccgtaacgtaaacggtaaactcggtaacggacctaaggggtacgttacgggagtaccgg

SEQ ID NO: 249125 - DNA, 641 bp, Homo sapiens
  misc_feature: GYAE6OF02I66ZE.35.71.G05.1.454.CMB.1.raw
  modified_base (392)..(392): a, c, t, g, unknown or other
  misc_feature (392)..(392): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtgggctgctaatgctctgggtctctggatccgaggtgggatattgtgatcgactcacgtctcctactcctccctcgcccgtccaccccgtggagacgcccggcctccactctcctgctaggtctagtcagcgtcctcgtgctatagtatgatacgtaagttattagattcggtacctgactagacgcgacgggcacgtcaccacgcgcgtacctntacgttacttaggtttcggttacgtacgggttcccggtcccggttccggggttccccaggtaaccgttacgggttctaacggtcgacgtagggtacggacttacggaacggacctaacggtacgtttaactttaacgaacgttaaagtaaaacgtcgacgtacgagggtacggtacgggtaaggtaccgtaagggtaacggttggttagggtttacgttaacggttttaacttacggtcgtacgtaacg

SEQ ID NO: 249126 - DNA, 663 bp, Homo sapiens
  misc_feature: GYAE6OF02I644R.35.71.G05.1.454.CMB.1.raw
  modified_base (273)..(273): a, c, t, g, unknown or other
  misc_feature (273)..(273): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcagtcgtagactttgtgttctcggtaggctccctgctcagctccgtgggctgctaatgctcgtggtctcgtggatccgaggtggggattacgttgtgagtcgactcgacgtcctccactctcccgtcgcccgcctacccgngacgacggccccgtccgtaccacgtcctccgtagcgtacgttcgtacgtacgacgacgtacccgtctgacctaataagtaacgtcggtaataacggtaagtttagttagtacgttacgtaccgtacgagaacgaacggtaccgacgggacctacgtccgtaccaacgtcgccgtacgtagtcttacgttagttcggttactaacggtccggtaccgtccgggtaccacgtacgtacggttcgaggtacgcgtacggtacgacgtacgaggttaccgaacgttacggttacttaaccgtaagtaaacgaactacgacgacgttaggacgggtaggacgtacggtaggtagttaggttacgttacggttaagttcgtaactcggtataacgg

SEQ ID NO: 249127 - DNA, 718 bp, Homo sapiens
  misc_feature: GYAE6OF02FS7TJ.35.71.G05.1.454.CMB.1.raw
  modified_base (589)..(589): a, c, t, g, unknown or other
  misc_feature (589)..(589): n is a, c, g, or t
tcagtacagatcgtcacgaccggtgctcgatttagtgtcgtcgcaagagagagggggcacttctccctctaacactctcccctgttgaacgctctttgtgacgggcgagctcaggccctgagtgggtgacttcgcaggcgtagactttgtgttctcgtagctccctgctcagctccgtgggctgctatgctcgtggtctctggactccgaggtcgggtacttagttgtacgatcgactcgacgtcctacctacctcctcccgtcgtccccgtccaccccgtggacgtacggcccggtccctaccgtacttcctcccgtacgtccgtacggttactacgtacaacggtacgtccgttccgtacgaacctaacgttaaacgtaaacgttacggtaaccttaaccgttaaacgtttaagtttaacggtaacgtttacgggttaacccgtacgaccgtaacggaacggaccgtacgggactacgtacctacccgactacgtccctccgtagtacttacgttacgtttacggttaccgtacgtccgggtacccgtccggtaccgtacgtacggttacgtcgacggtcgtaccgnggtaccgacttcgacgactaacgtaagttaacttacgaaacttaagaacgtcgacggacgaggtacgggtacgtaccgcgtaaggacgtacggtttgttacggttaccttactaccgtacgacgtaacg

SEQ ID NO: 249128 - DNA, 734 bp, Homo sapiens
  misc_feature: GYAE6OF02HEYT1.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctcctgctcagctcctgggctgctaatgctctggtctctggatccagtgggatatgtgatgactcagtctccactctacctcgacctctacccgtggacgcgccgtcctccatccgtacctcgactacggtactagtaccgagaacgtcccttccgtagacctaagttaacgtaaacgtgggtaaactaacgtaaaggttatttaggtaaaagtttccggtaaaccgtggtacctaaacgggtaaacacccggaaacggggtcctaacgttccctaacccgaacgtacggtaccttaccgtagtaacgttcgtttaacgtttacgggtttaacgtaaacggtccggggtacccgttcccgggggtacccctagggtaaccgttacgggtttacgaacgggttaccgggtacgtacgggtacgggaacttaccggacggttaaccgaaacgttagttaaacgtttttaccgaaaccgttaaaggaaaacgtccgaagttacgaggttaacgggtcgaaggtcgtaggaaggttagttacggtttacggtaagttttcgtacgttcgaagttaacg

SEQ ID NO: 249129 - DNA, 729 bp, Homo sapiens
  misc_feature: GYAE6OF02F8IMU.35.71.G05.1.454.CMB.1.raw
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgctaatgctcgtggtctctggactccgaggtgggtatagttgtgtatcgactcacgtctccacctcctccctcggcccctccaccccgtggacgcggcccgcctccagttcctccgtgccgtacggttacgtcgtacgacgacgtccctccgtgactaatacgtaagtagaacttaactaagtttagttagtaacgtttacggtacctgacgtaagaaccgtaccggagggtactacggtaccctaccgtaacgtacgtcctacgtcgtaactttaccgtttaggttttacggtttacgttaaccgggttcccgggtacccgggttacccgggtcccgtacggtaacggttacggttcggtacggttcggtacgtacggtacggtacgtaccggtagtaccgtaagttaacgttaactttaaccgaacgttaaacgtaaaccgttagaccgtacggtaacggtacggtaacgggtagtaccgggtaagtacggtaggtttaggtttacggttaaccggtttaacgtacggtacgttacgtaacgg

SEQ ID NO: 249130 - DNA, 867 bp, Homo sapiens
  misc_feature: GYAE6OF02H1M2X.35.71.G05.1.454.CMB.1.raw
  modified_base (157)..(157): a, c, t, g, unknown or other
  misc_feature (157)..(157): n is a, c, g, or t
  modified_base (174)..(174): a, c, t, g, unknown or other
  misc_feature (174)..(174): n is a, c, g, or t
tcagtacagatcgtcacgaccggtgctcgatttagtgtcgtcgcaagagagaggggcacttctccctctaacactctccctgttgaagctctttgtgacgggcgagctcaggccctgagtgggtgacttcgacgaggcgtagtactttgttgtttcncgtaggctccctgctcngtcctccgtggggctgctaatcgcgtcgtgggtctcgtaggactcgtaggtgggattagtgtagatgtactcgaacgtcctccactccttccgtcgcccgtaccgcccgtaacggcgaacggcccggcccttaccgtaactcccgtttcccgaggtacgtaccggttacgttaacgcgtaaccgaacgtccctaccgtacgtacctaaagttaaacgtaaagtacgggtaacttaaacgtaagttacgtttagtaaggttaccgttacgacgaggaacggtaaacgggcggaccgtagttaccgacctacgaacggttcctccgttagtacttcgtttaagggtttacggttacgtaaaccggtcccgggtacccggtttccgggtacccggtaacggttccgtaaacggtttaccggaaggtcgggtaaacggtcgggtaacggtaaccggttacgacccggtaaccgtaaacggttaaccgttaaaacgttttaacccgtaaaacggttaaccgttaaaaaacggttaacccgaaaggttccccgggaaaagggtaaaggggttaccggggtttaaaacccgggtacgggttaaacgggggttaggtttaaacgggtttaaggggtttaacgggttttaaacggtttttaacccggtttaacgggttaccgtaacggtaaccggtaacccg

SEQ ID NO: 249131 - DNA, 760 bp, Homo sapiens
  misc_feature: GYAE6OF02G312Q.35.71.G05.1.454.CMB.1.raw
tcagtacagatcgtcacgaccggtgctcgatttagtgtcgtcgcaagagagagggggtcaggctggaactgaggagcaggtgggggcacttctcctctaacactctccctgttgaagctctttgtgacgggcgagctcaggactgatcaggactcctcagttccaccttctcactaagtgacggtcctccctgctcacgtcctccgtgggactcgactactcgcgttcgtggttactcgtaggactccggtaggtagggtattagttcgtgacttcgacttcgacttcctacctacttccgtacccttcgtccccgtacctaccccgtagggacgaccggtacccggtcctccgtactccgtccgtcgtcggtagtcgttacgtacgacggtacctcctcgtacggtactaacgttaaggttaacgtacgtaacgtaaacgttaaggttttacgtttaacggttaaccgtttacggtaccgtacgtaacgaacgggtaacccgacgggttacggaaccttaccggtacccgtacccgaaacgttccgtaccgttaccggttattaacgttttcggtttaacggtttacgttaccgtaaccgggttcccgggttcccgggttaccgggttacctaccgggttacgtcggtttaacggcggttcggtacggtacggttcgacgtcggaacgcgtttaacgttacgttaacttacgaactaagtaacgacgtacgtaacgtaggtacgggtacggtatacggg

SEQ ID NO: 249132 - DNA, 748 bp, Homo sapiens
  misc_feature: GYAE6OF02JJ1BA.35.71.G05.1.454.CMB.1.raw
  modified_base (171)..(171): a, c, t, g, unknown or other
  misc_feature (171)..(171): n is a, c, g, or t
  modified_base (235)..(235): a, c, t, g, unknown or other
  misc_feature (235)..(235): n is a, c, g, or t
  modified_base (576)..(576): a, c, t, g, unknown or other
  misc_feature (576)..(576): n is a, c, g, or t
  modified_base (721)..(721): a, c, t, g, unknown or other
  misc_feature (721)..(721): n is a, c, g, or t
tcagtacagatcgtcacgaccggtgctcgatttagtgtcgtcgcaagagagagggggcacttctccctctaacactctcccctgttgaagcttcttgtgacgggcgagctcaggccctgatgggtgacttcgcaggcgtagtactttgtgtttctgtaggctccctgctcngctccgtggggctgctaatgctcgtggtctcgtggactccgaggtgggtattattggtacggtntacgactcgtacgtcctaccctaccttccctcccgtccgtccccgtacccgtaccccgtgggaaccgcggccccggtacccttccacttcccgtccgtcgtcgtaacgggttcgtaacgtacgacggtacccgtcccgttaccgtggaacctaagttaagtaaacggtaacggtaactttaaccgtaaagttttaacgtttagttaaacggtttacggttaccgtacggaacgtaacggaccggacgacgggtctacgtacctccgaacgcgttaccctcgtgtacttacgtttaggtttggtacgttaccggtccgggtcccggttccgggtaccctcgnggttccggtacgtagggtcggactcgggtacgtacgcggtaggtaccctaagttaccgttacttaactaccgtaaagtaacgtagccgtaggaacggtggacgggtgtaccgtaggtacggtttacgggttaggtttaaggtttntttaacggtacgttacgtagtaaccgg

SEQ ID NO: 249133 - DNA, 525 bp, Homo sapiens
  misc_feature: GYAE6OF02JIR2A.35.71.G05.1.454.CMB.1.raw
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (489)..(491): a, c, t, g, unknown or other
  misc_feature (489)..(491): n is a, c, g, or t
  modified_base (493)..(493): a, c, t, g, unknown or other
  misc_feature (493)..(493): n is a, c, g, or t
  modified_base (497)..(498): a, c, t, g, unknown or other
  misc_feature (497)..(498): n is a, c, g, or t
  modified_base (500)..(500): a, c, t, g, unknown or other
  misc_feature (500)..(500): n is a, c, g, or t
  modified_base (502)..(508): a, c, t, g, unknown or other
  misc_feature (502)..(508): n is a, c, g, or t
  modified_base (510)..(524): a, c, t, g, unknown or other
  misc_feature (510)..(524): n is a, c, g, or t
tcagtacagatcgtcacgaccggtgctcgatttagtgtcgtcgcaagagagagggggcagactcaccatgaccgaggacacatctacagacacagcctacatggagctgcgcagcctgagatctgacgacacggccgtgtattattgtgcaacagaaaattcgatatgtggagtggttatacacggaaaactacgtggggaccagggaaccctgacctcgaacccgttctcgtcgacgtccctcccaccgaaacggggccccaagttccggttcctttccccccgtgggcctacccctcccgtaccaacgtacgccacccgttcggtcgggggccaccgtacggccggccccgttgggccttcggccgtcggtcgaacggaccttaccttccacgactctacgtacgtcgaggcggcgtcggacgaaaggccgacacgtacggancgactncncgtancgntgacngtcncgntntgcgnancgcncgnnncnacgnncngnnnnnnncnnnnnnnnnnnnnnnc

SEQ ID NO: 249134 - DNA, 716 bp, Homo sapiens
  misc_feature: GYAE6OF02HFNVX.35.71.G05.1.454.CMB.1.raw
tcagtacagatcgtcacgaccggtgctcgatttagtgtcgtcgcaagagagaggggggtcaggctggaactgaggagcaggtggggggcacttctccctctaacactctcccctgttgaagctctttgtgacgggcgagctcaggactgatcaggactcctcagttcaccttctcacaatgaggctccctgctcagctccgtgggctgctaatgctcgtgggtctcgtggactccgaggtggggtattagttgtagtacgtgtactcgtacgttcctccctaccttcccttccccgtccggtcccccggtcccaccccgtcgggacgaccggccccggccctccactcctcctcgcgtacggtctacgtcacgtacgtcctccgtgacctaattaagtagtacggtaacttaacgttaagttagtttaagttaagttacggttaccgtgtacaacggaccgtaccggagggtacctaacgtccttacccgacgtacgtcctaccgttagtacttacgttttacggttttacgggttacctaacggggttcccgggtcccgggtttccccgggggttacccgttacgtaccggttcgggtttacgtaggttcgtacggtaggttcggacgttaccggacggtactacggtaacttaacgtttaaccaagtaacgtaactaccggaagtaccggaagggtaggttagggtaggtacgg

SEQ ID NO: 249135 - DNA, 862 bp, Homo sapiens
  misc_feature: GYAE6OF02JJ3LN.35.71.G05.1.454.CMB.1.raw
  modified_base (217)..(217): a, c, t, g, unknown or other
  misc_feature (217)..(217): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagcttctttgtgacgggcgagctcaggactgatcgaggactcctctagttcaccttctcacaatgacggctcctgctcagctccgtgggctgtactatcncgtcgttgggttctcgtggacgtccgtagggtacggggtattagttggagattacgtacctacgtacgttcctcctactcccttcccgccgtcccgtcccaccccgtggacgtaccgcccgtacctccgtactcctcgcgtcgtagttcctaggcaacgtaccctccgttccagtaccgtaacgttaaacggttagttaacggtaacttaaaccggttaaaggttttactttaacgggtaaacgttttccgggtaaacctacgtaccgggtaaacgtaacgacccgggtacggggttaacccttaaccggttaccgttacccagggtttaaacccttccggttaccgtaacgttaccggttttaccggtttttaaacggtttcgggtttaaccgttaacccggggttccccgggtttaccccgggttaccccggggttaacccgtttaccgggtaccgtttaacgggttacccggtaagggttcccgaaaccgggtttcggtaaaccgggtcctttaaccgggacctaccggttaaccggtttaaccggtttaaccttttaaaccggtaaacgttaaaccggttaaccgtaccggttaaccggacggtttaaaaccgggtgggtaacccgggtcgttaaccgggg

SEQ ID NO: 249136 - DNA, 737 bp, Homo sapiens
  misc_feature: GYAE6OF02IR65N.35.71.G05.1.454.CMB.1.raw
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgagctcctgactnagtctcgtgggctgctaatgctcgtggtctcgtaggtactacgnggtagggtatagttgtagatacgactctagttacctcctactccttaccctccgtacccgttcccaccccgttacggtaaggaccggtcccgggtaccttccaaccgttccgttaccgtcgaaccgtttacgggttacttacggtaccgaacggtaccgtaccccgttacctacggtacctaaaggtttaacgttaaagtaagggtaactttaaaagtaaacgtttagtttaaggtaaacgttttacggttaaacccgtacgtaacgtaaaggaaccggtacccggtaacgggtaccgtacgtacccgtacgtaacgtacgccgttacctagtactttacgtttagttttacggttacgtaccggttacggtcccggttcgggtcccgttacgacgtacgttacgtaggtcgtacgcggtacgctacgacgtactaacgtcgttacttaacgtacttaagtaacttacgaaggtccgtaaggacggtacggtaggtaacggg

SEQ ID NO: 249137 - DNA, 759 bp, Homo sapiens
  misc_feature: GYAE6OF02JF2AB.35.71.G05.1.454.CMB.1.raw
  modified_base (169)..(169): a, c, t, g, unknown or other
  misc_feature (169)..(169): n is a, c, g, or t
tcagtacagatcgtcacgaccggtgctcgatttagtgtcgtcgcaagagagagggggcacttctccctctaacactctcccctgttgaagcttcttgtgacgggcgagctcaggccctgatgggtgacttcgcaggcgtagactttgtgttctcgtaggctccctgctnagcctccgtggggtctgctaagtgtctcggtggtctcgtggtactccaggtggggatagttgtgtatcgactcgtacgtcctccactcctcccttccgaccccgttcccacccggtggacgaccgccccggtcctaccctatccctcctggtaccgtacgttaccgtagaccgagtcccgtcccttcgtacgaccttaattaacggtaatacgggaactttaacgttaaagtttacgttaggtaacggttttaccgacgtacgtacggaacggtaacggacggtacgggactaacgttccgtacccggaaagtccgtacccgttactaggttacttttacgtttaggttttaccgggtacgtttaacccgggtccgggttaccccgggttccgggtaccctcggtaacgttcggttacgtcgggttacgtcgagggtacgtctacgggacctaggtaaattaccggttaactttaaccgaagttacgaaactcgacgtacggttaggaacgggttcgggtacgggtacgtagggtaacgtttcggggttaagtttccgggttaaagtttaccgtaacgtcgttataaccg

SEQ ID NO: 249138 - DNA, 765 bp, Homo sapiens
  misc_feature: GYAE6OF02I9ODG.35.71.G05.1.454.CMB.1.raw
  modified_base (308)..(308): a, c, t, g, unknown or other
  misc_feature (308)..(308): n is a, c, g, or t
tcagtacagatcgtcacgaccggtgctcgatttagtgtcgtcgcaagagagagggggtcaggctggaactgaggagcaggtgggggcacttctccctctaacactctcccctgttgaagctctttgtgacgggcgagctcaggactgatcaggactcctcagttcaccttctcacaatgaggctcctgctcagctccgtggggctgctaatgctcgtggtctctggactccaggtgggatattgtgatgactcacgtctccacgtcctcccctcgccccgtccacccctggacgacggccggcctccnctacctccgtcgcgtacggtacttcgtacacggacgtccctccgtcgactagtaagttaacgtgggtaactaaacgtaaggtttaacgttttacggttaagtttaccggtaaccgttcggtaacgtaacgggtaaacggacccggtaacggggtctacggtacccttaccgtaaccgacgttccccgttaccgttcgttactttcgttttaacggtttttcgggtttaaccgttaaccgggttcccgggggtaccccgtttaccccggggggttcccgttaaccggtaccggttacgggttaccgttaacgggttcgggtaccgtagggttaacgtacggtcggtacggtaccgttaaccggaacgttttaaccgttttaaccggtaaacgtttaaacgtaaaaccgttcggaaccggtcgttaaacggggacggttaacggggtacgggttaacgg

SEQ ID NO: 249139 - DNA, 656 bp, Homo sapiens
  misc_feature: GYAE6OF02G46YO.35.71.G05.1.454.CMB.1.raw
  modified_base (336)..(336): a, c, t, g, unknown or other
  misc_feature (336)..(336): n is a, c, g, or t
  modified_base (408)..(408): a, c, t, g, unknown or other
  misc_feature (408)..(408): n is a, c, g, or t
  modified_base (460)..(460): a, c, t, g, unknown or other
  misc_feature (460)..(460): n is a, c, g, or t
  modified_base (618)..(618): a, c, t, g, unknown or other
  misc_feature (618)..(618): n is a, c, g, or t
  modified_base (644)..(644): a, c, t, g, unknown or other
  misc_feature (644)..(644): n is a, c, g, or t
  modified_base (652)..(652): a, c, t, g, unknown or other
  misc_feature (652)..(652): n is a, c, g, or t
tcagtacagatcgtcacgaccggtgctcgatttagtgtcgtcgcaagagagagggggtcaggctggaactgaggagcaggtgggggcacttctccctctaacactcctcccctgttgaagctctttgtgacgggcagctcgaggactgatcgaggacctcctcagttccaccttctcaactaatcgaggtcctccctgctcacgtccgtccgtgggctcgactatgtccgtcgttcgggtctcgtcggtactccggtaggtaggggtattagttgtagacttcggtacctcgtacgttcctaccctaccttccgtccccgtccgccccgttacccnccccggtaggaacgccggcccgtcctacctacctccgtaccgtcgccgtagtctagcgacgacctctccgtnactaagtagtaacgtcgtaataacgttaagttattacgtacggttactacgngtacgaacgtacgcggtagctacgtaccacgacgtacgtcttacgtatacgttacgtttgttcgtacgttacggtcccggtaccggtcccggtatacggttaacgtcgtacgtacgtacgcgtactgggtacacggctacgtacgtaacgttcttaanacgtaactagctagacggtaggtacncgggttanacgg

SEQ ID NO: 249140 - DNA, 570 bp, Homo sapiens
  misc_feature: GYAE6OF02F594Z.35.71.G05.1.454.CMB.1.raw
  modified_base (227)..(227): a, c, t, g, unknown or other
  misc_feature (227)..(227): n is a, c, g, or t
  modified_base (313)..(313): a, c, t, g, unknown or other
  misc_feature (313)..(313): n is a, c, g, or t
  modified_base (375)..(375): a, c, t, g, unknown or other
  misc_feature (375)..(375): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (508)..(508): a, c, t, g, unknown or other
  misc_feature (508)..(508): n is a, c, g, or t
tcagtacagatcgtcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtaggctccctgctcagctccgtggggctgcgtaatgctcgtgggtctcgtggatccgaggtgggatattgnatgactcagtctccactctccctcgcccgtcacccctggagacgcccgcctccatcctcctcgctaggtactagcaagcgcctccngacagtatagagatacaagttattgaacgttggactgacagaacgcgaggccagtctaccgnacgtctcgtagacttgttacgttttggtactaaacggtccggtcccggtacccgggtccacgactcgggtancggtacgcgaggtacggtnaccgngacaacgtagttaactttacaacttaaagaactcganacgtagacggtaggacgacggtagaggtactggtttaggtatttacgtaccgtatcgtaacg

SEQ ID NO: 249141 - DNA, 806 bp, Homo sapiens
  misc_feature: GYAE6OF02G3IWV.35.71.G05.1.454.CMB.1.raw
tcagtacagatcgtcacgaccggtgctcgatttagtgtcgtcgcaagagagagggggtcaggctggaactgaggagcaggtgggggcacttctccctctaacactctcccctgttgaagctctttgtgacgggtcgagctcaggactgatcaggactcctcagttcaccttctcacaatgagcctcctgctcagctccgtgggctgactaatgcttcgtggtctgacgtactacgtaggtggtatagttgagtatgtactactacgtcctacctcctacccgtccctccggtaccccgtacccgtaaccccggtcggaacggccggtaccccgtacctacccgtaacttcccgtccgtcggacgttacggtacgtacgtaccgaacgtccgtccttcccgtaggtactaagttaaggttaacgtaggtaaactaaacgtaacgtttaaacgtttaaggtaacggttttaacgacccgtaggtaccgaaaggaaccgtaacccgggtaacggtacctaccggttaaccctaaccgtaacgtaacccgtccttaaccgtagttaaccgtttacggttttacggttttaacggttaccgttaaccgggttacccgggtcccgggttttacccggggtcccttaaggggtacccgtttaaggggttaccgaacggttcgggtaacgtagggttaaccggtacggtaccggaccggttacgtaaccgtagttttaaaccttaaccggtaaacgtaaacgtaaccggttagaaccgtaaggttacgggtaagggtaccggtacgttaacggg

SEQ ID NO: 249142 - DNA, 763 bp, Homo sapiens
  misc_feature: GYAE6OF02GQVLA.35.71.G05.1.454.CMB.1.raw
  modified_base (558)..(558): a, c, t, g, unknown or other
  misc_feature (558)..(558): n is a, c, g, or t
tcagtacagatcgtcacgaccggtgctcgatttagtgtcgtcgcaagagagaggggggtcaggctggaactgaggagcaggtgggggcacttctccctctaacgactctcccctgttgaagctctttgtcgacgggcgagctcaggactgatcaggacctccgtcagttctaaccttctacacaatcgacggtcctccctcgctcgacgtcgtccggtgggctggtctaacgtcgctcggtgggtccgtcgtcggactcgagggttgggacttagttgtagagttacgccgtactacgttcctacccgtaccttccgtacccgtccgtaccccgtaccctacccggtacgggacggtccggtccccgtaccgttcccgtacttcccgtaccgtcggtcgtacgtcgtagtaccggactaccgtccgtcgtacgtactaagtaagtacgtaggtaactaacgttaagtttagtttaacgtaacggtttccgtacgtacggtacgtacggtacggacccggtaggcttccggtacctcccgaagtaccttacgtaccgtnttaacgtttacggttagttttacccggtactaccgggttcccgggtacccgttcccgggtaacgtccggtaaccggtacgttccgtaacgggtcgtaacgtaggtcaaccgggttacacggtaccctttaaggttaccgtttaaactaccggtaagtaacgttacgtacgaccggtataacgggttaggccggggtattaccggg

SEQ ID NO: 249143 - DNA, 791 bp, Homo sapiens
  misc_feature: GYAE6OF02GCVSE.35.71.G05.1.454.CMB.1.raw
  modified_base (414)..(414): a, c, t, g, unknown or other
  misc_feature (414)..(414): n is a, c, g, or t
  modified_base (688)..(688): a, c, t, g, unknown or other
  misc_feature (688)..(688): n is a, c, g, or t
tcagtacagatcgtcacgaccggtgctcgatttagtgtcgtcgcaagagagaggggtcaggctggaactgagagcaggtgggggcacttctcctctaacactctcccctgttcgaagtctctttgtgacgggcgtagtctcaggactgatcgaggtactcctcagttcaccgttctcacaactggacggtcctcccgtgtcgtcgacgtccgtccggtaggggctgtacttaagtcgtaccgttcggttcgggttactccggtaggtacgttaccggtagggttacggggtaattaggtttcggtagacttcggaaccttcgaacggttcctacccgtaccttcccgtaccccgttcgtccccggtacctaccccgtggaccgtaccgcccggtacctactacgttcctaccgnggaccgttacggtcgtacgggtacctacggtaccgtccgtcgtacgaacgttaacgttaacggtaacgtacggtaacttaacgtaagtttaacgttaagttaacgttaccgggtacctaggtaacccggaagtaaccgttacgggacggtaactacggttacacgtaacgtacgtcctacggtgtacgttcgttacggtttggtacgtacggtccggtaccgttacgggtccgttaggaccgttaggtaccggtaggtacgtagtaaccgggtnaccgttacggacgttaccgaaccggttacggttaacgttacccgtaagtaaccgtaaacggttccaagttaaccgggcgtttaacgggtggtacggtaacggg

SEQ ID NO: 249144 - DNA, 154 bp, Homo sapiens
  misc_feature: GYAE6OF01AIXZK.30.24.C02.1.454.CMB.1.raw
  modified_base (154)..(154): a, c, t, g, unknown or other
  misc_feature (154)..(154): n is a, c, g, or t
tcagcacgctacgtcacgaccggtgctcgatttagtacagatcgttagggaaagggaccaaggtggaaatcaaacgaactgtggctgcaccatctgtcttcatcttcccgccatctgaagtactctatctgagcgggctggcaaggcgcatagn

SEQ ID NO: 249145 - DNA, 156 bp, Homo sapiens
  misc_feature: GYAE6OF01BJYR0.30.24.C02.1.454.CMB.1.raw
  modified_base (154)..(156): a, c, t, g, unknown or other
  misc_feature (154)..(156): n is a, c, g, or t
tcagcacgctacgtcacgaccggtgctcgatttagtacagatcgttagggcaagggaccaaggtggagatcaaacgaactgtggctgcaccatctgtcttcatcttcccaccctcctcacgtagcgtgctgagcgggctggcaaggcgcatagnnn

SEQ ID NO: 249146 - DNA, 172 bp, Homo sapiens
  misc_feature: GYAE6OF01AENXJ.30.24.C02.1.454.CMB.1.raw
  modified_base (150)..(150): a, c, t, g, unknown or other
  misc_feature (150)..(150): n is a, c, g, or t
  modified_base (155)..(172): a, c, t, g, unknown or other
  misc_feature (155)..(172): n is a, c, g, or t
tcagcacgctacgtcacgaccggtgctcgatttagtacagatcgttagggaaagggaccaaggtggaaatcaaacgaactgtggctgcaccatctgtcttcatcttcccgcatctgaagtacctctatctggagcgggctggcaaggcgnatagnnnnnnnnnnnnnnnnnn

SEQ ID NO: 249147 - DNA, 153 bp, Homo sapiens
  misc_feature: GYAE6OF02INV7S.30.24.C02.1.454.CMB.1.raw
tcagcacgctacgtcacgaccggtgctcgatttagtacagatcgttagggaaagggaccaaggtggaaatcaaacgaactgtggctgcaccatctgtcttcatcttcccgccatctgaagtactctatctgagcgggctggcaaggcgcatag

SEQ ID NO: 249148 - DNA, 246 bp, Homo sapiens
  misc_feature: GYAE6OF01DFZXC.11.73.G07.1.454.CMB.1.raw
  modified_base (243)..(246): a, c, t, g, unknown or other
  misc_feature (243)..(246): n is a, c, g, or t
tcagcgagagataccacgaccggtgctcgatttagctctacgctcagggtcttcgtggctcacgtccaccaccacgcatgtgacctcaggggtccggagatcatgagggtgtccttgggttttgggggaagaggaagactgacggtcccccaggagttcaggtgctgggcacagcggccctgggctgcctggtcaaggactacttccgtatctctcgctgagcgggctggcaaggcgcatagnnnn

SEQ ID NO: 249149 - DNA, 242 bp, Homo sapiens
  misc_feature: GYAE6OF01E0TM8.11.73.G07.1.454.CMB.1.raw
  modified_base (241)..(242): a, c, t, g, unknown or other
  misc_feature (241)..(242): n is a, c, g, or t
tcagcgagagataccacgaccggtgctcgatttagctctacgctcagggtcttcgtggctcacgtccaccaccacgcatgtgacctcagggtccgggagatcatgagggtgtccttgggtttgggggaagaggaagactgacggtcccccaggagttcaggtgctgggcacagcggccctgggctgcctggtcaaggactacttccgttctctcgctgagcgggctggcaaggcgcatagnn

SEQ ID NO: 249150 - DNA, 245 bp, Homo sapiens
  misc_feature: GYAE6OF01D9U8W.11.73.G07.1.454.CMB.1.raw
  modified_base (243)..(245): a, c, t, g, unknown or other
  misc_feature (243)..(245): n is a, c, g, or t
tcagcgagagataccacgaccggtgctcgatttagctctacgctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccgtatctctcgctgagcgggctggcaaggcgcatagnnn

SEQ ID NO: 249151 - DNA, 245 bp, Homo sapiens; identical to SEQ ID NO: 249150
  misc_feature: GYAE6OF01B3PLH.11.73.G07.1.454.CMB.1.raw
  modified_base (243)..(245): a, c, t, g, unknown or other
  misc_feature (243)..(245): n is a, c, g, or t

SEQ ID NO: 249152 - DNA, 489 bp, Homo sapiens
  misc_feature: GYAE6OF01BB0DF.11.73.G07.1.454.CMB.1.raw
  modified_base (312)..(312): a, c, t, g, unknown or other
  misc_feature (312)..(312): n is a, c, g, or t
  modified_base (433)..(433): a, c, t, g, unknown or other
  misc_feature (433)..(433): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttggaaacngaggtcccacgaggttcagtggaagtggatcgtgggacagactttactctcaccatcagcagcctgcagcctgaagatattgcaaacatattactgtacaacagttatgatcgtctcctanaatttcggcccttgggacccagagtcggacagtacgaaacgtactgtcggctgacc

SEQ ID NO: 249153 - DNA, 492 bp, Homo sapiens
  misc_feature: GYAE6OF01BNT9Y.11.73.G07.1.454.CMB.1.raw
  modified_base (386)..(386): a, c, t, g, unknown or other
  misc_feature (386)..(386): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgacagggaagcccctgagctcctgatctacgatgcgtccaatttggaaacagaggtcccacgaggttcagtggaagtggatcgtgggacagactttactctcaccatcagcagctgcagcctgaagntattgacaacatattactgtacaactagtatgatcgtcttacctctaacttcggccctgggaccctagagtcggaacatagtaaacgactaggtcggctggtaccc

SEQ ID NO: 249154 - DNA, 475 bp, Homo sapiens
  misc_feature: GYAE6OF01EBQCA.11.73.G07.1.454.CMB.1.raw
  modified_base (399)..(399): a, c, t, g, unknown or other
  misc_feature (399)..(399): n is a, c, g, or t
  modified_base (470)..(470): a, c, t, g, unknown or other
  misc_feature (470)..(470): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccacgaggttcagtggaagtggatctgggacagactttactctcaccatcagcagcctgcagcctgaagatattgacaanatattactgtacaacagtatgatcgtctctctattccgcctggaccagagtgacatacgaaacgactgtgntgacc

SEQ ID NO: 249155 - DNA, 503 bp, Homo sapiens
  misc_feature: GYAE6OF01A7FWH.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccacgaggttcagtggaagtggatctgggacagactttactctacaccatcagcagccctgcagcctgaagtatattgacaaacatattactagtacaacagtatgattcgtctctctaactttccggcccttagggacccaggacgtgggactagtacggaaaccgacgtggtggctgtaccc

SEQ ID NO: 249156 - DNA, 554 bp, Homo sapiens
  misc_feature: GYAE6OF01D8GXE.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgctacctaatttaggaaacagacggtcccacgaggttcagtggaagtggatcgtgggacagactttactctacaccatcagcagcctgcagcctagaacgtatattgacaactattaattactgtacaacagttatgtacttcgtacctccttactaacgtttcccggacccgttacggggaacccagggtaacggtcgggaaaccgtaagttaacggaaaaaccggttaaaccgtagggttacgggtccttggaacccc

SEQ ID NO: 249157 - DNA, 501 bp, Homo sapiens
  misc_feature: GYAE6OF01A8NJ4.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgacgctcctgactctacgatgcgtccaatttggaaacagacggtcccacgaggttcaggtggaagtggatcgtgggacagactttactctacaccatcagcacgcctgcagcctagaagatattgacaactatattactgtacaacagtatgtatcgtctcctctaacgttccggaccctgggacccaggagtcggacagtacgaaacgactagcgcgtgaccc

SEQ ID NO: 249158 - DNA, 537 bp, Homo sapiens
  misc_feature: GYAE6OF01CCQ6F.11.73.G07.1.454.CMB.1.raw
  modified_base (193)..(193): a, c, t, g, unknown or other
  misc_feature (193)..(193): n is a, c, g, or t
  modified_base (418)..(418): a, c, t, g, unknown or other
  misc_feature (418)..(418): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcagtcaggacattaagaactattaaatgtatcgcagcgaccgaggaaacgcccctgacgctcctgactctacgatgcgtaccaagtttaggaaacaggacggtccaacgaggttacagtggaagtggatcgtaggactagtacttactctcacatcagtcagcctgcacgcctagaacgtatactgacaacataattactntacaactagtatgacttcgtactacgtccttaagttcccggtacccttacggggacctaaggtacggtcggaactaacgtacgtaaaaccggaacgttggtacgggtccgtgtaacccg

SEQ ID NO: 249159 - DNA, 572 bp, Homo sapiens
  misc_feature: GYAE6OF01CGSEL.11.73.G07.1.454.CMB.1.raw
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaatgtatcggcagcgacaggaacnccctgagctcctgatctacgatcgcgtacctaaagtttggaaaacnggacggtcccacggaggttcaggtggaagtggatcgtgggactagactttacnctacacctatcagcagcctgccagcctagaagattacgttgacaaactattaacttactagttacaaactacgttagttcgaacttcgttccctaccttacgttaaacgttttcccgggacccgttggggaacccctagggtaacggtacggtaacctaaggttaaccgggaaaacgtaccggttggtacggtctccgggtaaccc

SEQ ID NO: 249160 - DNA, 544 bp, Homo sapiens
  misc_feature: GYAE6OF01BJH7N.11.73.G07.1.454.CMB.1.raw
  modified_base (194)..(194): a, c, t, g, unknown or other
  misc_feature (194)..(194): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaatggtatcgcagcgacagggaacgccctgagctctgactctacgatcgcgtacctaagtttaggaaacgaggacggtacccaccggtaggttcaggtaggaagtggatacgtgggactagtactttactctacactatcagtcacgcctagacacgccgtagaagtatattagactaactataacttactgtaacaataagtatagacttccgtctaccgtctaacgtttccggacccgtacgggaccctaggtacggtcggaactacgtaaggaaaccgtagtaggtcggcgtggtaccc

SEQ ID NO: 249161 - DNA, 492 bp, Homo sapiens
  misc_feature: GYAE6OF01CYDVC.11.73.G07.1.454.CMB.1.raw
  modified_base (386)..(386): a, c, t, g, unknown or other
  misc_feature (386)..(386): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaagcccctgagctcctgatctacgatgcgtccaatttggaaacagagtccacgaggttcagtggaagtggatctgggacagactttactctcaccatcagcagcctgcagcctgaagntatgcaacatattactgtacaaactagtatgatcgtctcctactaatttccggcccgtgggacccaggacgtggactagtagaaacgaacttggtacggctggacc

SEQ ID NO: 249162 - DNA, 505 bp, Homo sapiens
  misc_feature: GYAE6OF01CTXC3.11.73.G07.1.454.CMB.1.raw
  modified_base (194)..(194): a, c, t, g, unknown or other
  misc_feature (194)..(194): n is a, c, g, or t
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
  modified_base (500)..(500): a, c, t, g, unknown or other
  misc_feature (500)..(500): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatcgngggacagactttacnctcaccatcagcagcctgcagcctagaagatattgacaactatattactgtacaacgtagtatgtacttcgtcttacctcgtaactttccggcccgtagggaccaggagtcggaacagtacgaaacgtactggtcggntgacc

SEQ ID NO: 249163 - DNA, 519 bp, Homo sapiens
  misc_feature: GYAE6OF01B9HS7.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcagacattaagaactattaaatggtatcggcagcgacagggaaagcccctgagctcctgatctacgatgcgtccaatttggaaacagacggtcccacgaggttcagtggaagtggatcgtggacagactttactctcaccatcagcagcctgcagcctagaagtatattgacaaactatatttactgtacaacagtatagattcgtctacctctaaactttcggtaccccttggggaaccctaggaaggttcggaaactagtacgtaaaaccggaaacttggtacgccgtgtacccg

SEQ ID NO: 249164 - DNA, 516 bp, Homo sapiens
  misc_feature: GYAE6OF01CPOHW.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacattaagaactatttaaattggtatcggcagcgaccagggaaagcccctgagctcctgatctacgatgcgtaccaatttaggaaacagacggtcccaccgtaggttcagtgggaagtggatcgtgggacagtactttacgcttcaccatcacgtcacgcctgcagcctagaagatatgacaacatattactagtacaactagtatagattcgtctcctactaactttccggccctggaacctaggaggtcggaactagtacgtaaaacgactggtacggtctggtaccc

SEQ ID NO: 249165 - DNA, 487 bp, Homo sapiens
  misc_feature: GYAE6OF01D9FR0.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatgtatcggcagcgacaggaaagcccctgagctcctgatctacgatgcgtccaatttggaaacagacggtccaccgaggttcagtggaagtggatctgggacagactttactcttacaccatcagcagcctgcagcctgaagatattgacaacatattactgtacaacagtatgatcgtctcctctaatttccggacccttgggacctaggagtggacatacgaaacgaactggtgctgacc

SEQ ID NO: 249166 - DNA, 535 bp, Homo sapiens
  misc_feature: GYAE6OF01AP7V8.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccaggaacgcccctgacgctcctgatctacgatgcgtcctaattggaaacagacggtacccacggaggttcaggtggaagtggatcgtgggactagtactttactctacaccatcagcacgcctgcagcctagaagtatatcgacaactattattactagtacaacgtagtatgtacttcgtcctcctacttaacgttccggacccgtacgggtaccaggtacggtcggaactaagtaacggtaaaccgtacgttaggtacggccttggtaccc

SEQ ID NO: 249167 - DNA, 585 bp, Homo sapiens
  misc_feature: GYAE6OF01BBTFA.11.73.G07.1.454.CMB.1.raw
  modified_base (199)..(199): a, c, t, g, unknown or other
  misc_feature (199)..(199): n is a, c, g, or t
tcagcgagagataccacgaccggtgctcgatttagctctacgctcgaggggggcaggagtcagtcccaaccaggacacagcatggacatgagggtccctgctcagctcctggggctcctgctgctcgtagtctctcaggtgccagatgtgacattccagttgaccccagtctccatcctcctgtctgcatctatagganacagagtcaccatcacttgccaggcgagtcaggacattaagaactattaaattggtactcggcagcgacaggaagcccctgacgctcctgatctacgatcgcgtacctaatttaggaaacagtacggttcccacggtagttacaggtggaagtggatcgtgggactacgtactttactctacaccgtatcgagtcacgccctgacagcctagaacgtatagttcgactaactacttacttacgtcgtaccaacgtacgtatgtaacttccgtaccttacccgtacgtaaacgttttcccgggacccgttcggggaaccctaggtacggtcgggaacctaggttacggtaaaaccggtaacgttagggtacggtccgtacggacccg

SEQ ID NO: 249168 - DNA, 508 bp, Homo sapiens
  misc_feature: GYAE6OF01C6NKL.11.73.G07.1.454.CMB.1.raw
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcatcgaccagggaaagcccctgagctcctgatctacgatgcgtccaatttggaaacagacgtcccacgaggttcagtaggaagtggatcgtgggacagtactttactctcacatcagcagcctgcagcctagaagtatattgactaanattattacngtacaacagtatgactcgtctccttactaagtttccggcccgtgggacccaggaggtggaacagttaggaaaccgtacgtgtacggctggtaccc

SEQ ID NO: 249169 - DNA, 597 bp, Homo sapiens
  misc_feature: GYAE6OF01DVYGL.11.73.G07.1.454.CMB.1.raw
  modified_base (194)..(194): a, c, t, g, unknown or other
  misc_feature (194)..(194): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtcctccatcctcctgtctgcatctatagganacagagtcaccatcacttgccaggcagtcaggacattaagaactattaatggtatcggnagcgacgaagggaacncccctggacgtctcctagactcgtacgatcgacgtacctaagtttaggaaacgacgtaacggtcccaaccggtaggttacgaggtaggaagtggagtcgtagggactagtactttacgctcacctatcgacgtcacgtctagctagacctagaatacgtattcgactaactattaacttacgtcgtacaacgtagttaactcggtacttccgtaccttcctaacgttacggtttacccggcccgttacgggtaaccgtagggtacggttacggaccgtaaacgttaaggaaaaccgtaaccggttaggtaccggtcgtacgtaacccg

SEQ ID NO: 249170 - DNA, 500 bp, Homo sapiens
  misc_feature: GYAE6OF01CC5IZ.11.73.G07.1.454.CMB.1.raw
  modified_base (194)..(194): a, c, t, g, unknown or other
  misc_feature (194)..(194): n is a, c, g, or t
  modified_base (493)..(493): a, c, t, g, unknown or other
  misc_feature (493)..(493): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactatttaaattggtatcggcagcgaccagggaaagcccctgagctcctgatctacgatgcgtccaatttggaaacagacggtcccacgaggttcaggtggaagtggatcgtgggacagtactttactctcaccatcagcagcctgcagcctagaagtatattgacaactattattactgtacaactagtatgatcgtctcctctaactttccggcctgggacctagaggtggacagtacgaaacgactaggtcggngtgaccc

SEQ ID NO: 249171 - DNA, 552 bp, Homo sapiens
  misc_feature: GYAE6OF01DC4LY.11.73.G07.1.454.CMB.1.raw
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaattggtatcggcagcgacagggaaacgcccctgacgctcctgatctacgatgcgtacaatttaggaaacagacggtcccacgtaggttcaggtggaagtggatcgtagggactagtactttactctacaccatcagcagcctgcagcctagaanatatgacaanattattacngtacaactagttatagtattccgtcttaccttacgtaacgtttcccgggcccgttacggggaaccctaaggacggttacggaaacgtaagttaacggaaaaccggtaacgttgggtacgggtcctcgggtaaccc

SEQ ID NO: 249172 - DNA, 642 bp, Homo sapiens
  misc_feature: GYAE6OF01DY7FG.11.73.G07.1.454.CMB.1.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
tcagcgagagataccacgaccggtgctcgatttagctctacgctcagggggcaggagtcagtcccaaccaggacacagcatggacatgagggtccctgctcagctccgtggggctcctgctgctctgtctctcaggtgccagatgtgacatccagttcgacccagtcctccactccctcctgtctgcatctagtagganacagagtcaccatcacttgccgaggcgagtcgaggactaattaaagtaacttaatttaaagttggtatcggacgagaccgaaccggaagggaaccncccgtagacgtcctcctgactcgacgacgtcgcgtactaagttacggaacacggtacggtacccacggtaggtacgaggtacggaagtcggagttcgtagggactaacgttactttacgtaccgtacctacctagtccgaacggacacgtcccgtagaccgtacggtaccgaagtaacttagttaacgtaccgaactaaacttacttaacgttaactcggttaacaacgttagttaacgtacgtaccgttcccgttactacccgttagttaacccggttcccggaccgtagggacctaggaggtacgaacgtacgtaacgtaaacgtacgtaggtccgtgtccgtac

SEQ ID NO: 249173 - DNA, 507 bp, Homo sapiens
  misc_feature: GYAE6OF01A5CY7.11.73.G07.1.454.CMB.1.raw
  modified_base (312)..(312): a, c, t, g, unknown or other
  misc_feature (312)..(312): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccaggaaacgcccctgagctcctgatctacgatgcgtcaatttggaaacngacggtcccacgaggttcaggtggaagtggatcgtgggacagactttactctcaccatcagcagccctgcacgcctagaagattattgactaacattattactgtacaacgtagtatgattccgtctcctctagtttcccggcccgtgggacctaggacggtggacagtacgaaacgtactggtcggctgacccg

SEQ ID NO: 249174 - DNA, 545 bp, Homo sapiens
  misc_feature: GYAE6OF01A2LHS.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgacagggaacgcccctgagctcctgatctacgatgcgtaccaatttaggaaacagacggtcccaccggaggttcaggtaggaagtggatcgtgggacagtactttactctcaccatcagcagccctgcacgcctagaagtatattacgactaactattaacttactagtacaactagttatagtacttccgtaccttccttacgtacgtttccggacccgttagggaccctaggacggtacggactaagtaacgaaaacggtacgtaggtcggaccgtggaaccc

SEQ ID NO: 249175 - DNA, 532 bp, Homo sapiens
  misc_feature: GYAE6OF01END7P.11.73.G07.1.454.CMB.1.raw
  modified_base (197)..(197): a, c, t, g, unknown or other
  misc_feature (197)..(197): n is a, c, g, or t
  modified_base (452)..(452): a, c, t, g, unknown or other
  misc_feature (452)..(452): n is a, c, g, or t
tcagcgagagataccacgaccggtgctcgatttagctctacgctcagggggcaggagtcgagttcccaaccaggacacagcatggacatgagggtccctagctcagctcctggggctcctgctgctctgtctctcaggtgccagatgtgacatccagttgacccagtctccatcctccctgtctgcatctatagganacagagtcaccatcacttgccaggcgagtcaggacattaagaacttagttaaattggtatcggcagccgacgagggaagcccctgagctcctgatctacgatgcgtccaattttggaaacagacggtcccacgaggttcagtggaagtggatcgtgggacaggactttactctacgaccatccagcaagccctgccagccctagaacgatacttgacaactattattactgtacaacagtatgatcgtctccgtntaacgtttccggacccgttgggaccctaggtacggtcggtactagtacggtaaaacgtacgtaggtacggctggtaaccc

SEQ ID NO: 249176 - DNA, 561 bp, Homo sapiens
  misc_feature: GYAE6OF01DI2N7.11.73.G07.1.454.CMB.1.raw
  modified_base (360)..(360): a, c, t, g, unknown or other
  misc_feature (360)..(360): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtcctccatccctcctgtctgcatctataggagacagagtcacatcacttgccaggcgagtcaggacaattaagaacttaatttaatggtatcggcagcgacgagggaacgccccgtgacgctctgatcgtacgatcgaccgtactaagttaggaaacaggacggtacccacggaggttcaggtaggaagtggatcgnggactagtactttacgctacacctatcagacacgcctagacacgacctagaatatagttacgactaactattacttacgtagtaaccaagtacgttatacgtacttccgtacttaccttacgtaacgttccgggacccgtacgggtacctaggtacgtcggaacaaggtacgaaacgttacgtggtacggtctcggtaccc

SEQ ID NO: 249177 - DNA, 521 bp, Homo sapiens
  misc_feature: GYAE6OF01ELKNU.11.73.G07.1.454.CMB.1.raw
  modified_base (395)..(395): a, c, t, g, unknown or other
  misc_feature (395)..(395): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacaattaagaacttatttaaattggtatcggcagcgacagggaaagcccctgagctcctgatctacgatcgcgtcaagtttaggaaacagacggtcccacgtaggttcagtggaagtggatgtagggacagtactttactctcacatcagcagcctgcagcctgaagtntattgacaacattatactgtacaacagtatgtactcgtactcctactaacgtttccggacccgttacggggacctaaggagtcggaaactagtaacggaaaccgtacgtagtacggtcctggaccc

SEQ ID NO: 249178 - DNA, 529 bp, Homo sapiens
  misc_feature: GYAE6OF01AKZBB.11.73.G07.1.454.CMB.1.raw
  modified_base (197)..(197): a, c, t, g, unknown or other
  misc_feature (197)..(197): n is a, c, g, or t
  modified_base (368)..(368): a, c, t, g, unknown or other
  misc_feature (368)..(368): n is a, c, g, or t
tcagcgagagataccacgaccggtgctcgatttagctctacgctcagggggcagggagtcagtcccaaccaggacacagcatggacatgagggtccctgctcagctcctggggctcctgctgctctgtctctcaggtgcctagatgtgactatccagttgacccagtctccatcctccctgtctgcatctatagganacagagtcaccatcacttgccaggcgagtcaggacattaagaactatttaaattggtatcggcagcgaccaggaaagcccctggacgctcctgatctacgatgcgtcctaatttggaaacagaggtcccacgtaggttcaggtggaagtggatgtgggacagtactttacnctcacatcagcagcctcgcagtcctagaagtattagttgacaactattaattactgtacaactagtatagattcgtctccttacgtactttccgggccctagggacctagggtcggtaggaccgtaagtacgtaaacgtacgttaggcggtctgggtaccc

SEQ ID NO: 249179 - DNA, 513 bp, Homo sapiens
  misc_feature: GYAE6OF01EPZJF.11.73.G07.1.454.CMB.1.raw
  modified_base (272)..(272): a, c, t, g, unknown or other
  misc_feature (272)..(272): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
tcagcgagagataccacgaccggtgctcgatttagctctacgctcatggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaattggtaatcggcagcgaccagggaaancccctgagctcctgatctacgatgacgtccaatttggaaaacagacggtcccacgaggttcagtggaagtggatcgtgggacagactttacnctcaccatcancagcctgctagcctagaagtatattgctaaactnttaagttactgtacaacagttatgattcgtctcttctaacgtttcggcccgttgggaacctaggagttacggactaagttacgaaaacgtaactggtgctacgg

SEQ ID NO: 249180 - DNA, 547 bp, Homo sapiens
  misc_feature: GYAE6OF01EJCMG.11.73.G07.1.454.CMB.1.raw
  modified_base (194)..(194): a, c, t, g, unknown or other
  misc_feature (194)..(194): n is a, c, g, or t
  modified_base (296)..(296): a, c, t, g, unknown or other
  misc_feature (296)..(296): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaacttaattaaattggtatcggcagcgaccagggaaacgcccctgagctcctgatctacgntgcgtaccaatttaggaaacagacggtacccacgaggttacaggtggaagtggatcgtagggacagtactttactctccactatccagcacgcctgcagcctagaagtattattcgactaactattattactgtacaacgtagtatgtacttccgtccttaccgtactaacgtttcccgggaccgttacgggtaaccaggtaggtcggaacaagttaacggaaaccgtacgttaggtcggccgtgtacccg

SEQ ID NO: 249181 - DNA, 679 bp, Homo sapiens
  misc_feature: GYAE6OF01DF8TO.11.73.G07.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccactccctccctgtctgcatctaagtagganacgagagtccaccatccacttgccgaggcgagtacgaggaactaattaaagtaacttaagttttaaagttaggtatcggacagaccggaaccgaagggaaaccnccccgtagacgtcctcctagactacgtacgatcgtacgtacctaaagttagaaacgtaggtaccggtacccgacggtaggttacaggtaggtaagtgagtcgaggtacagtactttacacgtacacctatacacgacacgtccgtgacacgtccgaagtaacgtattacgttacgaacctaacgttaattaacgttttaagtccgtaaactaaccgtaaggttaacttaccggtactttccggttacccttaccgtaaccgttaacgtccccgggtacccgttaacggggacccgtaagggtacggttacggaaccgtaaaggtaaaccggtaaaccgttacgggttaggtcccggttacgtaccgggtaacccc

SEQ ID NO: 249182 - DNA, 562 bp, Homo sapiens
  misc_feature: GYAE6OF01B4OB7.11.73.G07.1.454.CMB.1.raw
  modified_base (459)..(459): a, c, t, g, unknown or other
  misc_feature (459)..(459): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccgagggaacgcccctagacgctcctgatctacgatcgcgtacctaagtttacggaaacaggacggtacccaccggtagggttccgaggtagggaaggtggtagtcgtagggacaggtactttactctccaaccatacagcagccctgccagcctagaatatatacgacaacattaacttactataccaagtagttangttaactcgtacctcctactacgttccggaccctggggtacccaggtacggtacggacgtaagttaccggtaaaacgtcgttagggtacgtccgtgtaacccg

SEQ ID NO: 249183 - DNA, 536 bp, Homo sapiens
  misc_feature: GYAE6OF01EBACC.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcattcaggacataagaactattaattgtatcgcagcgaccgagggaaacgcccctgagctcctgatctacgatgacgtccaatttaggaaacagacggtacccacgaggttcagtggaagtggatcgtgggacagtactttactctacacatcagcacgcctgcagcctagaagtatattagacaactattattactgtacaacgtagtatagtatccgtacttcctactacgtttaccggcccgttacgggacctaaggacggtaggaaccctaagttaaccggaaaccgaacgttacgggtacgcgttacggaccc

SEQ ID NO: 249184 - DNA, 723 bp, Homo sapiens
  misc_feature: GYAE6OF01CS6QW.11.73.G07.1.454.CMB.1.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacctagtctccatcctccctgtctgcatctagtagganacagactccacatcactcgaccgaggacgtagtacgaggaactaattaaagtaaacttaatttaaagttggtacgtacggacgaggaccgaaccggaagggaaaccnccccggtagacgtcctccgtagtactacgtacgtacgtcgtaccgttaaccgtaagttaacggaaaacgtacggtaaccggtccccgtaaacggtacggtttacgaagggttacgggaaaggtcggacgttacggtacgggaacttacgttaaccttttaaccgcgtacctaaccgtagttaccgaacggtacgtaacccgcccgttgaaccgtaacggtccgtaagtaaacggttactacgtagtacctaaattacttaacttacgtaacgaacctaaacgtagttacgtacgtacgttacccttacgtacccttaagttaaccgttcccgggtaccgtacggggtaaacctagggtaggtaaccgaactaaggtaaccggtaaacggttaacgttggtaaccgtacgttcggtaaaccc

SEQ ID NO: 249185 - DNA, 611 bp, Homo sapiens
  misc_feature: GYAE6OF01CFS70.11.73.G07.1.454.CMB.1.raw
  modified_base (407)..(407): a, c, t, g, unknown or other
  misc_feature (407)..(407): n is a, c, g, or t
  modified_base (456)..(456): a, c, t, g, unknown or other
  misc_feature (456)..(456): n is a, c, g, or t
  modified_base (556)..(556): a, c, t, g, unknown or other
  misc_feature (556)..(556): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtcctccatccctcctgtcctgcatctagtaggagacagagtcaccatcacttgccgaggcgagtcgaaggactaattaaagtaacttaatttaaagttggtaagtcggacaggcgaccgaagggaacgcccctagacgtctcctgactacgtacgatcgccgtacctaagttacggaaacaggtaccgtacccgacgtaggttcgaggtacggaaggtggatcggtaggactagttaccttacncctacaccgtactcgacgacacgtccctgaccgacgtacctaggtaaanattagtacgactaaatattaacgtagtacgtacaacgtagttatactagttacccgttacctaccgtacgttaacgtttcccgggacccttagggaaccngggtaacgtggtaaactagtaacggtaaacgtacgtggtacggtcgacggtaccc

SEQ ID NO: 249186 - DNA, 498 bp, Homo sapiens
  misc_feature: GYAE6OF01A5L39.11.73.G07.1.454.CMB.1.raw
  modified_base (362)..(362): a, c, t, g, unknown or other
  misc_feature (362)..(362): n is a, c, g, or t
  modified_base (474)..(474): a, c, t, g, unknown or other
  misc_feature (474)..(474): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccacgaggttcagtggaagtggatcgtgggacaggactttacnctcaccatcagcagcctgcagcctgaagtatattgactaacattattactgtacaacagtatgatcgtctcctctaagttccggccctgggaccctaggaggttcggactanacgaaacgactggtggctggtacc

SEQ ID NO: 249187 - DNA, 503 bp, Homo sapiens
  misc_feature: GYAE6OF01EDNBA.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaagcccctgacgctcctgatctacgatgcgtcaatttggaaacagacggtcccacgaggttacagtggaagtggatcgtgggacagactttactctcacatcagcagcctagcagcctagaagtatattgactaactattattactgtacaacagtatgattcgtcttcctataactttcggaccctagggaccaggacggtggactagtagtaaacgataggtcggctgtaccg

SEQ ID NO: 249188 - DNA, 497 bp, Homo sapiens
  misc_feature: GYAE6OF01DU38U.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaattggaaacagacggtcccacgaggttcagtggaagtggatcgtgggacagtactttactcttcaccatcagcagccctgcagcctgaagtatattgacaactattattactgtacaacagttatgattcgtctcctctacttccggcccgtagggaccaggacgtggaactatacggaaacgactgtggctgacc

SEQ ID NO: 249189 - DNA, 647 bp, Homo sapiens
  misc_feature: GYAE6OF01BYY9G.11.73.G07.1.454.CMB.1.raw
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
tcagcgagagataccacgaccggtgctcgatttagctctacgctcagggggcgagggagtcagtcccaaccaggacacagcatggacatgagggtccctgctcagctcctggggctcctgctgctctgtctctcaggtgccagatgtgacatccagttgacccagtcctccatccctccctgtctgcatctataggagacagagtcaccagtacacttgaccgaggcgagtcaggactaattaagtaacttatttaaattggtatcgacagcgaccgagggaacgccctgacnctcngatcctacgagtcgccgtactaagttacgaacaggacgtcccgacgtagttacgagtggaagtcggtatcgtagggacaggtactttacctcgttaccaacctagtaccgaacgaccgtaacggtcccgtaggacctaacggtccccgttaagaacgttactaacgtttacggaactaaaccgtaatttaacgttacgtacggttaaccaaacgtagttaacgtacgtacgttaccgttccgttacccgttacggtaacccgtttccgggacccgttacgggaacctagggtacggtacggacgtaacgaaacggtaaacgtacggttaccggcggtccgtcgtaacccg

SEQ ID NO: 249190 - DNA, 245 bp, Homo sapiens
  misc_feature: GYAE6OF01AQYI8.11.73.G07.1.454.CMB.1.raw
  modified_base (245)..(245): a, c, t, g, unknown or other
  misc_feature (245)..(245): n is a, c, g, or t
tcagcgagagataccacgaccggtgctcgatttagctctacgctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccgtatctctcgctgagcgggctggcaaggcgcatagn

SEQ ID NO: 249191 - DNA, 712 bp, Homo sapiens
  misc_feature: GYAE6OF01DOA5B.11.73.G07.1.454.CMB.1.raw
  modified_base (183)..(183): a, c, t, g, unknown or other
  misc_feature (183)..(183): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctccctgttcncactatacgtagtagacacgagtactaccacctactactacgtccgacggacggtacgtacgtacggaacgaacttaagttaaaacgtaacttttaaaattttaagttaggttacgacggacacggaaccgaaacgggaaacgggtaacccgtcccgtaggaccgtaccgtcgtagtaccttacgtaacgtgtaccgaccgttaacgttaaggttaaaccggaacgtaccgggtacccgacccggtacggtacggttaacgtacgggtaaggggtacggtaggtacgtacgggtacgggaaacttacgttacctttaccgacctaacctaactactacgcgtacgaccgtctacgaccgacgtccgtaaggtataacttagtcaattaacttacttaattacgactaaccgtaagttagttataacttcgtccgttacctacttacgttaccggtccggtaccggtagaaccggtagacggttacgaactacggaaacgtaaacgcggttagtacgcgtaccgaacccg

SEQ ID NO: 249192 - DNA, 502 bp, Homo sapiens
  misc_feature: GYAE6OF01AV4U7.11.73.G07.1.454.CMB.1.raw
  modified_base (198)..(198): a, c, t, g, unknown or other
  misc_feature (198)..(198): n is a, c, g, or t
  modified_base (444)..(444): a, c, t, g, unknown or other
  misc_feature (444)..(444): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagaaagngtcaccatcacttgccaggcgagtcaggacattaagaactatttaaattggtatcggcagcgaccagggaaagcccctgagctcctgatctacgatgcgtccaatttggaaacagaggtcccacgaggttcagtggaagtggatctggggacaggtactttactctcaccatcagccagccctgcagcctagaacgtattattgacaactattattactgtacaactagtatgattcgtctcctanactttcggccctgggaccaggtagtggacagtacgaaacgtactgtaggctgctaccg

SEQ ID NO: 249193 - DNA, 500 bp, Homo sapiens
  misc_feature: GYAE6OF01BX70S.11.73.G07.1.454.CMB.1.raw
  modified_base (273)..(273): a, c, t, g, unknown or other
  misc_feature (273)..(273): n is a, c, g, or t
  modified_base (314)..(314): a, c, t, g, unknown or other
  misc_feature (314)..(314): n is a, c, g, or t
  modified_base (495)..(495): a, c, t, g, unknown or other
  misc_feature (495)..(495): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtggccagatgtgacatccagttgacccagtctccatcctccctgtctgcatctataggagacagagtcaccatcacttgccaggcgagtcaggacattaagaactatttaaattggtatcggcagcgaccagggaacncccctgacgctcctgatctacgatgcgtcaatttggaaacngacggtcccacggagttcaggtggaagtggatcgtagggacagtactttactctccaccatcagcagcctgcacgcctagaagtatattagacaaactattaacttactgtacaactagtatgatcgtctctctaactttcggacctggaccagacgtgacaagtacgaaacgtactgcgntgacc

SEQ ID NO: 249194 - DNA, 548 bp, Homo sapiens
  misc_feature: GYAE6OF01B70VV.11.73.G07.1.454.CMB.1.raw
  modified_base (194)..(194): a, c, t, g, unknown or other
  misc_feature (194)..(194): n is a, c, g, or t
  modified_base (269)..(269): a, c, t, g, unknown or other
  misc_feature (269)..(269): n is a, c, g, or t
  modified_base (373)..(373): a, c, t, g, unknown or other
  misc_feature (373)..(373): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcagacattaagaactatttaaatgtatcggcagcgacagggaaacncccctgacgctcctgactctacgatgcgtacctaagtttacggaaacaggacggtacccacggaggttcgaggtaggaagtggatcgtgggacagtactttacnctacaccatcagcagcctgcagcctagaagtatagttagacaaactattattactagtacaaactagtatgtacttcggtactaccttacgtaacgtttcccggaccgtagggacctaggacggtacggacctaagtaacgtaaacggtacgtaggtaggtccgtaggtaacccg

SEQ ID NO: 249195 - DNA, 559 bp, Homo sapiens
  misc_feature: GYAE6OF01CPHWB.11.73.G07.1.454.CMB.1.raw
  modified_base (280)..(280): a, c, t, g, unknown or other
  misc_feature (280)..(280): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcacttgccaggcgagtcaggacaattaagaacttatttaaagttggtatcggcaggcgaaccgaagggaacnccccgtagacgtcctcctgactacgtacgatcgcgtactaagttacggaaacgaggacggtcccaacggaggttcaggtaggagtaggntcgtggacagtacttacnctcacctntacagcagccctgacacgtccgtagaacgtattagtcgaactaaactattaacttacgtaagtactaaacgtagtacgtgtacttccgttacctaccgttactacgtttccggaccgtacggtaccgagtacggtagactagacgaaactagtgcgcgtgtacc

SEQ ID NO: 249196 - DNA, 502 bp, Homo sapiens
  misc_feature: GYAE6OF01D5HMC.11.73.G07.1.454.CMB.1.raw
  modified_base (277)..(277): a, c, t, g, unknown or other
  misc_feature (277)..(277): n is a, c, g, or t
  modified_base (329)..(329): a, c, t, g, unknown or other
  misc_feature (329)..(329): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcagacattaagactattaaatggtatcggcagcgacagggaagcccctgagctcngatctacgatgcgtacaatttggaaacagacggtccacgagttcagtgaagngatctgggacaggtaactttcgtctacaccgatcagtcacgtcctgccaggccctagaacgtatattgactaactatacttactgtacaactagtattgacttcgtcttcctactagtttcccggccgtggaccaggagtggaactagtagaaacgactaggctgtgtaaccg

SEQ ID NO: 249197 - DNA, 617 bp, Homo sapiens
  misc_feature: GYAE6OF01BSWXQ.11.73.G07.1.454.CMB.1.raw
  modified_base (262)..(262): a, c, t, g, unknown or other
  misc_feature (262)..(262): n is a, c, g, or t
  modified_base (442)..(442): a, c, t, g, unknown or other
  misc_feature (442)..(442): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcatctataggagacagacgtcaaccatcactgccaggcgagtcaggacattaagaacttatttaaattggtatcggnagcgaacgaggaacgcccagacgctccgtgactctacgatgacgtactaagttaggaacacggacggtaccaccgtaggttacaggtaggagtaggtatcgtagggactacgtactttaccgtactacacctagtacgacgtaccgtacgtcccgtgacgtacgtcccgtaagaaacgtnttaacgttagaacctaaacttaattactttaactacgtacctaaacgtaggttaactacggtaacttccggtaccttccggttaacttaacggtttcccggacccgtacggaaccgtaggtaacgtgggaacctaagtaacggtaacgtaaccgtggtacgtaccgtgtaacccg

SEQ ID NO: 249198 - DNA, 651 bp, Homo sapiens
  misc_feature: GYAE6OF01D3CUE.11.73.G07.1.454.CMB.1.raw
  modified_base (260)..(260): a, c, t, g, unknown or other
  misc_feature (260)..(260): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgctatctagtaggagacagagtcaccatcacttgccaggcgagtcagacaattaagaacttaatttaattggtatcggnagcgaccgagggaacgccccgtgacgtctccgtgactctacgatcgtaccgtacctaagtttaggaaacctacggacggttaccccgaaccggtagggtttaccgaaggttagggtaaggttgggtaacgttcggtacggggaacctaacggtaccttttacctcgtacctaaccgtactccgacggacaacggtccctcggaccgacgtacccgtagaaacgtaattaacgttcgaactaactaattacttactagtaacaactagtatcgtacttccgttccttacctaccttaacgtttcccgggacccgttacgggtaacctagggtaacgggttacggaacgtaagttaacggaaaaccgtactagggtccgtacgtcgtaacccg

SEQ ID NO: 249199 - DNA, 554 bp, Homo sapiens
  misc_feature: GYAE6OF01CVBMX.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggactaattaaagtaacttaatttaaattggtatcggcagcgaccgagggaacgcccctgagctcctgatctaacgatcgtcgtacctaagttacggaaacacgacggtcccgaaccggtaggttacgaggtagggaagtggatcgtagggactagtactttactctacaccatcagcagcctgacacgccgtagaagtattactgactaactattaacttactcgtacaactagtatacgtattccgtacttacctactaacgttccggaccgtggaccgtaggtacggtagactagtaacggaaacgtacgttggtacggctgaccg

SEQ ID NO: 249200 - DNA, 597 bp, Homo sapiens
  misc_feature: GYAE6OF01CQY0S.11.73.G07.1.454.CMB.1.raw
  modified_base (194)..(194): a, c, t, g, unknown or other
  misc_feature (194)..(194): n is a, c, g, or t
  modified_base (314)..(314): a, c, t, g, unknown or other
  misc_feature (314)..(314): n is a, c, g, or t
  modified_base (369)..(369): a, c, t, g, unknown or other
  misc_feature (369)..(369): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtccacatccacttgccaggcgagtcaggacattaagaactattaaatggtatcggcagcgacgaggaacgccctgagctactgactacgtagatgcgtacctaagttggaaacnggacgtcccacgtaggttcaggtggaaagtggatcggtaggatacgtactttacnctacactatcacgacacgcctgcagcctagaagtatagtcgactaacattacttacgtagtactaaacgaagttatacgtacgttccgtacttacccgttataacccggttttccggaccccgttaacggggtaaccccgaaagggttaccgggttcggaaaaccgttaggttaaaccgggtaaaaaccggttaaacgttcgggttaccgggcgtaaccgggtaaccc

SEQ ID NO: 249201 - DNA, 707 bp, Homo sapiens
  misc_feature: GYAE6OF01CB5FJ.11.73.G07.1.454.CMB.1.raw
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgcagatgtgacatccagttcgacccagtcctccatccctccctgtctgcatctataggagacagagtccaccatccacttgaccagggcagtcgaaggaacattaagaactaatttaaattggtatcgnagcgacgagggaanccccgtagacgctcctnactctacgatcgacgttaccaaattaggaaaactaggacggtacccaaccggtaggtttcgaaggttgggaagttgggaatcggtagggaactaggtaacttttacgaccttacaaccgtactacgagaccaacgccccgttaggaccgtacgtacccgttaggtaaacgtaagtttaaactttacggaacctaaaacgtaactttaaatttaacccgttaacggttaacctaaaaccgtttaaagggttacttaacggttaccgtttaccgtttacccttaaccccgttactttaaaccgggttttacccgggtacccccggttacgggtaacccggtaaaggtacggttaggtaaacccgtaaagtaaccggtaaaacgaacgttgggaccgggtactcggtaaacccc

SEQ ID NO: 249202 - DNA, 503 bp, Homo sapiens
  misc_feature: GYAE6OF01BXUXK.11.73.G07.1.454.CMB.1.raw
  modified_base (414)..(414): a, c, t, g, unknown or other
  misc_feature (414)..(414): n is a, c, g, or t
  modified_base (494)..(494): a, c, t, g, unknown or other
  misc_feature (494)..(494): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgacgctcctgatctacgatgcgtccaatttggaaacagacggtcccacgaggttcagtggaagtggatcgtgggacagtactttactctcaccatcagcagcctgcagcctgaagtatattgacaacattattactntacaacagtatgtacttcgtctcctactacgtttccggacccgtgggaccgtaggacggtgacagtacgaaacgactagngtctggacc

SEQ ID NO: 249203 - DNA, 480 bp, Homo sapiens
  misc_feature: GYAE6OF01EQHO3.11.73.G07.1.454.CMB.1.raw
  modified_base (264)..(264): a, c, t, g, unknown or other
  misc_feature (264)..(264): n is a, c, g, or t
  modified_base (387)..(387): a, c, t, g, unknown or other
  misc_feature (387)..(387): n is a, c, g, or t
  modified_base (402)..(402): a, c, t, g, unknown or other
  misc_feature (402)..(402): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcagacataagactattaaatgtatgcagcgaccaaggaaancacctgagctcctgatctacgatgcgtcaattgaaacagacggtccacgagttcagtggaagtggatcgtgggacagtactttactctcaccatcagcagcctgcagctgaagatatgacaanataatactgtacaanagtatgatcgtctctactagtttccggaccgttgggacctaggacgtaggacaagtacggaaacgaactggtgctacg

SEQ ID NO: 249204 - DNA, 580 bp, Homo sapiens
  misc_feature: GYAE6OF01DDIBQ.11.73.G07.1.454.CMB.1.raw
  modified_base (286)..(286): a, c, t, g, unknown or other
  misc_feature (286)..(286): n is a, c, g, or t
  modified_base (312)..(312): a, c, t, g, unknown or other
  misc_feature (312)..(312): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccattcctccctgtctgcatctagtaggagacagagtcaccatcacttgccagggcgagtcgaaggaactattaaagtaactaatttaaattggtatcggacagacgaccgagggaaacnccccgtgacgtctcctgactctacgntgccgtactaagtttacggaaacacgaccggtcccgaccggtaggttacagggtaggaaggtgggattcggagggtactaggtactttacgctacaacctagtccaagcaacgcctgcagacctagaagtattatgaacctaatattattactatacctaacgtagtatagtcgtaccttcttacctaacctagttcccggccgtacggaaccgtaggtggtaacggaactagtaacgaaacgtacgtaggtcggtcctcggtacccg

SEQ ID NO: 249205 - DNA, 559 bp, Homo sapiens
  misc_feature: GYAE6OF01B6566.11.73.G07.1.454.CMB.1.raw
  modified_base (457)..(457): a, c, t, g, unknown or other
  misc_feature (457)..(457): n is a, c, g, or t
tcagcgagagataccacgaccggtgctcgatttagctctacgctcagggggcaggagtcagtcccaaccaggacacagcaatggacatgagggtccctgctcagctcctggggctcctgctgctctgtctctcaggtgccagatgtgacatccagttgacccagtctccatcctccctgtctgcatctagtaggagacagagtcaccatcacttgccaggcgagtcaggacattaacgaacttatttaaattggtatcggtcagcgaccgagggaacgcccctgacgctcctgactcgtacgatgcgtacctaagtttaggaacagacggtcccacgtaggttcagtggaagtggactcgaggacagtactttactctacaccatcagacacgcctagcacgcctagaagtattagtagactaactaattacttactgtaaccaacgtagttacgtntaacgttccgttacctacccgttactaacgtttccggacccgttgggacctaggacgtggaacctagtaacggaaaccgtagttaggtgccgtcggtacccg

SEQ ID NO: 249206 - DNA, 597 bp, Homo sapiens
  misc_feature: GYAE6OF01ERF4Z.11.73.G07.1.454.CMB.1.raw
  modified_base (253)..(253): a, c, t, g, unknown or other
  misc_feature (253)..(253): n is a, c, g, or t
  modified_base (457)..(457): a, c, t, g, unknown or other
  misc_feature (457)..(457): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcacctatcacttgccaggcgagtcaggacataagaacttattaattgtatcgnagcgacagggaaacgcccctggacgctcctgatactacgactgacgtcaatttaggaaacagacggtcccacgtaggttcaggtagagtggatcgtagggactaggtactttacgtacttaccaccgtatacacgcgacgtcctagacacggtccctagaagtattagttacgacaactattaattactagtacaactagttanacgtacttcgtaccgttcctacgttaaaccgttttccgggaccccgttacggggtaaccctaaggtaaggttaccgggaacctaaggttaaccgtaaaacgggttaacgttaccgggtagggtacccgtggtaaaccccg

SEQ ID NO: 249207 - DNA, 511 bp, Homo sapiens
  misc_feature: GYAE6OF01EJ5AU.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtccaccatcacttgccaggcgagtcaggacataagaactattaaattggtatcggcagcgacaggaagcccctgagctcctgatctacgatgcgtcctaatttggaaacagacggtccacgaggttcaggtggaagtggatcgtagggacaggtactttacgtctacacctatcagcacgcctgcacgcctgaagtatattgacaactattacttactcgtacaactagtatgattcgtctcctctaacgtttccggcccttgggacctaggacgttggactagtacgaaacgtacgtaggtcgctgtacc

SEQ ID NO: 249208 - DNA, 812 bp, Homo sapiens
  misc_feature: GYAE6OF01B8VKC.11.73.G07.1.454.CMB.1.raw
tcagcgagagataccacgaccggtgctcgatttagctctacgctcagggggcaggagtcagtcccaaccaggacacagcatggacatgagggtccctgctcagctccgtggggctcctgctgctctgtctctcaggtgccagatgtgacatccagttcgacccagtctccatccctcctgtctgctatctaagtaggagacagagtccaacctatcctacgttcggacccgagggccgaagtaccgaagggtaacctaaagtttaaaacggtaaactttaaagttttaaaagttagggttaacgtaccgggaccgaacgggacccgaaaccggaaaggggggaaaacccgtcccccgttaaggaccgtaccttacccgtaggtaacttaccgtaacgtagtacggtaccgttacctaaaaggttacggaaaacgtacggtaaccgggtaccccgtaacgggtaacggttacgaagggttacgggaaggttcggtaacgttacggtaagggaacctaacggttaacctttaccgtcgtaccacctacgtacgacgaccacggtcctggaccgtaacggtacgtaagaagttacttaacgttacgaaactaaacttaatttaaccgtttaacgtacgttaaccgtaacgttacgttaacgttacgtacgtttacccgttaacctcccgttaaccgttaacccggttcccgggtacccggttacgggaaccgtaagggttacgggtaacgtaaacgtaagttaaaccgggtaaaccggttaacggtcgggttccggtaacccgtcgtaaaccccg

SEQ ID NO: 249209 - DNA, 565 bp, Homo sapiens
  misc_feature: GYAE6OF01BFCX8.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcgaggacattaagaacttattaatgtatcggcagcgaccgaggaacgcccctgacgctcctgatctacgatgacgtacctaagtttacggaaacacggtacggtacccaacggtacggttcgaggtaggaaggtggactcgtaggggactacggtactttactctacacatcagcagtccctagcacgcctaagaactatacgttagacctaatactaactttacgtagtacaacgtagttatacggtacttccgtctacctcgtaacgtttccggcccttagggacctaggtacggtcggtacaagtaacggaaaccgtacgtaggtcggtcgtgtaacccg

SEQ ID NO: 249210 - DNA, 615 bp, Homo sapiens
  misc_feature: GYAE6OF01BLS2Q.11.73.G07.1.454.CMB.1.raw
  modified_base (200)..(200): a, c, t, g, unknown or other
  misc_feature (200)..(200): n is a, c, g, or t
  modified_base (418)..(418): a, c, t, g, unknown or other
  misc_feature (418)..(418): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttcgacccagtcctccactccctcccgtgtctgcatactagtagganacagacgtcaccatacactcgaccaggcgagtcaaggtactataaagtaacttaatttaaagttcggtatacggacaggaccgaacgaacggggaaactccccgtagacgtcctccgtagactacgtacgacgtcgaccgtaactaagttaacggaaaccgaggtaccggtccacgtaggtacgaaggtaggagtgatcgtaggactagtactttacncgtactacgactcgacgcgacgtccctagacgtaacgcctaagtaacgtaacgttgtacactaacgttaattacgttaactacggtaataaaccgtagtacgtagtacttcgtacctaccgtactaacgttcccgggaacctagggaccctagacgtaggacaagtaaccggaaactcggtagacggtcctcgtacc

SEQ ID NO: 249211 - DNA, 565 bp, Homo sapiens
  misc_feature: GYAE6OF01EGMN9.11.73.G07.1.454.CMB.1.raw
  modified_base (381)..(381): a, c, t, g, unknown or other
  misc_feature (381)..(381): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtcctccatcctccctgtctgcatctataggagacagagtcaccatcacttgccaggcgagtcaggacattaaagaacttaatttaaattggtatcggacagcgaccgaagggaaacgcccctggacgctcctgatctacgatgcgtactaatttaggaaacagacggtcccacggaggttcaggtaggaagtggatcgtagggactagtacctttacncgtacacactcagcagtcctgacacggacctagaagtattagttacgactaactattaattacgtagtacaacgtagtagttacgtattccgtaccttacctacgtacgtttcccggaccgtcggggaacctagggacggtcggactaagtacggaaacgtacgtacggtaggccgtgtaaccg

SEQ ID NO: 249212 - DNA, 526 bp, Homo sapiens
  misc_feature: GYAE6OF01A5VQB.11.73.G07.1.454.CMB.1.raw
  modified_base (362)..(362): a, c, t, g, unknown or other
  misc_feature (362)..(362): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccgagggaacgcccctgagctcctgatctacgatgctccaatttggaacagaggtcccacgaggttcagtaggaagtggatcgtgggacagtactttacnctcaccatcagcagcctgcagcctagaagtatacgttgacaaactattacttactgacaactagtatagtacttcgtcctccgtacttaacgtttccgacccgtgggaacccaggaggttccggacagtacgtaaaacggtacgtaggtggtccgtagtacccg

SEQ ID NO: 249213 - DNA, 576 bp, Homo sapiens
  misc_feature: GYAE6OF01C4LJC.11.73.G07.1.454.CMB.1.raw
  modified_base (254)..(254): a, c, t, g, unknown or other
  misc_feature (254)..(254): n is a, c, g, or t
tcagcgagagataccacgaccggtgctcgatttagctctacgctcgagggggcaggagtcagtcccaaccaggacacagcatggacatgagggtccctgctcagctcctggggctcctgctgctctgtctctcaggtgccagatgtgacatccagttgacccagtctccatcctccctgtctgcatctagtaggagacagagtacaccatcacttgccaggcgagtcaggacataagaatatttaatgtatcgnagcgacgaggaacgccctgagctctagactactagatcgcgtactaagtttacgaaacagacggtcccgacgacggttacaggtggaagtggatacgtggacacgtacttactctacacatacagacacgtctacgcacgtacctagaagtatatagactaactattacgttactcgtaactaagtagttatactacttccgtacttacccttacgttaaccgttcccggtacccggttacggaaacccgtagggtaacggttacggaaccgttaaaggtaccgtaaaacggtaacggttaggtcggtaacgttcgaacccg

SEQ ID NO: 249214 - DNA, 654 bp, Homo sapiens
  misc_feature: GYAE6OF01DLJ29.11.73.G07.1.454.CMB.1.raw
  modified_base (195)..(195): a, c, t, g, unknown or other
  misc_feature (195)..(195): n is a, c, g, or t
  modified_base (307)..(307): a, c, t, g, unknown or other
  misc_feature (307)..(307): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctcctgtctgcatctatagganacagagtcaccatcacttgccaggcgagtcaggactataagtaactaatttaattagtatcggcacgacgaccgaggaacgcccgtagacgctcctcgactacgtacgtacncgtttttttttttttacgacctaacgttacggaacgaacgacggtacccgtaccggtacggttacgtaggtagggtaaggtaggtacgtacggtacgggtaccgtaacggttacctttaccgttaccgttaccaacccgtactaccgaacgtaccgacgtacccgtacgacgacgacccgtagtaagtaacgttacttacgtacctaactaacttaacttactacgtactaacgtagtactacgtacttccgtaccttacctaccgtacgttaccggtcccgtacgggtaccgaggacggtacggaacgtacgtaacgtaaacgtaacgtaggtcggtcgtcgtacc

SEQ ID NO: 249215 - DNA, 484 bp, Homo sapiens
  misc_feature: GYAE6OF01D8ARZ.11.73.G07.1.454.CMB.1.raw
  modified_base (338)..(338): a, c, t, g, unknown or other
  misc_feature (338)..(338): n is a, c, g, or t
  modified_base (408)..(408): a, c, t, g, unknown or other
  misc_feature (408)..(408): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaattggtatcggcagcgaccaggaagcccctgagctcctgatctacgatgcgtccaatttaggaacagacgtccacgagttcagtggagtggatntgggacagtactttactctcaccatcagcagcctgcagcctagaagtatattagacaactattattactntacaactagtatgatctctcctctaattccggcctcgggaccagacgtggacatacgtaaacacgtgacgctgacc

SEQ ID NO: 249216 - DNA, 480 bp, Homo sapiens
  misc_feature: GYAE6OF01EH8GL.11.73.G07.1.454.CMB.1.raw
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactattaaatgtatcgtcagcgacagggaagcccctgacgctcctgatctacgatgcgtccaatttggaaacagacggtcccacgaggttcagtggaagtggatcgtgggacaggactttactctcaccatcagcagctgcagcctgaagatattgacaatatattactgtacaactagtatgatcgtctcctntacttcgcctgggaccngagtggaacagtacgaaacaactggcgctgaacc

SEQ ID NO: 249217 - DNA, 573 bp, Homo sapiens
  misc_feature: GYAE6OF01AZWPF.11.73.G07.1.454.CMB.1.raw
  modified_base (379)..(379): a, c, t, g, unknown or other
  misc_feature (379)..(379): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaacttattaaatgtatcggcagcgaccgagggaaacgcccctagacgcctcctgactctacgatcgccgtacctaagtttaggaaacagaccggtcccacggtaggttcaggtaggaagtggatcgtgggactagtactttacnctacaccatcgagcagccctgcgacgtcctagaacgtatagttacgactaactattacttactgtaacaactagttatagtacttccgtacctaccgttacgtaccgtttcccgggacccgttacgggaaccctagggtacgttcggaacgtacgtaacggaaaacgtacgttaggtcggtccgtaggtacccg

SEQ ID NO: 249218 - DNA, 530 bp, Homo sapiens
  misc_feature: GYAE6OF01DM2A2.11.73.G07.1.454.CMB.1.raw
  modified_base (254)..(254): a, c, t, g, unknown or other
  misc_feature (254)..(254): n is a, c, g, or t
  modified_base (410)..(410): a, c, t, g, unknown or other
  misc_feature (410)..(410): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaatgtatcggnagcgaccaggaagcccctgagctcctgatcttacgatgcgtacctaatttacgggaaactagaacgtccccgaaccgagggtttcaaggtaggaaggttggatcgtggggacagtactttacgctcacctatcagcacgcctgacagcctaggaanattattgactaactattattactgtacaatagtatacgattcgttctaccttctaacgtttcccggccgtcgggacctaggacgtggactatacggaaacgtactggtcggctggtaccc

SEQ ID NO: 249219 - DNA, 632 bp, Homo sapiens
  misc_feature: GYAE6OF01EIDB5.11.73.G07.1.454.CMB.1.raw
  modified_base (279)..(279): a, c, t, g, unknown or other
  misc_feature (279)..(279): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtccaccatccacttgccaggcgagtcaggactaattaagaacttatttaaattggtatcggcagacgacgagggaacnccctgacgctcctgactctacgactcgacgtactaagttacggaaactacggacggtacccaacggtaggttacgaaggtagggaagtgggtacgttcggtacggggtaactacggttaaccttttaccgtaccttaccgtaaccctacgttaccgaacggacctaacggtccctacggacctacggtaccctaggaacgtaattacgttacgactaaacgtattacgttactacgtacaacgtagttatacgtacttccgtacttcctacttacgttcccggaccgtacgggaccgtaggtacggtcgaactaagtaacgtaaacggtacgtagggtcgtctcggtaacccg

SEQ ID NO: 249220 - DNA, 775 bp, Homo sapiens
  misc_feature: GYAE6OF01A15D7.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtcgccagatgtgacatccagttcgaccctagtcctccacttccctccctgtctcgactattctaagtagggacgacctaaggacttaccaaccattctaccgttcgccgaagggcgacgtcaaggactaattaaagtaactttaatttaaagttaggtaacgtcggacgtacgaccgaaccgaacggggtaaaccgtcccccgtaggaccgtccgttaccgtagtaacttacgtacgtagtccggtacgttaccgttaaagttacggaaactacggtaccggtacccgacggtaggtacgtaggtacggtaagtcggtaacgtacgggtacggacgtaacgttacctttacgtacttaccaacctacgaccgaacgtcccaacggtacctcgaccgtacgtaccgtaagtaacgtagtacttacaacgtaacttaattaacgttaaccgtacgtaaccgtaaacgttagttacgttacgttacgttacccgttaccttacccgttaacgtttaccggtttaacccgggtaccccgtaacggggaaccctttaaggggaaccggtaacggtacctaaaggttaaaacccggtaaacggtaacggtttaacgggtccggtaaccgttaacccggttaacccg

SEQ ID NO: 249221 - DNA, 580 bp, Homo sapiens
  misc_feature: GYAE6OF01C20OB.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggactattaagtaacttaatttaaattggtatcggcagcgacgagggaaagcccctgacgctctgatctacgatcgcgtaccaattaggaaacaggacggtcccaacgtagttacgaggtggaagtggaatcgagggactagtactttaccgtctactaaccagtacaacggcctaacgcctagcaacgggtccctagaacgtaattagtacgacaaactaatatttaacgtagtacaaacgtagttatcgaactttcgtccttaccttacttacgttcccgggtaccctacggggaacctagggtaggttacggacgtacgtaggaaaacgtaacgtggtacggctggtaaccc

SEQ ID NO: 249222 - DNA, 559 bp, Homo sapiens
  misc_feature: GYAE6OF01DFRC5.11.73.G07.1.454.CMB.1.raw
  modified_base (289)..(289): a, c, t, g, unknown or other
  misc_feature (289)..(289): n is a, c, g, or t
  modified_base (337)..(337): a, c, t, g, unknown or other
  misc_feature (337)..(337): n is a, c, g, or t
  modified_base (401)..(401): a, c, t, g, unknown or other
  misc_feature (401)..(401): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatcctccctgtctgcatctataggagacagagtcaccatccacttcgaccagggcgagtcgaaggactattaaagtaacttaatttaaagttggtatcggacaggcgaacgagggaacnccccgtagacgctctgactctacgatcgtcgtacctaattaggaaacngacgtcccgaacgtaggttacaggtacggagtcgagtcgtgggacagtacttctctacacctancagcagctgacacgctagatatatagactaatattattactagacctaatacgtatagtacttacgttctccttacgtacgtttccggaccgtacggacgtaggacggtagggacctaaggttaacgaaacgttaacgtcggtacgtcgtcgtaaccg

SEQ ID NO: 249223 - DNA, 691 bp, Homo sapiens
  misc_feature: GYAE6OF01DDFYZ.11.73.G07.1.454.CMB.1.raw
  modified_base (323)..(323): a, c, t, g, unknown or other
  misc_feature (323)..(323): n is a, c, g, or t
tcagcgagagataccacgaccggtgctcgatttagctctacgctcgagggggcaggagtcagtcccaaccaggacacagcatggacatgagggtccctgctcagctcctggggctcctgctgctctgtctctcaggtgcagatgtgacactccagttcgacccagtcctccactcctcctgtctgcatactagtaggagacgaagacgtccaacctactctacgttcggaccgaggccgtagtcgaaggtactaagttaaacgtaaacttaaattttaaagttaggtacgtacggacgacgaccggaaccggaacgggaaccnccccgtagacgtctacctgtactacgtacgatcgaccgtactaagttacgaaacgtacggtaccggtacccgtacggtagttacgaggtaggaacggtacggtagtacgtaggtactaacgtacttactctacgaccgactacgacgtacgacgtacgtcgacgtacgacctaaggaactaagttacgtacgaactaacttaattaacttacgtacgtaacctaagtaacgtagttaccgtacgtttacctaccttaccgttaacgttacccggttccgtaccccgggttaacggaccggttaagtacggtacggtaacgtaaacgttaacgaaacgggttacgtacgggtacgccgtagtaaccccg

SEQ ID NO: 249224 - DNA, 740 bp, Homo sapiens
  misc_feature: GYAE6OF01EV454.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtagacatcctagttcgaccctagtcctacctactccctccctgtctgctatcttaagaggacacgagtacgtaccacctatcctacgttcgaccgagggacgacgtacgaaggtaactaattaaacgtaacttaatttaaagttggttaagtcggacgacggtaccggaaccggtaacggggaaaccgtccccgtaggtaccgtcctaccgtagtacgtaccgtaacggtacgttacgtaccgttaacgttaaacgttaacggaaaccgtacggtaaccggtaccccggtaacggtacggttacggaaggtagggtaaggtagggtactcggttacgggtaactacggtttacttacctcgtactactactacgacgcgtacgtcccgtgaccgtacgaccgtaagtaacgtacgttaacgtacgaactaacgttaacttacgttaacgttacgtaactaacgtaagttaacgtagtacccgttaccgtttaccttaccgttaccgttaaccggttcccgtaccgggtacggtaacccgtaggtacgtacgaacgtaagaacgggtaaacctcgggttagcgttacgcggtaaccc

SEQ ID NO: 249225 - DNA, 745 bp, Homo sapiens
  misc_feature: GYAE6OF01DZYSF.11.73.G07.1.454.CMB.1.raw
  modified_base (195)..(195): a, c, t, g, unknown or other
  misc_feature (195)..(195): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccattcctcctgtctgctatctatagganacagacgtcaccatccacttgccaggcgagtcgaaggtactaattaaacgtaaacttaatttaaagttggttatcggcacggacgaaccgagggaaacgccccgtgacgtcctcctagactcgtagactcgtacgtaccttaagttaacggaactaggaccggtaccgtacggtaggttacgacggtaggtaaggtggaacgtcgtcgggaactacggttacctttacgtacctaccacctaacgttccgaacgtcgtaccgtcccgtacggaccgaacgtaccggttaagtaaacgttacttacgttaacgtaaccctaaacgttaactttacctttaacgtaccgttaaacctaaacgtttacgggttaacgtttaacggtaccgttttacccgttcccgtttaaccccgttaccggtttaaacccgggtttccccgggacccgggttacggggtaaacccgtaaggggtaccggttaccggtaaaccttaagggtaaaccggtaaacggttaacgggtaccggtacgggtcccgttccggtaaaccc

SEQ ID NO: 249226 - DNA, 744 bp, Homo sapiens
  misc_feature: GYAE6OF01CHTEX.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccactcctccctgtctgcatctagtaggagacagagtcaccatcacttgccaggcgagtcgaggactaattaagaaacttaattttaaaagttggtaatcggacaggaccgaaccgaagggaaacgccccgtagacgcctcctgactcgtacgagtcgaccgttacctaagtttacggaaaaccgtacggtaaccggtacccccgtaaccggtacgggtttacgaagggttagggaaaggttcggaacgttcggtacgggtaacgtaacgttaacctttttaccgtacctacctaacccgtactacgaccgacgtaacgcccgttagaccgaacgtccgtaaggaagtacttacgtacgaactaaacttaattaactttacgtagtaaccgaaacgttagttacgtacgttaacttcccgttacctttacccgttaacgtttaacccgttttccccggggtaccccgttacgggggaaacccgttaagggtaaccgggtaacgggaaaccttaacgggttaaaaccgtaaaaccgggttaacgttggggttaacccggacgttaccgggtaaaccccg

SEQ ID NO: 249227 - DNA, 688 bp, Homo sapiens
  misc_feature: GYAE6OF01A7NQY.11.73.G07.1.454.CMB.1.raw
  modified_base (327)..(327): a, c, t, g, unknown or other
  misc_feature (327)..(327): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcgaggtgccagatgtgacatccagttgacccagtcctccatccctcctgtctgctatctagtaggagacagatcacctatcactgccaggcgtagtcgaaggactaagttaaagtaacttaagtttaaagttggtaactacggacaaggaccgaccgaacgggaacgtccccgtagacgtcctcctagatactacgntcgcgtacctaagttagaacgtacgacggtaccacgtaggttacgacggtaggagtgacgtacgtagggactacgtacttacgtctacctacacttacgacgtcgacgtacccgtcgacaccggtacgtaacgtaaagactttaacgtacgtacctaaaacgtatttaaacgtttaccgttaagtttacccgaaagtacgggtttaactacggttaaaccgttccgtttaccgttaccctaacggtttaccgtttaccccgggacccgggtttaacgggaccggtagggttaacggtaccggtaacgtaacgttaaaccgggtaacaaacggggtttcgacggttcgtaaccggtaacccc

SEQ ID NO: 249228 - DNA, 703 bp, Homo sapiens
  misc_feature: GYAE6OF01DAL69.11.73.G07.1.454.CMB.1.raw
  modified_base (195)..(195): a, c, t, g, unknown or other
  misc_feature (195)..(195): n is a, c, g, or t
  modified_base (327)..(327): a, c, t, g, unknown or other
  misc_feature (327)..(327): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctccctgtctgcatctatagganacagatcacatcacttgccaggcgagtcaggacattaacgtaacttaatttaattggtatcggcacgcgaacgagggaacgccccgtagacgcctccgtgtactactacgatcgcgtactaatttaggaacncggacgtcccgacgtaggtacgaggtggtaaggtagtatcggtacgggaactagtaaccttttacgtccttaccaaccctattccgaagtaccgaccgtacccgttaggaccgtaacggacccgttaaggaaacggttaactttaacgtttaccggaaacctaacttaacgttttaactttaaccgttacggttaaccaaaaccttagggtaactttacggttaattccccggtttaccttaccccgttaaccctttaacgggttttacccccgggccggttaaccggggtaccgtaaggggtaaccggttacgggaaccttaaagggtaaacggtaaaccggtacggttaagggtcgggtactccgggtaaaccc

SEQ ID NO: 249229 - DNA, 779 bp, Homo sapiens
  misc_feature: GYAE6OF01CFJS7.11.73.G07.1.454.CMB.1.raw
  modified_base (142)..(142): a, c, t, g, unknown or other
  misc_feature (142)..(142): n is a, c, g, or t
  modified_base (204)..(204): a, c, t, g, unknown or other
  misc_feature (204)..(204): n is a, c, g, or t
  modified_base (633)..(633): a, c, t, g, unknown or other
  misc_feature (633)..(633): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagntgtgacatccagttcgacctagtcctccacttccctccctgtcctagcctatctagtagganacgagacgtccacctatctacttcggacccgagggccgagtcgaacggtaactaagttaaagtaacttaagtttaaagtggtaacgtcggacgagaccggacgaagggtaaccgtcccaggaccgtctaccggtacgtactaccgtacggtacgtacggttaccgttaaccgttaaggttaaccgggaaaacgtacgggtaacccggtaccccgtaacggggtaagggtttacccgggaagggttaacgggtaaagggttccgggaacgtttcggggtaacgggtaaaccggttaacggtttaacccttttacccgggaccttacccgtaaccgtacctacgacccgacgacggtcccgttagaccggtactacgttaacgggaaacttagttaacgttacaacctaaagttaccgttaataaccgttntaaccggtaattacggtacttcgttaacctcggttaccctacggttacctaacgggttcccggtacccgaagggtccctaagggtgttaccgggaaattaccgggaaacgtaaacgggtcttaacggtccgtaccgtcggtaaccc

SEQ ID NO: 249230 - DNA, 592 bp, Homo sapiens
  misc_feature: GYAE6OF01B8PZL.11.73.G07.1.454.CMB.1.raw
  modified_base (138)..(138): a, c, t, g, unknown or other
  misc_feature (138)..(138): n is a, c, g, or t
tcagcgagagataccacgaccggtgctcgatttagctctacgctcagggggcaggagtcagtccccaaccaggacacagcatggacatgagggtccctgctcagctcctggggctcctgctgctctgtctctcaggtnccagatgtgacatccagttcgacccagtcctccatccctccctgtctgctatctagtaggagacagacgtccaccatcacttgccgaggcgagtcaggacattaagaacttaatttaaatggtatcggacagacgacgaagggaacgcccctagacgcctcctgatctacgatgccgtactaagttaggaaacaggtaccggtacccacggtaggttcgaggtaggaaggtggatcgtagggacagtactttactctacacctatcgagcagcctgacacgtctagaagtatatcgactaactattaacgttactcgtaactaaacgtagttaacgtacgttacttccgttacctaccgttacctaacggtttcccggaccgttaccgggtactaaggtacggtacggacgtaaacgtacgtaaaccggtacgtaggtccgtgtcgtaaccccg

SEQ ID NO: 249231 - DNA, 665 bp, Homo sapiens
  misc_feature: GYAE6OF01AZB1J.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtcgccagatgtgacatccagttcgaccctagtcctccatccctcctgtctgctatctaagtaggagacagacgtacacctatctacgttggccagggcgagtcgagaactaattaaagaacttaatttaaagttggtagtcgtacgagccgaacgagggaacgccccgtagacgctcctagactctacgatcgccgtacgtaagttacggaaacgacggaaccgtacccgacggtaggttacgaggtaggtaacgtggtactcggtagggtaactacggtaactttacgtccttacgactactacgacgtacacgtcccgtgaccgtacgtaccgtagaattattacgttacgacctaaactagtttaacctacttacgtaactaacgtagttactacggtaacttccgttaccttccgtaaacgttaccggtttacccgggacccggttaacggtccggtaaggccggttaacgaacctaaggttaaacccggtaaacggtacgttacgggcggttacgtccgtaaccc

SEQ ID NO: 249232 - DNA, 789 bp, Homo sapiens
  misc_feature: GYAE6OF01ETBXI.11.73.G07.1.454.CMB.1.raw
  modified_base (333)..(333): a, c, t, g, unknown or other
  misc_feature (333)..(333): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgaccctagtcctccactccctccctgtctcgctatctaagaggagacgagtacgtaccaccatcctacgttcgaccgagggacgtagtaccgaaggtaactaaagttaaagtaaactttaagtttaaaagttggttaacgtcggaacgacggaccgaacggaacggggtaaacccnccccgtaggaccgtcctacgtagtactacgtacggtactcgacccgttaacgttaaagttaacggaaaccgtacggtacccgtaacccgtaacgggtacggttacgaaggtagggaaacggttcgggtaactcgggtaaccgggacttaacggttaacctttaccgtacctaccaacgtactacgacgtaccgtacgtccgtacgacgtacggtaccaagtaagtaattaccgtagtaaccaagtttaacttaacgtttaccgtacgtaaaccgtaaacgttagttaacgttacggttaccttacccggttaccctttaccggtaaaccggtttacccggtttacccgggaacccggttaagggtaaccgtaagggttaacgggtaccgtaaaacgttaaaccgggaaacggttaaaccgtacgggtttacggccgttaacgttacggaacccccg

SEQ ID NO: 249233 - DNA, 782 bp, Homo sapiens
  misc_feature: GYAE6OF01EIC41.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcgaggtcgaccagatgtacgactacttccgtagttccgaacccgtacgttccctaccctacttccccttccccgttggttcctacggtacctaacttaccgtaaaggtaagggaacgaaccgtaaggtaaccgttacccaacctaacttccgtaccgttcgaccggagggtaccgtaacgtacgaacggaacttaagttaaacgtaaactttaagtttaaagttggttacgtcggacgacggtaccggaacggaacggggtaaccgtacccgtaggaccgtccgtacgtacgtacgtacgtacgtacgtcgtaccgtaacgttaagttaacggaacgtacggaccggtacccgtacggtaggtacgaggtagtaaggtcgtacgtgacggtactacgttacttacgtctaaccacgtactacgacgacgtacgtccgtacgacgtacgtacgtaacggtataacgttacgtacgtaaactaacttaacgttaccttaacgtacgttaaacgtaaaggttacttaaacgttcgttaccttcccgttaacctaccgtttaaccgttaccggttccggaaccggtaacgggacgtaggtacgtacggaagttaacgaaacggtaacgtacggtggtaccgtcgtacggtaaccc

SEQ ID NO: 249234 - DNA, 774 bp, Homo sapiens
  misc_feature: GYAE6OF01BFT0U.11.73.G07.1.454.CMB.1.raw
  modified_base (209)..(209): a, c, t, g, unknown or other
  misc_feature (209)..(209): n is a, c, g, or t
tcagcgagagataccacgaccggtgctcgatttagctctacgctcagggggcaggagtcagtcccaaccaggacacagcatggacatggagggtccctgctcagctccgtggggctcctgctgctctgtctctcgaggtcgaccagatgtgacactcctagttcgaccctagtcctccacttccctcctgtctgctactctagtagganacagactaccacctatctacgttcgaccgaggacgacgtacgaaggtactaaattaaacgtaactttaatttaaagttggtaacgtacggacaacggtaccggaaccggtaacgggaaacccgtccccgtaggtaaccgtcctaccgtagtaacgtaccgtaacgacgtaccggtaccgttaaaccgttaaggtttaaacgggaaacgtacggtaacccggttaccccgtaagggttaacggttacgaagggttaaggtaaacggtacgggtacgttacgggtaacgggtaacttaacggttaaccttttaccgacccgtaacctaccgtacgttaccgaccggacctaacggtccctacgggaccgtaaccggtaccgtaaggtaacgtaacttacggttaaccaacctaaacgttaactttaaccgttacgtaacgtaacctaaagtagttaactcgttacttacccgtctaccgtacgttacccgttccggtaacccgtcgggaactaggacgtacgtaacgtaacgtaaacggtacgtacgttggacgtcgtacgtaaccc

SEQ ID NO: 249235 - DNA, 776 bp, Homo sapiens
  misc_feature: GYAE6OF01CM2I9.11.73.G07.1.454.CMB.1.raw
  modified_base (312)..(312): a, c, t, g, unknown or other
  misc_feature (312)..(312): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccactccctccctgtcctgcctatctaagtaggagacaggactcaccatcacttcgccaggcagtcgaggataattaaagtaacttaatttaaatggtatcgcgagaccgacgaaggaacgcccctagacgctcagactctacgntcgcgtacctaagttacggaaactacggaccggtacccgaacggtacggttacgacggtaggaacggtggtacgtacggtagggaaccgtaacggttaccttttaccgacttaccaaccgtactaccgaacgccgtaaccgtcccgacgtaccgaaccgttccgtaaggtaacgttaactaacgtttacgaacccgttaaacttaaatttacgtttaaccgttacgttaaacccgaaacgttaacggttaagtttaacggtaacccgttttacccgtttacccgttttaaaccccgttaaccgtttaaacccggttttaccccccgggggacccggtttaaacccggggtaaacccggttaacggggtaaacggggttaaccggaaaccgttaaacgggttaaaccgggtaaaaaccggtttaaccgttacggggttaacccggtccgttaccggtaaaccccg

SEQ ID NO: 249236 - DNA, 819 bp, Homo sapiens
  misc_feature: GYAE6OF01ESV5W.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcgaggtgccagatgtgacatccagttcgacccagtcctccactcctcctgtctgctatctagtaggagacaggactcacctatcctacttcgcgaggcgagtacgaggaactaagttaaacgtaactttaagttttaaaagttggtaacgtcggactaggaccggaaaccgaacgggggaaaccgtccccgtaggaccgtccgttaccgtacgtacgttaccgtaagtacgttacggtaccgttaaccgttaaagtttaacggaaaaccgtaacgggtaaccggttaccccgaacgggttaacgggttacgtaacgggttaagggtaaacgggttcgggtaacgttaccgggtaacgggggtaaccttaacggtttaaaccccttttctaacccgttaacccaaccgtaactaccaacggtaccgtacggtacccgtacgacccgtaacggtacccgtaaggtaaacgtttacgttaacgtttacgaaaccctaaacggtttaactttaaccgtttaactaaccggttaactaaacggtaggtttaaccttacggttaactcccggtttaccttaccggttactttacccggttcccgggaccggttacgggtaaccgtaagggtacggtacgtaaccgtaaagttaacgggtaaaccgtaggttacggtaccgggtactccggtaac

SEQ ID NO: 249237 - DNA, 725 bp, Homo sapiens
  misc_feature: GYAE6OF01BXTG1.11.73.G07.1.454.CMB.1.raw
  modified_base (368)..(368): a, c, t, g, unknown or other
  misc_feature (368)..(368): n is a, c, g, or t
  modified_base (605)..(605): a, c, t, g, unknown or other
  misc_feature (605)..(605): n is a, c, g, or t
  modified_base (676)..(676): a, c, t, g, unknown or other
  misc_feature (676)..(676): n is a, c, g, or t
tcagcgagagataccacgaccggtgctcgatttagctctacgctcgagggggcaggagtcagtcccaaccaggacacagcatggacatggagggtccctgctcagctccgtggggctcctgctgctctgtctctcaggtcgccagatgtgacatcctagttcgaccctagtcctcctctccctcctgtctgctatcgtagtaggagacagacgtacaaccatcctacgttcgaccgaggcgaacgtccgaaggactaagttaaacgtaaactttaagttttaaaggttaggttacgtacgggacaacggtaccggaaccgaacggggaaccgtccccgtagacgtcctacctagtaccgtacgtaacncgtaccgtaccgttacgttaaacgttaacggaaacgacggtaacccggtacccgaacgttagggtacgtaaggtagggtaaggtaggtacgtacgggaagtacgtaacgtttaaccttaccgtacctaccgtaacctcgtaacgcgacgtacctcgtacggtacaacggtcgtaagaaacgtttactacgtttaacgaaccttaagttaacttaaccgttacgactaacgtaacgtnttaacgtacgttacctaccgttcctaccgttacgttaccggttcccggacccgtagggtaacctaacgggngttacgaaccctaaggtaaaccgtacgtagtacgggcaccgtgtacccg

SEQ ID NO: 249238 - DNA, 705 bp, Homo sapiens
  misc_feature: GYAE6OF01BLMSQ.11.73.G07.1.454.CMB.1.raw
  modified_base (203)..(203): a, c, t, g, unknown or other
  misc_feature (203)..(203): n is a, c, g, or t
  modified_base (468)..(468): a, c, t, g, unknown or other
  misc_feature (468)..(468): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcgaggtcgcagatgtgactatcctagttacgacccagtcctaccactccctcctgtctgacatcagtagganacagtatccacctatcctactgaccaggcgagtcaggactaagttaaacgtaactttaatttaaagttggtaagtcggactacggaccggaaccggaacgggaaccgccccgttaggaacctcctaccgtaggacttaccgaggtacgtacggtacctaaccttaaggttaaccggaaacgtacggtaaccggtaccccgaaggtacggttacgaaggtacgggtaagtacgggacttacggtaggtactaacgttacctttacncctactaccgactacgacgtacgtacgtaccctggaccacggtaccgtaagaagttacgtagttaccgaacttaactagtttaacgtactggtaacctacgttagtaacttcggtacttaccggtcctttacgtaccgttacgtacccgtaaccggttcggaaaccgtgggtaaacgttcggaaccgttaacggaaacggtaaacgttcgggttacgtacgggtactcgtaaaccgg

SEQ ID NO: 249239 - DNA, 793 bp, Homo sapiens
  misc_feature: GYAE6OF01DPZKI.11.73.G07.1.454.CMB.1.raw
  modified_base (138)..(138): a, c, t, g, unknown or other
  misc_feature (138)..(138): n is a, c, g, or t
  modified_base (345)..(345): a, c, t, g, unknown or other
  misc_feature (345)..(345): n is a, c, g, or t
tcagcgagagataccacgaccggtgctcgatttagctctacgctcagggggcaggagtcagtcccaaccaggacacagcatggacatgagggtccctgctcagctccgtggggctcctgctgctctgtctctcaggtnccagatgtgactactcctagttcgaccctagtcctccactccctcccgttgtcctgactattcgttaagagggaacgacagtacgtaccacctagttcctacttcggaccgagggtcgaacgtacgaagaactaagttaaagtaactttaaagttttaagttcgggtatccggagtacggaccggaaaccggaagggggtaaacccnccccgtagaccgtccttaccgtagtaaccttacgtaacgtaggttaccgtaccggtttaaccgttaaagttacgggaaacctcggggttaaccggtacccccgtaaaggggttacggttaggaagggttacggggtaaagttcgggacttaccggtaacggggaacctaggtttaacccttttcaaccgtaccctaaccgtactacggtacgaccgtaccggaccgttaccggacgtaaccgtaaccgttaagggtaaacgttaacttacgttaacgactaaaacttaacgttaacgttaactccggtaataaaccgttagtacgttacgttacgtttaccgtcccttaaccgttagtttaccggttcccgacccgggttagggaccgttaagacgggtacttaaacgaacgtttaacgaaacggttatagggtccgactccgtaacc

SEQ ID NO: 249240 - DNA, 742 bp, Homo sapiens
  misc_feature: GYAE6OF01E5PD3.11.73.G07.1.454.CMB.1.raw
  modified_base (141)..(141): a, c, t, g, unknown or other
  misc_feature (141)..(141): n is a, c, g, or t
tcagcgagagataccacgaccggtgctcgatttagctctacgctcgagggggcaggagtcagtcccaaccaggacacagcatggacatggagggtccctgctcagctccgtggggctcctgctgctctgtctctcgaggtnccagatgtgactactccgtagttccgaccctagtcctacctactccctcctgtctcgctatactagtacggagacacgtactccacctactctacgtcggaccgagggacgtaaggtacgaacggtaactaatttaaacgtaacttttaagttttaacgttggtacgtccgggacacgggtacccgaacggaaccgggaacccgtcccgtacggacgtaccttaccgtagtacgttaccgtacggtacgtacgtacccgttaacgttaaaggttaacggaaacgtacggtaccggtacccgaacgggttacgttacggaggtaggtaacgtggtacgtacgtacgggtaactacgttactttaccgtactaccgaacctacgtaccgacgtaccgtacggtcccgtacgaccgtaacgtaccgtaagtaacgtattacgtactaacttaacttattaaccgttacgtgtaacctaagttgtaacgttaccgacgtttacccttacgttacccgtacgtttacccggttcccgaccgggttacggaccgtaggtacgtacggtaacctaagggaacctacggtagcggtacgtcgtaccgac

SEQ ID NO: 249241 - DNA, 606 bp, Homo sapiens
  misc_feature: GYAE6OF01BAF8Q.11.73.G07.1.454.CMB.1.raw
  modified_base (268)..(268): a, c, t, g, unknown or other
  misc_feature (268)..(268): n is a, c, g, or t
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtccaccatcacttgccaggcagtcaggacattaagaactattaattggtatcgcagcgacgaggaaancccctgacgctcctgatctacgatcgcgtactaagttacggaaacagacggtacccacggaggttcaggtaggaagtggatcgagggacagtacttactctacacatcacgcacgctacgcacgccgtagaacgtatacgttcgactaaacgtattactttaaccgtagtaccgtaaataacggttagttacgtaacttccgttaccttaccctttaccgtaacgtttttacccgggtaccccggttacgggtaccccgtaacgggttaacgttacggggaacttaagtaaacgggtaaaacccggtaacggttacgggtcgtccgtacggtaacccc

SEQ ID NO: 249242 - DNA, 763 bp, Homo sapiens
  misc_feature: GYAE6OF01CDJED.11.73.G07.1.454.CMB.1.raw
  modified_base (201)..(201): a, c, t, g, unknown or other
  misc_feature (201)..(201): n is a, c, g, or t
tcagcgagagataccacgaccggtgctcgatttagctctacgctcgagggggcaggagtcagtcccaaccaggacacagcatggacatgagggtccctgctcagctccgtggggctcctgctgctctgtctctcaggtgccagatgtgacactccagttcgacccagtcctccactccctcctgtctgctatctagagganacagacgtccactatccacgttcgaccgaggacgagtacgaaggactaattaacgtaactttaagtttaaagttacggtacgtcggacacggaccggaacggaacgggaaccgccccgtaggacgtccctcgtacgtacttaccgtaacgtgtacgtaccgtaacgttaagttaacgggaaacgtacggtaccggtacccgtaacggtagggtttacggaaggttagggtaacgtggtacggtacggtacggtacgtaacgtttacctttacctccttaaccaccgtataccgacgtacgtacgtccgtacgaccgtaacggtaccgtaagaaacgttagtttaacgtacctaacgtaaacttattaacgtttaacgacggttaaaccaacggttaagtttacgtacggttaaccctttaccgttacctacccgtttaacggttacccgtttacccggggaccgttaaccgggtaaccgagggttaacggtacggtaaacgttaaccgtaaacgggtaaaccgttaaccggttgggtaaccgttcgggtacccttaacccgg

SEQ ID NO: 249243 - DNA, 861 bp, Homo sapiens
  misc_feature: GYAE6OF01BJMC6.11.73.G07.1.454.CMB.1.raw
tcagcgagagataccacgaccggtgctcgatttagctctacgctcgagggggcaggagtcagtcccaaccaggacacagcatggacatggacgggtccctgctcagcctccgtgggctcctgctgctctgtctctcgaggtcgcagatgtgacactcctagttacgaccctagtcctcctacttccctccctgtctgctatacgtagtaggacgaccgagtactaccacctattacctaccgttcggccgaggggaccgtacggtacgaaacgggtaaccttaaagtttaaaacggttaaactttttaaagtttttaaaacggttggggttaacggtaccggtaccgaaacggacccggtaaacccgggaaacgggggtaaccccgtcccccggttagggtacccgtcccttaccgtacggtacttaccggtaccggtacgtacgtaccggttaaccgttaaaggttaaccgggaaaccgtaccggtaacccggggtaccccgtaacgggttacgggttacgaacgggttaagggaacggttggtaacgtccgggtaacggtaacctacggttaccctttacaccgtaaccactacgtacgacgtaaccgcgtccgtcgaccgtacgtacgtaagtaaacgttacttacgttaacgaacttaaactttaactttacctagttaccgtaaaccttaggtaagttcgttacgttaccgttacccgttcttaaacccgttcccgggtttaaacccggttcccgggtacccgggtaacgggtaacctaggttaaacggggtactaaaacccggtaggtaaaaccggttacgtaccggttagggtactaccccgtacgtaaacccg

SEQ ID NO: 249244 - DNA, 630 bp, Homo sapiens
  misc_feature: GYAE6OF01CBU8A.11.73.G07.1.454.CMB.1.raw
  modified_base (197)..(197): a, c, t, g, unknown or other
  misc_feature (197)..(197): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtcctccatccctccctgtcctgcatctatagganacagacgtcaccatcatcgccaggcgagtcaaggactaattaagaacttaatttaaagttggtactcggacaggccgaacgaagggaaaccgccccgtagacgtctccgtgtaactccgtacgatcgaccgtactaaagtttacggaaactaggaccggtacccaacggtaggttacaggtaggaagtgatcgtaggactagtacctttacgctacacctatcgacgcacgtccaggtaccacgtctaagaagtatacgttacgactaaagtattaacttactacgtaactaaacgtaagttacgtagtaaccttccgttacctacccgttaacgttaacgttccccgggtacccgtacgggtaacccgtaggtacggtacgggaacaacgtttaaacggaaacgtaacgttgggtaccggtctacggtaccc

SEQ ID NO: 249245 - DNA, 733 bp, Homo sapiens
  misc_feature: GYAE6OF01DW3L6.11.73.G07.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (276)..(276): a, c, t, g, unknown or other
  misc_feature (276)..(276): n is a, c, g, or t
tcagcgagagataccacgaccggtgctcgatttagctctacgctcagggggcaggagtcagtcccaaccaggacacagcatggacatgagggtcccctgctcagctccgtggggctcctgctgctctgtctctcaggtgccagatgtgacatccagttgacccagtctccactcctccctgtctgactatcgttaanagganacagagtcaaccctatcacgttgccagggccgagtcaaggaacaattaaacgaattaatttaatggtaatcggnagcgacagggaacgccctagacgtctcctagtactacctacgacgtcgtacgtacctaaagttttaacgggaaaactaacgggtaaccgggttaccccgtaaccgggtaacggtttaccgaaggtttaggggaaacggttggggtaactacgggtacgggaacgtaaggtaaccgttttaacctaccgttaccgaacccataccacgacgtaaccgtccgtcggaacgacgaccgttaagaaagtagttaacgttacgaaccttaaataaggtaacttttaacgtacgggttaacaaacccgaagttaacgtacgtaacgttacccggttaccttccccttaaacgttaaccggttaccgggtaccccgttaggggaccccaaagggttacgtacgggtaacctaacggttaacgtaaaaaccggtaacgttaggtaacgggtcctacgggtaaccc

SEQ ID NO: 249246 - DNA, 679 bp, Homo sapiens
  misc_feature: GYAE6OF01AD4SJ.11.73.G07.1.454.CMB.1.raw
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
tcagcgagagataccacgaccggtgctcgatttagctctacgctcagggggcaggagtcagtcccaaccaggacacagcatggacatgagggtccctgctcagctccgtggggctcctgctgctctgtctctcaggtgccagatgtgacatccagttcgacccagtctccactccctcctgtctgctatctataggagacagacgtcactatcacgttcgccgaggcgagtcgaaggaactaattaaacgtaacttaatttaaagttggtaagtccggacgacggaccggaaccggaacgggaaacccgcccccgttaggacgtccttaccgtaggtaccttcgtaacgtacgtcggtaccctaacgttaaacgttacgggaaacacggtaccggtacccgaacgggtacggttacgaagggttaggaacggtggtagttcggtacgggaactacggtttactttacctccaactaccngtacncgacacgtccgacgcgaacgtacgtagaagtattacgtacaacctaaagtactttaacgttgtaacgtaactaagtagtagtactacttcccgttaccttacccgttattacccgggttccggccgtaagggtacccgtaggtacgtggtaaacctagtaaaccgggtaaacctggtggtcggtactcgtaaccg

SEQ ID NO: 249247 - DNA, 632 bp, Homo sapiens
  misc_feature: GYAE6OF01ASLFI.11.73.G07.1.454.CMB.1.raw
  modified_base (260)..(260): a, c, t, g, unknown or other
  misc_feature (260)..(260): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctccctgtctgcatctataggagacagagtccaccatcacttcgccaggcgagtcaggactattaagaacttattaattggtatcggnagcgacgagggaacgccctgacgctctagatctagatgacgtactaagttaggaaacagacgtaccgacgtaggttacaggtaggagtggactcgtaggactagtctttactcctacactatcagcacgcctagacacgacctagaactagtacgtacgacgtaactaacgtttacttacgttacgtaactaaacgtagttactacgtacgttcccgtaccttcccgttaaccgttaaccggtttacccgggtaacccccggttaacggggaaccccgttaagggtaacgggtcgggtaaaaccgttaacggttaaaaccgggtaaaaccgggttacgtttaacggggtacggtcccgttaacggtaacccg

SEQ ID NO: 249248 - DNA, 742 bp, Homo sapiens
  misc_feature: GYAE6OF01AK09N.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccactccctccctgtctgctactctagtaggagaacagacgtccacctatccacgttcgaccgagggcgacgtacgaaggaactaagtttaaacgtaaactttaagttttaaagttggttataccgggacgtacggaccggaaccggaacggggaaaccgtcccccgttagacgtaccctccgtacgtacgttaccgtacgtacgtccgtaccgttaccgtaagtttacggaaactacggtaccggtaccccgacggttacggttacgtagggtaggtaacggtggtactaccggtagggtactacgttacctttacgtaccttaccgaacctacgtacgacgtaccgaccgtaccgtcgacctacgtaccgtaaggaacgttaacttacgtacgaaccttaacttaactttaacgttaccgttaagttaaccaacggtttacgtacgttacgtttaccgttccgttaccgttacccttaccgttaccggttcccggaccggtacggtaccagggttcgtacggaacctaacggtaacggaacccgttacggtaggccgttactacggtacccc

SEQ ID NO: 249249 - DNA, 707 bp, Homo sapiens
  misc_feature: GYAE6OF01BNF1O.11.73.G07.1.454.CMB.1.raw
  modified_base (198)..(198): a, c, t, g, unknown or other
  misc_feature (198)..(198): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcatctagtagganacagagtcaccatcgacttgccagggcgagtcgaggaacctaagtttaaagaaacttaattttaaaagttggtattcggcagaccggaaccgaagggaacgccccgtagacgtcctctgactcgtacgatcgaccgtactaagtttacggaaacacggtaccggtacccacggtacggttacgaaggtaggtaagtggacgtacggtagggactaagtacctttaactcctaccgacctatccgacgacgacgtccgtacgacgaacgtccgtaaggtaacgtaattacgtacggaactaaacgtactttaccgtttaacgtacttaaccgaaacgtttaggttacgtacgttacccgttaccgtttaccccgttaccctttaacggttaacccgtttcccgggaacccggtttaccgggaaaccgtagggtaacgggttaaccggaacgtaaacgttaaacggtaaaacccggttacgttaacggggtctaccggttcgaaaccccgg

SEQ ID NO: 249250 - DNA, 668 bp, Homo sapiens
  misc_feature: GYAE6OF01CR6A3.11.73.G07.1.454.CMB.1.raw
  modified_base (145)..(145): a, c, t, g, unknown or other
  misc_feature (145)..(145): n is a, c, g, or t
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (546)..(546): a, c, t, g, unknown or other
  misc_feature (546)..(546): n is a, c, g, or t
  modified_base (578)..(578): a, c, t, g, unknown or other
  misc_feature (578)..(578): n is a, c, g, or t
tcagcgagagataccacgaccggtgctcgatttagctctacgctcagggggtcgaggagtcagtcccaaccaggacacgagcatggacatgagggtccctgcctcagctcctgggctcctgctgctctgtctctcaggtgccagntgtgacactccagttcgaccctagtcctccactccctcctgtctgctatctataggatacagngtccaacatcncttgccgaggtccgagtaccaaggactaagttaaagtaacttaatttaaacgttggtaacgtcggtacaggaccgaaccggaagggaaacgcccccgtaggaaccgtcttacgtagtaccttacgttaacgacgtcgtacgttaccgtaaggtttaccgggaaacgtacggaccggtaccccgtaaccgggtacggtttacgaacggttacgggaaacggttcgggaacgttcggtacggggtaactacgttaaccgtttacctacgtacctactacgtacacgtcacgccgtcggactacgacctagagtactatacgactaacgnttaacgttactcgtaactacgtagtgtacgtnttaccgttcctaccgtacgtacgttccggaccgtacggaccgtaggtacgtcggtactagtacgaaacgtactggacgtccgtagtaccc

SEQ ID NO: 249251 - DNA, 668 bp, Homo sapiens
  misc_feature: GYAE6OF01ABV8E.11.73.G07.1.454.CMB.1.raw
  modified_base (193)..(193): a, c, t, g, unknown or other
  misc_feature (193)..(193): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcacatcacttgccaggcgagtcaggacattaagaactattaaacttggtatcggacagcgaccagggaaacgccccgtgaacgctccgtagactactacgatcgcgtaccgtaaattttcgggaaaacaggtacggtaccccgtaacggtacgggtttacgaaggttaggaaacggttcggtaacgttacgtacggggtaacctaacggttaaccttttacgtaccgttacaaccgtagtacctaacggcctaacggtacccttacggacctacgtcccgtagaaacgtattagttacggacctaacgtattaacttaccgtagttaacctaacgtaagttaacgtacgtactttaccggttacctaccttacgtaacgtttacccgggacccgttagggacccgtaaggtacggtacggaactaacgttacggaaaaccgttactagggtaccggcttacggtaccc

SEQ ID NO: 249252 - DNA, 771 bp, Homo sapiens
  misc_feature: GYAE6OF01CQSNG.11.73.G07.1.454.CMB.1.raw
tcagcgagagataccacgaccggtgctcgatttagctctacgctcgagggggcaggagtcagtcccaaccaggacacagcatggacatggagggtccctgctcagctccgtggggctcctgctgctctgtctctcgaggtcgccagatgtagacactccagttcgacccagtcctccacttccctcctgtctgactatcgtaagtaggagaacaggtactaccaacctatcctaacgttcggacccgagggacgtaaggtaccgaaaggtaacttaaagttaaaacggtaaaacttttaaagttttaaaaggttagggttaacgtaccgggaacgaacggaccggaaaaccggaacggggtaaaacccgtccccgaggtacccgtaccgtaccgtacgtaacgtaccgtaaggtacgtaccggtacctaaacgttaaaggttaaccggaaacgtacggtaacccgtacccggacggttagggttacggaaggtagggtaacgtaggtacgttaccggaagggtacctaagttaccgtttaccactaccgaactacgtacgacgccgtacgccgtagaaccgtacgtacgtaagacgttaataccggtataacctaacgtttaatacgttactaacgttaccaagttaattagtactacccgttacgtaccttacccggttataccccgggttacggacccggttacgaaaggttacggaggtaacgtaacgtaacggtaaacgaaggtcgttagggaccttgtaccgtacg

SEQ ID NO: 249253 - DNA, 892 bp, Homo sapiens
  misc_feature: GYAE6OF01AU5XY.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggatacagacgtacaccatccacttcggaccagggtacgagttaccgaagggtacctaagttaaacggtaaacctttaagttttttaaaaagttcgggttaagttaccgggacgaacggtacccgggtaaaccgaaacgggggaaaacccgtccccccgttaggggaaccggtaccctttcccggttagaacgtttacccgtaaacggggtacttacgggtaccccggttaacccgttaaagtttttaaccgggggaaaaacctaccggggtaaccgggtaacccccgtaaccggggttacgggtttaaccgtacggggttaaggggtaacggttacgggtaacggtacccggttagggggtaaacctacgggttaaacccttttacgtaccttacccgtaaccctaattcccgaagggtcccgtaacggtaccccctggtaacccgaaccggtacccgtaagggtaaacgtaacggtttactaaaccggtacctaaactaagttttaaccgtttaaccgttacggttaactaaaaccggtagttaacgtacgtaacgtttccccgttacccgtaccgtttaaccgttaccgtacccgggttacccggtacccgggtaacgtagggtaacggtttacgggaacctaagttaaacccgggaaacggtttaaccggttgggaccggtaaccgttcgggaaacc

SEQ ID NO: 249254 - DNA, 686 bp, Homo sapiens
  misc_feature: GYAE6OF01BNAH6.11.73.G07.1.454.CMB.1.raw
  modified_base (203)..(203): a, c, t, g, unknown or other
  misc_feature (203)..(203): n is a, c, g, or t
  modified_base (436)..(436): a, c, t, g, unknown or other
  misc_feature (436)..(436): n is a, c, g, or t
tcagcgagagataccacgaccggtgctcgatttagctctacgctcgagggggcagggagtcagtcccaaccaggacacagcatggacatgagggtccctgctcagctccgtggggctcctgctgctctgtctctcgaggtgccagatggtgacatccagttcgacccagtcctccatccctcctgtctgcatactagtagganacaaggtactccaccactcctacgttcgaccggtaggacggacgtacggaaggtaactaatttaaacggtaactttaagtttaaacgttggtacgttacggacgtaacggaccgaaccgggacgggtaaaccgtccccgtaggaccgtacctccgtagtactcgtacgagtgtaccgtactaagttacggaactacgggaccgtacccaggtaggttacgacggtaggtaagnggtacgtacggtacgagtacgttacgttacgtctacctacgacgtcagacgtacgtcctacgtcgacgtacgtaagaacgtatcgtaacgataactattacgttatacgtaaccgtaacgtagtacttacgtacgttccgttaccttacccgtaagtttccgtaccggtacccggtacgggtaacttacgggacggttacgaacgttagaaccgggttaaacgtagttacggcgtacgtaccggtacccg

SEQ ID NO: 249255 - DNA, 808 bp, Homo sapiens
  misc_feature: GYAE6OF01EVKH9.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggcctcctgctgctctgtctctcgaggtgccagatgtcactactccagtttcgaccctagtccctcctactccctccgtgtctgctatgtaagtaggacacagtactccacctatcctacgttcgaccgagggtcgaagtaccgaaggtaacctaagttaaacgtaaactttaagttttaaacgttggttaacgtccggacaacgggtaccgaaccggtaagggaacgtcctaaccggtaggaccgtcctccgtagtacctacgtacgtatcggtacgttacctaaaggttaagaaccgtacggtaccgtaccgtacgggtagttaccgagggttacggaagtcggtaactaccgggtacggtaaacttacggttaacccttttaccgacctaccgtaaccttaacgtacgacgtacccgtacgtcccgttaagccgtaacccggtacttaaagggaaacgttacgttaaccgttacgtaaacctaacgtttgttaaaccgttaccttaacgaccttaacggttaacgtttaacgttacccggttaacgtttacccgttaacccttaccggttacccgtttaaaccggggttccccgggttaacccgggtaccgggaaaggttacggaacccgggttaagtaccgtaaaaacggttacggttaaacggttaaccccggttgggtaccggccttaaccg

SEQ ID NO: 249256 - DNA, 727 bp, Homo sapiens
  misc_feature: GYAE6OF01AQLIT.11.73.G07.1.454.CMB.1.raw
  modified_base (107)..(107): a, c, t, g, unknown or other
  misc_feature (107)..(107): n is a, c, g, or t
  modified_base (717)..(717): a, c, t, g, unknown or other
  misc_feature (717)..(717): n is a, c, g, or t
tcagcgagagataccacgaccggtgctcgatttagctctacgctcagggggcaggagtcagtcccaaccaggaccacagcatggaccatgagggtccctagctcagntccgtggggctcctggcgtgtctctgtctctcgaggtgccagatggtgactactcccacgttcggacccagtcctcccagtccctccctggtcctggacatcgtaagtagggacgacgagacgtacaccatcctactttcgccgaggcgagtcgaggactaattaaacgtaaccttaatttaaacttggtactcggacgagtccggaccgaaggaaccgcccccgtgaccgtcgtcctaggacttacgtacgtagtacgtaccgttacctaaacgtttagggaaacgtaggtaccgtacccgtaaccggtacggttaccgaaggtacgggtaaaggtacggtaagtcggtacggggtaaccgtaacggttaaccctttaacgtaccttaccgaaccgtacgtaccgaacgaccgtaaccggacccgttacggacccgtacgtacccggttaagaaacggttaggtaacttacggaaccttaacgtaacttacgtttaacgtcgtaaacctaagtacgtaagtcgtacgtaccgttctaccgttactaccgttccggccgtacggtaccgtaggttaggcgtactaagaacgtaaacgtacgttagtcgtntacggtaccg

SEQ ID NO: 249257 - DNA, 274 bp, Homo sapiens
  misc_feature: GYAE6OF01DM8ZD.11.73.G07.1.454.CMB.1.raw
  modified_base (251)..(274): a, c, t, g, unknown or other
  misc_feature (251)..(274): n is a, c, g, or t
tcagcgagagataccacgaccggtgctcgatttagctctacgctcagggtcttcgtggctcacgtccaccaccacgcatgtgacctcaggggtccgggagatcatgagggtgtccttggggttttggggggaagaggaagactgaccggtccccccgaggagttcaggtgctgggcacagcggccctgggctgcctggtcaaggactacttccgtatctctcgctgagcgggctggacaaggcgcagtagnnnnnnnnnnnnnnnnnnnnnnnn

SEQ ID NO: 249258 - DNA, 911 bp, Homo sapiens
  misc_feature: GYAE6OF01EMYEJ.11.73.G07.1.454.CMB.1.raw
tcagcgagagataccacgaccggtgctcgatttagctctacgctcagggggcaggagtcagtcccaaccaggacacagcatggacatgagggtccctgctcagctccgtggggctcctgctgctctgtctctcgaggtcgccagatggtagactactccgtagttaccgaccctacgtcctacctaccttccccgttcccgttcgttcctacgtactaacgttacgtaaggtaagggaacgacgaacggtaccgtaccacctactaccgttaccgtaccggaccggacgggaccgtagtacggaacgtaacttaaagttaaacgttaaacttttaaagtttaaggttaggtacgtacggaaccgacggaccggaaccgggaaccgggtaacccgtcccggtacggtccgtaccgttaccgtacgtaccgttacggtacgtacgttaccgtaccgttaaacgttaacggttaaccggaaacgtaccggtaacccggtacccggtaacggtacggtacggtagggtaacggtaggtacggtacgtacggtacggtaacttacgttactttaccgtacctaccttaaccgacgtaccgacgtacccgtacgggtaccccaggacccgtaacggttaccgaaagggttaaaccgttagtttaaccgttaacctaaactaaacgttttaacgttttaccgttaacgttaaccggttaaaacctaaggttagtttaaccgtttcgtaccccgtttacctttaaccccgttacgtttaaacccgggtttacccgggtacccccggtaacgggaaaccgggtaaccggttaagggttacggttaaaaccgaaaccggttaaagggttaaacccgggtaacgttttacgggacgggttaacccgtcgtaccccgtaaacg

SEQ ID NO: 249259 - DNA, 746 bp, Homo sapiens
  misc_feature: GYAE6OF01EMZ5L.11.73.G07.1.454.CMB.1.raw
  modified_base (200)..(200): a, c, t, g, unknown or other
  misc_feature (200)..(200): n is a, c, g, or t
  modified_base (315)..(315): a, c, t, g, unknown or other
  misc_feature (315)..(315): n is a, c, g, or t
tcagcgagagataccacgaccggtgctcgatttagctctacgctcagggggcaggagtcagtcccaaccaggacacagcatggacatggagggtccctgctcagctcctgggctcctgctgctctgtctctcaggtcgccagatgtgacatcctagttcgaccagtcctccactcctcctgtctgctatcgtagtagganacgagctacacctatctacgtcgaccgaggacgtacgtacgaagtactaaagttaacgtaaactttaagtttaagtgtacgtcggaactaggccgaacggaacggaaccgtccgngaccgtcctcgtatactcgagtctcgtacttacgtaacgtaacggaacacggtaccgtaccgtaacggttaggtaacggtaggtacgggtaagtcggtaacgttacgggtacggtaactaaccggtttacttacccggtactaacccgtaaccgtaacgtaccgtacggtaccgtaccgttaccgtaccgtaaccggtaaccgtaccggttaaagttaacggtaactttaacgtacggtaaacctaactttaacggtaactttacgtaagtaaccctaaaggttctaaacggttccttactttacccgtaccttacccgtttaaacggtacccggtttacccggtaaccggttacggtaaccggtaggtacggaaacgttaacggtaaagtaaccgtaaacggttcggtaccggtctacgtcccgtaaacg

SEQ ID NO: 249260 - DNA, 767 bp, Homo sapiens
  misc_feature: GYAE6OF01AN4Q5.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttcgccaggcgagtcaggactaattaaagaacttaatttaaattggtagtcggctagccgaccgaagggaacgccccgtgacgtcctcctgactctacgatcgccgtacctaagtttaggaaaacacggtaccggtaccccgtaaccggtacggttacgacggttagggaacggttcggtaacgtacggtaggggtaacctaacggttaccttttaactcctaccaacccgtacttccgaacgactaccgtaccctcggacctaacggtcccgtaagggaaacgttaacgttactttacggaacctaaacctaatttaaccgtttaacctacggttaaccctaaacggttaacgttacggtttaacgttaacccgttaccggttacccttaccccggttaaccctttaaccgggtttacccccgggtaccccgggttaaccggggtaaacccgtaaccgggtaaggttaacccgggtaaacgttaaacccgggttaacggtaaaaacccggtaacggtttaaccgggacgggttacccgttaccggtaaacccccgg

SEQ ID NO: 249261 - DNA, 755 bp, Homo sapiens
  misc_feature: GYAE6OF01EGWWM.11.73.G07.1.454.CMB.1.raw
tcagcgagagataccacgaccggtgctcgatttagctctacgctcagggggcaggagtcagtcccaaccaggacacagcatggacatgagggtccctgctcagctccgtggggctcctgctgctctgtctctcaggtcgccagattggtagactactaccaggttcgaaccctgttcctccacttcccttccctgtctgctagtactaagtaggacacaagtactaccacctatcctaccgttcgaccgagggcgtacgtacgaacggaactaaacgttaaacgtaaacttttaagtttaaagtttgggtaactccgggacgaacgaccggaacggaacgggtaacccgcccgtaggcgtccttaccgtagacttacgtacgtacttcgtaccgttaaccgttaggttaacggaaacgtacggaccgttaccccgaaggttaggttcgaaggggtagtaacgggttggtacgttacggtacgggaactttacggttaacctttctacccgtaccaactactcgaacgccgtaactcccggtacgaccgttacgtacgtaaggtaacgtattacgtctaacgtaacttagttactacggtactaaacctacggttaagtacgttacgttaaccgttccgttaccttacgttaaccggtttccggtaccccgggtccggttaacggacgtacgggacgtaaccggtaattaacgggtaaaccgtaaggttaccgttgggaacgttccgccgtaaccg

SEQ ID NO: 249262 - DNA, 834 bp, Homo sapiens
  misc_feature: GYAE6OF01EPYXM.11.73.G07.1.454.CMB.1.raw
  modified_base (193)..(193): a, c, t, g, unknown or other
  misc_feature (193)..(193): n is a, c, g, or t
  modified_base (305)..(305): a, c, t, g, unknown or other
  misc_feature (305)..(305): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacgagatcaacatcacttgccaggcgagtcaaggacaattaagtaacttaatttaaaagttggtatcggacacgacgaccgaacggaacgcccctagacgtctcctagtacnttccgaacgtatacggttcgtaaccagtttacgggaaaaccaggtacggttccccaaacggttcgggttaactagggtaggtaacggtagggaacttccggtacgggtaaccgtaacggttaacctttttaacccgtaccttacccgtaaccccttaacgttacccgaacggtaccgtaacccggtaccccgttacgacccgtaacggaccccgtttaagggaaaacgttaaactttaacgtttaacggtaacccgtaaaaccgtttaaactttaaacgttttaaaccgttaaccggttaaccctaaaaaccgggttaaagtttaacgtttaaccggttaacgtttacccgttaaccccgttttacccgttaacccgttaaacccggtttttacccccgggggtacccccgtttacggggtaaacccccggtaaaggttacgggttaaaccgggtaaaccgttacggtaaaaaccggtaaaacccggtaaacccggtttacggggttaccgggtaccggttaacccggg

SEQ ID NO: 249263 - DNA, 901 bp, Homo sapiens
  misc_feature: GYAE6OF01A31DV.11.73.G07.1.454.CMB.1.raw
  modified_base (661)..(661): a, c, t, g, unknown or other
  misc_feature (661)..(661): n is a, c, g, or t
tcagcgagagataccacgaccggtgctcgatttagctctacgctcagggggcaggagtcagtcccaaccaggacacagcatggacatgagggtccctgctcagctccgtggggctcctgctgctctgtctctcaggtgccagattgtagacatcctagttcgaccctagtcctccctacttcccttccctcgtctcgactacttactaagtagggacgaacgagtacgtaccaacctaacttccgttaaccgttccggacccggacggggaccggtaacggttaccgaaacgggtaaacctaaagttttaaaaacggttaaaacgtttttaaaagttttttaaaaggtttaggggtttaaacgttaccggggtaacgaaaccgggaacccgggaaaccccgggtaaaacgggggtaaaacccgtcccccgttaggtaacccggtcccgttaccttacggttaccttaccggtaacgttacgttaccgtaccgttaaccgttaaaaggtttaacggaaaaccgtaacgggtaacccggttaaccccgtaaccggttagggttacggtaagggttaaggggtaacggtacgggtaacgtacgggtacgggtaaccgtacgtttaacctttaccgttaccctacctacccgttatacccgtaanacccgtaccggtccgacggaccgtaccgaccggttaagtaaacgttacttacgtacgtaacctaaacgttattaaccgtttacgaaccgttaacctaagttacgtaattcgttaacgttaccttacccttaccgttaccctttacccgggtttacccgtaccggggtaacgtaccggaaggttacggagtaaaccgtagttaaaccgggtaacgtacggttacggttcgcgttcgacccg

SEQ ID NO: 249264 - DNA, 621 bp, Homo sapiens
  misc_feature: GYAE6OF01EQWV8.11.73.G07.1.454.CMB.1.raw
  modified_base (193)..(193): a, c, t, g, unknown or other
  misc_feature (193)..(193): n is a, c, g, or t
  modified_base (332)..(332): a, c, t, g, unknown or other
  misc_feature (332)..(332): n is a, c, g, or t
  modified_base (383)..(383): a, c, t, g, unknown or other
  misc_feature (383)..(383): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatccacttgccaggcagtacaaggactaattaagtaacttaatttaaaattggtatcggacagccgaaccgagggaaacgcccctagacgtctcctagactactacgatgccgtacaattaggaaacngacgtccacgtagttcagttgggaagtgatcgtgggaactagtacctttanctacacgattcagctagcctagctacgtaccgtagaacgtataagtttacgacctaaataatttaacttacgtacgtaacgaaaccgttgttaagtcgtaacttccggttaccttaccctaagttaaccgtttcccgggaccccgttacggggaacccgtaaggtaggtaccggtaaccctaaacggtaacggtaaaacccggttaacggttagggttacggaccgtctaaaccccgg

SEQ ID NO: 249265 - DNA, 693 bp, Homo sapiens
  misc_feature: GYAE6OF01AEKOS.11.73.G07.1.454.CMB.1.raw
  modified_base (212)..(212): a, c, t, g, unknown or other
  misc_feature (212)..(212): n is a, c, g, or t
  modified_base (419)..(419): a, c, t, g, unknown or other
  misc_feature (419)..(419): n is a, c, g, or t
  modified_base (680)..(680): a, c, t, g, unknown or other
  misc_feature (680)..(680): n is a, c, g, or t
tcagcgagagataccacgaccggtgctcgatttagctctacgctcagggggcaggagtcagtcccaaccaggacacatcatggacatgagggtccctgctcagctcctggggctcctgctgctctgtctctcaggtgccaggatggtgacactcctagttcgaccctagtcctacccacttccctccctgtcctgctactctaagtaggganacgagacgtccacctatctacgttcgccgaggcggtagtacgaaggtacttaagttaaacgtaactttaattttaaggttaggtacgtcggggactaacggacccggtaaccgtaacgggggaaccctcccccgtagggtaactcccttaccctagtacgttacctaacggtactcggtaccgtaacttaaggttaacgggaaaccncggtaccggtaccccgagttaggtacgtagggtaggaagttggacgttaggacggtactagttacctttacgctaactacgcacgacgctaccgtctcggactacgctaagaatctactagaactaagtattaacttgtaacaacgtaactgttacgacttacgtaccgttacccttaccgttacgtaccggtttcccggacgttaccggataacggttacggcaaacgtaccgtaaacgaaacggttactacgggttacncccgtggtaaccc

SEQ ID NO: 249266 - DNA, 779 bp, Homo sapiens
  misc_feature: GYAE6OF01DM7RD.11.73.G07.1.454.CMB.1.raw
  modified_base (146)..(146): a, c, t, g, unknown or other
  misc_feature (146)..(146): n is a, c, g, or t
  modified_base (204)..(204): a, c, t, g, unknown or other
  misc_feature (204)..(204): n is a, c, g, or t
  modified_base (772)..(772): a, c, t, g, unknown or other
  misc_feature (772)..(772): n is a, c, g, or t
tcagcgagagataccacgaccggtgctcgatttagctctacgctcagggggcaggagtcagtcccaaccaggacacagcatggacatgaggtccctgctcagctcctgggctcctgctgctctgtctctcaggtcgccagatggtnacactcctagttcgacccagtcctcactccctccctgtctgctattactagtaggganacaaggtactaccacctatacctacgtcgaccgagggcgtagtccgaaggtacctaagtttaaacgaactttaaagttttaaacgttcgggttaacgttccggacgacggaaccgaccggtaacggggaaaccgtcccccgttaggaaccgtccttaccgtacggtacttaccggttaagacgttcggtaccgttaacgttaacgtttaacggaaactaacggtacccggtaccccgtaacgggttaacggtttaccgagggttacggtaaacggttcggaacgttacggtacgggtacccgtaaggtttaccctttaccttaccgttaccaaccgtactacggaccgtaacgacccgtaccgttgaaccgtggtacccgtaaggtaaacgactttaacgtacggtaactaacgttaattacgttaacttccgtacgtaaacgtagttacgtcgtaacgtttaccgtcccgttaccttaacgtacccggttacccgccggttacggaaacgttaggtacggtacgaaactacggtaaaccgtaaacggtactcgggttcgaaccggtntaccccg

SEQ ID NO: 249267 - DNA, 784 bp, Homo sapiens
  misc_feature: GYAE6OF01A1NN1.11.73.G07.1.454.CMB.1.raw
  modified_base (198)..(198): a, c, t, g, unknown or other
  misc_feature (198)..(198): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacactccagttcgacccagtcctccactcctccctgtctgcatctatagganacagagtccaccatccacttcgccgaggcgagtcgaaggactaagttaacgaacttaatttaaagttgtatcggcagccgacgaacggaacgcccgtgacgcctcctagtactaccgtacgtacgtcgccgtaccttaaagtttacggaaacgtacggtaccggtaccccgtaaccggtacggttaccgtaaggtagggtaaggtcggtaacgttcgttacgggggaaccttaacggtttaacccttttaccgtacccttaacccgtaacccgtacgttacccgaaacgtcccgtaaccggtccccgttacggaaccctaacgggttaccccgtaaggtaaacggttacgtttacgttaacggtaaccctaaacgttacttaaccgtttacgttaccggtaaacctaaacgttaggtttaacgttaacggtaccttacccggttaccctttaccgttaccgttaaacccggttttcccgggaccccgggttaacgggtaacccgtaaggtacggtaccggtaactaaacgggttaacggtaaaaccggtacgtttaccggggacggtaccgttaccggtaaccccg

SEQ ID NO: 249268 - DNA, 848 bp, Homo sapiens
  misc_feature: GYAE6OF01AJI8Z.11.73.G07.1.454.CMB.1.raw
  modified_base (186)..(186): a, c, t, g, unknown or other
  misc_feature (186)..(186): n is a, c, g, or t
  modified_base (211)..(211): a, c, t, g, unknown or other
  misc_feature (211)..(211): n is a, c, g, or t
tcagcgagagataccacgaccggtgctcgatttagctctacgctcagggggcaggagtcagtcccaaccaggacacagcatggacatgagggtccctgctcagctccgtggggctcctgctgctctgtctctcgaggtcgccagatgtgacactcctagttcgaccagtcctccacttccctcctntctacgctatctagtacgagacgancgtaccactactctacttgacccggtagggacgtaggtacgaacggtaactaacttaaacggttaaacttttaaagttttaaaggttttagggtaacgtacgggtaccgaacgggaccggaaaccgggaaaccggggtaaacccggtccccggtaggtaacccggttcctaccgttacgtaaccgttaccgtaaccggttacgtacggttacccgttaaacggttaaacgttaaccgggaaaacggtaccgggtaaccggtaccccggtaacgggttacgggttaacggtacggggtacggtaagggtacggtaacggtaccggtacgggtaacgttaaccgttaccgttacctacgtacctaacgtacgtccgaaggtaccgaccgtacgacgtaacgacggtacctaaggtaacgttactaggttaacctaaccttaacttaacggttaacctttaacgttaccgtaaaccgttaaggttaactacgttaacgttcccttacgggttacccttacggttaacccgtttacgttacccgggtaccgggtaccgggttaaccggaagggttaccgggaacttaacggttaaccggtaacggttaaaccggacgtttacggcgtacgtaaccctaacg

SEQ ID NO: 249269 - DNA, 757 bp, Homo sapiens
  misc_feature: GYAE6OF01ARLL8.11.73.G07.1.454.CMB.1.raw
  modified_base (639)..(639): a, c, t, g, unknown or other
  misc_feature (639)..(639): n is a, c, g, or t
  modified_base (738)..(738): a, c, t, g, unknown or other
  misc_feature (738)..(738): n is a, c, g, or t
tcagcgagagataccacgaccggtgctcgatttagctctacgctcgagggggcaggagtcagtcccaaccaggacacagcatggacatggacgggtccctgctcagctccgtggggctcctgctgctctgtctctcgaggtcgccagtatgtacgactacttccgtagttacgaccctagttcctcctacttcccttccctggttctcgtacctacttacgtaacggtagggaactaacgtacggacgttaccaacctaattccgtaccgttcggaccggacggggtccgtacgttacgaacggtaatttaaacgttaaacggttaaacgtttaaaagttttaacgttaggttacgttaccggagtaccgggtaccggaaaccggtaacgggtaaacccgtccccgttgggacctaccttccggtagtactacctacggtatacgacgttacgttaagttaacggaacgtacgtaccggtaccgtaacggtacggtagaacggttaggacgttagggtaccgttacggtacgggtacttacgttaaccttacgtacctacgaccttagacgccgacgtcggacccgtgacgtaccgaacgtacgtaagcttactacgaacttaagttactacttgtaanactagtactagttgacttcgtaccgttcctacggtaccgttacccggtcggaaccggtacttagggacgtcgtaacgttacggtaacgtaacgggttangggttctaaccggtctacg

SEQ ID NO: 249270 - DNA, 810 bp, Homo sapiens
  misc_feature: GYAE6OF01A0ECH.11.73.G07.1.454.CMB.1.raw
  modified_base (138)..(138): a, c, t, g, unknown or other
  misc_feature (138)..(138): n is a, c, g, or t
tcagcgagagataccacgaccggtgctcgatttagctctacgctcagggggcaggagtcagtcccaaccaggacacagcatggacatgaggtccctgctcagctccgtgggctcctgctgctctgtctctcgaggtcnccagtactgtcgacacttaccgtagttccgaccctagttcctacctacttcccgttcccgtgtctacgctaactacgtaggtacggaagaacaggtaccgtccaacctactaccgtaccgttcgaccgacggacgtacgtacggaacggtaactaagttaaacgtaaacttttaaagtttaagttcggtacgtaccggtacgaaccggaccggaaacccggtaacgggaacccggtcccgtaggtaccgttcccgtaccgttacggacttaccgtaacgtaccgttacgacccgtttaaaccgttaacgttaacggaaaccggtaccggtacccggtaacccgtacggtaacgggttaggtaacggggtacgtaagggtacggtacggttaccgggacggtaacgttaccgttaaactttccctactaccacgtacgtaccgacgcctacgtaccgttacgaccgtacgaacgttacgtaagtttactagtaccgaaacttaactactttaaagttccgtaacgtaactaagttacgttacgttaaccgtaccgtttcgttacccctttaaccgtaccggttaccggtaccccggtaccgggttaagaccgtacggtacggtaacgtaacgaacgttaacggaaccgttcgtaaggtcaccggtactacccg

SEQ ID NO: 249271 - DNA, 793 bp, Homo sapiens
  misc_feature: GYAE6OF01A3TVY.11.73.G07.1.454.CMB.1.raw
  modified_base (167)..(167): a, c, t, g, unknown or other
  misc_feature (167)..(167): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcnccactccctcctgtctgcattctataggagacgagagtcacctatcctacttcgccgaggcgagtaccgaaggtaactaagttaaacgtaactttaattttaaagttaggttaactccggacgacgaccggtaaccggaaacgggaaaccgcccccgtgtacggtaccttccgtagaacttccgtaacggtaacgttcgtacccgttaaccgttaaaggttttaaaccgggaaacgtacggaacccggttaaccccggtaccggtaagggttaccgaagggtaggtaaggtaggtacgtacggtaggggaactaacggttaacctttacctacgttaccaaccgtattaccggaacgtaccgacgtcccgtacgacccgtaacggtacccgtaagggtaaactaacgtttacgtaacgtaaccgtaaactaactttacgttactaacgtttaacaaacggtagtttaacgtacgttacgttaccgttacccgttacccttaacggttacccgtttaccccgggaacccggttacgggtaaaccccggttaagggacgggtttaaccggaacgttaacgtaaacggttaaaccggacgttcgggtaccggtaccgtcggtaaccccg

SEQ ID NO: 249272 - DNA, 788 bp, Homo sapiens
  misc_feature: GYAE6OF01AO0JW.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgctatctaataggagactagagtaccaaccatccacttcgcccgaagggcgaacgtcgaaggaacctaagtttaaacgaaactttaattttaaaagttaggtacgttacggaccaggaccgaaccgaaaggggaaaacgcccccgttagaccgtccttaccgtacgaacttaccgtaccggaatcggacccgttaccgtaaagtttaacggaaaaccgacgggtaaccggttacccccgaaacggttacgggtttaacgaacgggttaagggaaacggttacgggtaacgtccggtaggggtaactaacggttaaccttttaaccgtactaccaaccgtacttacgaacgtcaacggtccctaacggaccaggtaccctaaggtaaacgtaacttaacgttacgaactaaacctttaagttaactttaacccgttaagtaaccctaaacgaagtttaacgttaccgtagtttacccgttaccttaaccgttaccggtaaactttttaccccggggaccggttacggggaaacccgtaaggtacgggtaaacgtaacctaacggaaacgttaaaccggtaacgtaggttaacggccgtacgtaaccccg

SEQ ID NO: 249273 - DNA, 766 bp, Homo sapiens
  misc_feature: GYAE6OF01BMCFN.11.73.G07.1.454.CMB.1.raw
  modified_base (735)..(735): a, c, t, g, unknown or other
  misc_feature (735)..(735): n is a, c, g, or t
tcagcgagagataccacgaccggtgctcgatttagctctacgctcgagggggcacggagtcagtcccaaccaggacacacgcaatggacatgacgggtccctgctcagctcctgggctcctgctgctctgtctctcgaggtcaccagtagtggtacgactactaccgtacgttcgaaccctagtcctacctacttccccttccttacggttcctcgtcctaacgttccgttaacgaacggtaacgtacgaacgtaccgttaccaacccgtaacttaccgtaccgtttccggaccgtacggtacgtaacgtaccgaaggtaacttaaacggttaaaacgtaaacgtttaaagtttaaaagtttcggttaacgtacggacgtaacggaaccgaacgaaacggggtaaccctcccggtacgacgttcgttaccgtagtaccgttaccgtacgacgttacgtaaccgttaacgttaaggtttaaaccggaaacgttacggtacccggtaccgtacggtaacggtacgttaaggtaagggtaagtcggtacgtacggtagggtactaacgttaaccgttactactaccgactactacgaggtacacgggtactcgtacgacgtacgtagtagtaactacgttacgattaacacttagttacgtactaacatacggtaattacgtactacgtcttacgtgttaccttccgggacgtacgtacgagtacgacgtaacgtaanaaaccgtacggtctaacgtcgacgtcgtacg

SEQ ID NO: 249274 - DNA, 904 bp, Homo sapiens
  misc_feature: GYAE6OF01CJK7G.11.73.G07.1.454.CMB.1.raw
  modified_base (145)..(145): a, c, t, g, unknown or other
  misc_feature (145)..(145): n is a, c, g, or t
tcagcgagagataccacgaccggtgctcgatttagctctacgctcagggggcaggagtcagtcccaaccaggacacagcatggacatgacgggtccctgctcagctccgtggggctcctgctgctctgtctctcgaggtcgcagntggtacgactactccgtacgttaccgacccctacgtcctacccacttcccctccgttcggtcctcgtctactacgtaagtacggacgaacgaggtacttaccaactacttacctaccgttcggaccggtacggaccggtacggtaaccgaacggtaaccttaaagttaaaacgttaacgtttaaagttttaaaggttacggtacgtccggaccgtaacggaccggaaccgggtaaagggaacccgttaccgtacggtaccggtacctaccgtagtaaccgtacgttacggtacgtacggtaaccttaccgttaaacgttaacggaaacggtacggaaccggtacccgtaacggtaacggttacgtaaggtaggtaacgtcgggtaactcgggtaacgtacgtaactttacgttaccgacctacgtaaccctataccggaacgtaccgaccggttcaggttaacccgtaccgtggtaaaccggaatttacggacctaataacccggtaaatttgggtaaaccttaccggtaacgtaaccgttaacgtaaaggtttccgtaacgttaacccgttcggttaaccccgttcgttaaacccgggtttacggttaccccccgggagggttaacccggggtaacccttaaagggggtaaccccggtttacgggaaaaccggtttaaacccgggaaaaaccggttttaaccgggaacgggttttcccccggggtaaacgtttcccggggtaaaccgtttaaaccccg

SEQ ID NO: 249275 - DNA, 722 bp, Homo sapiens
  misc_feature: GYAE6OF01DHC7A.11.73.G07.1.454.CMB.1.raw
tcagcgagagataccacgaccggtgctcgatttagctctacgctcgagggggcaggagtcagtcccaaccaggacacagcatggacatgagggtccctgctcagctccgtggggcctcctgctgctctgtcctctcgaggtgccagagtgtagacatccctagttcgaaccctagtcctcccgtactcccttccgtgtctcgactactcgtaagtaggaagacgagtacgtccacgtactcgtactcggaccgtaggacgtaacgtacgaaggtaaactaagttaaaacgtaactttaaagttttaaacggttggtacgtacgggacgaccggaccgtaaccggacggaaccgcccgtagacgtcctacgtcgtactacgtagtgacgtaccgtaacgtaagttaacgaacggtcggaccgtcccgtaaggtagttacgagggttacggagtacggacgttcggacggtacgtacgtttacttcgacctacgaaccgtcgtacgacgacgtaccgtccgtcgaacgacgtacgtagtaactaacgtactacgtaaccgttaactacgttacttacgtacgtaactaagtagtagtacgttacgttaccgttacctaccgttaccgttacccgggtaccggtaccgtaacgggtacgtaggtacggtaacgtacgtaacggttaaccgtaacggttaacgtggtaacccggtgtcccgtaacg

SEQ ID NO: 249276 - DNA, 118 bp, Homo sapiens
  misc_feature: GYAE6OF01DR2YM.11.73.G07.1.454.CMB.1.raw
  modified_base (116)..(118): a, c, t, g, unknown or other
  misc_feature (116)..(118): n is a, c, g, or t
tcagcgagagataccacgaccggtgctcgatttagctctacgctcgagggggcaggagtcagtcccaacaggacacagcatggacatgagggtccctgctcagctccgtgggctcnnn

SEQ ID NO: 249277 - DNA, 712 bp, Homo sapiens
  misc_feature: GYAE6OF01C6D94.11.73.G07.1.454.CMB.1.raw
  modified_base (136)..(136): a, c, t, g, unknown or other
  misc_feature (136)..(136): n is a, c, g, or t
  modified_base (146)..(146): a, c, t, g, unknown or other
  misc_feature (146)..(146): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtnccagatggtnacatccagttcgacccagtctccatccctccctgtctgcatctagtaggacgacagctaccaccatctacgtgccgtacggcgagtcgaaggtaactaattaacgtaaacttaaactttaaggttgtacgtacggcaacggacgaaccgaaggggaaacnccccgtagacgtcctccgtagacttccgtacgntcggtaccgtaccgtaagttaacggaaacgtcgtaccggtcctaaccggtagtaccgaggtagtaaggtcggtacgtcggtacgggactaacgttactttaccgtctaccgactactgaaccgcgaaccgtcgtacgaccgtaacgtccctaagggtaacctaagttacgtacgaaacttaacgtaacgttttaaccttacgtacggttaacaacgtaaggttactacgttacgttacccttaccgttaacccgttaccgtttaacccggtcccccgggtacgttacgggtaaacccgtggtaacggtaaaccggtactaaaccgtaaacgttaaaaccggtaccgtagggtttacccgcgtaccgtaaaccg

SEQ ID NO: 249278 - DNA, 645 bp, Homo sapiens
  misc_feature: GYAE6OF01BEPX2.11.73.G07.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
  modified_base (632)..(632): a, c, t, g, unknown or other
  misc_feature (632)..(632): n is a, c, g, or t
  modified_base (639)..(639): a, c, t, g, unknown or other
  misc_feature (639)..(639): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgcagatgtgacatcctagttgaccctagtcctccatccctccctgtctgcatctagtagganacagacgtcaccatctactcgccaggcgagtcaggactaattaaagtaacttaatttaaagttggtacgtcggcaggaccgaacgaagggaacncgaccgtagacgtcctccgtgactcgtacgagtcgtacgttacctaagtttacggaaaccgtacggtaccggtaccccgaacgggtacggttacgagggtagggtacggtaggtacgtacggtacgggtaactacgttacctttactcgtacctacctatcgacgtacacgtccgtagacgacgtaccgtagaagtattactacgaacctaactaattaacgtttagtaacgtaactaacgtaagtacttgtaaccgttccgttacctaccgttacttaccggttacccggtacggtacggaccgtaggacgtacgaacgtaaggtacgaaacgttacgnggttcgngtaccg

SEQ ID NO: 249279 - DNA, 555 bp, Homo sapiens
  misc_feature: GYAE6OF01EF4WE.11.73.G07.1.454.CMB.1.raw
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (322)..(322): a, c, t, g, unknown or other
  misc_feature (322)..(322): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctagcatctanagganacagagtcaccatcacttgccaggcgagtcaaggacaattaaagaactaatttaaatggtatcggcagcgaaccgagggaaacgcccctaggacgctcctagactctacgatgacgtacaattgaacngacggtcccagagtcaggtgaagtggatcgtagggactagtactttacgtctacgacatcaagcacgtcctagccagccctagaagtatatgactaatacttagtactgtacaacgtagtagtgtatccgtactacctactaaccgtttccggacccgtagggaaccctaggtacgtcgggaaactaggttaaccgaaaccggtaacttgggtacggtccttgggtaaacccc

SEQ ID NO: 249280 - DNA, 777 bp, Homo sapiens
  misc_feature: GYAE6OF01CMBQE.11.73.G07.1.454.CMB.1.raw
  modified_base (222)..(222): a, c, t, g, unknown or other
  misc_feature (222)..(222): n is a, c, g, or t
tcagcgagagataccacgaccggtgctcgatttagctctacgctcgaggggggcaggagtcacgtcccaaccaggacacagcatggacatggacgggtccctgctcagcctccgtggggcctctgctgctctgtctctcgaggtcgaccagatggtacgacacgtccgtagttacgaccctagtcctccactcccgtcctagtctgctatcgtagtacgganacgacgtacgtccactcgtcacgtcgaccggaggcgtagtcgaacgtactaaattaagtaacttaagtttaaagttcggtacgtcggacgtacgaccggtaacggtaacgggaacccgcccgtaggactcctacgtagtaccgtacggtacacgttcgtaccgttaacgtaaggtaccggaaacgtaccggttaccggtacccggtaacggttacggttaggtaaggtacgggtaacggtggtacgtacgggttacggaacgttaacgtttcccttaacaccgtacacgtacgtacgacgcgtacgtcgtacggaccgacgtacggaactaagtactacgtacgtaactaaccggttataccgtttagaacgtaactacgtacgttagtaccgttaccgttaccgtaccgttaacgtttacccggttaccgggttaccccggaaccgggggtttacccaaacggggttccgttaacgggtacccggttaaaaccgttaaagggtacccgggttaaaaccgggtcttccggggtacttaaccccgccgttaaaccg

SEQ ID NO: 249281 - DNA, 712 bp, Homo sapiens
  misc_feature: GYAE6OF01A78D0.11.73.G07.1.454.CMB.1.raw
  modified_base (427)..(427): a, c, t, g, unknown or other
  misc_feature (427)..(427): n is a, c, g, or t
tcagcgagagataccacgaccggtgctcgatttagctctacgctcagggggcaggagtcagtccccaaccaggacacagcatggacatgagggtccctgctcagctcctgggctcctgctgctctgtctctcaggtgccagatgtagtacatccagttcgaccctagtcctccactccctcctgtctgctatctagtaggagaccaggactcacatcactgccaggcagtcaggtactattaaagtaacttaatttaagttggtatcgactagaccgtaaccgaacgggaaccgccccgtaggactccgtacgtagactactagtacgtcgtaccgtactaagttacggaagacggtacggtacccacggtagttacgagtaggagtagtactacggtaggactacgtactttacgcctacaacctntaccgagtacaccgtactacggaccaacgtacctaagggaactagttacgttaccgaacttaaactacgtttaacgttacgtactaaccgaacgttacggttacgtacgttaaccgtttaccgttaccccttaaccggttacgtttacccgttacccggggtaaccgttaccggggtaaacccggtaaggggttacggtaaaccccggtaaagttaacggttaaaaccgggtaaaacccgttacgggtttaggggtcccggttaaccgtaaccggtaacccccgg

SEQ ID NO: 249282 - DNA, 779 bp, Homo sapiens
  misc_feature: GYAE6OF01D2CB8.11.73.G07.1.454.CMB.1.raw
  modified_base (165)..(165): a, c, t, g, unknown or other
  misc_feature (165)..(165): n is a, c, g, or t
tcagcgagagataccacgaccggtgctcgatttagctctacgctcagggggcaggagtcagtcccaaccaggacacagcatggacatgagggtccctgctcagctcctggggctctgctgctctgtctctcaggtcgaccagatgtgacatcctagttcgacccngtcctccatcctccctgtctgactatactaagtacggagtacgagtagtccaaccattacctacgttcgaccgaggcgtagtaccgaaggtaactaagttaaacgtaacgtttaagttttaaacgttaggttacgtccgggacgacggtaccggaaccggaacgggtaaacccggtccccttagggaccgttcccgttaccgtaggtaaccttccggtaaacgtcgttaccggtaaccgttaaccgttaaaggtttaacggggaaaactccgggtaacccgggtacccgaaccgggttaaggttaccgtaggggtaacgggtaaggttcgggtaacgtccgggtaagggtaccgtaacggtttaccttaccgttaccacgtaaccttaactccgaacgtaccgaaccgtcgttcgaactacgtaaccgtagtaacgtattacgtaacgacctaaacgtaactttacgttaacacgttacctaaagttcgttatacgtaccgttcgttacccttaaccttacgttaaccggtccccggtacgtaacggtaacggagttaccggtaacgaagttacgtaaaacgggtacgtacgttacgggactcgtccgtaaccg

SEQ ID NO: 249283 - DNA, 989 bp, Homo sapiens
  misc_feature: GYAE6OF01BXL3N.11.73.G07.1.454.CMB.1.raw
  modified_base (143)..(143): a, c, t, g, unknown or other
  misc_feature (143)..(143): n is a, c, g, or t
  modified_base (148)..(148): a, c, t, g, unknown or other
  misc_feature (148)..(148): n is a, c, g, or t
tcagcgagagataccacgaccggtgctcgatttagctctacgctcagggggcaggagtcagtcccaaccaggacacagcatggacatgagggtcccctgctcacgctcccgtggggcctcctgctgctctgtctctcgaggtnccagntcgtgacactcgagtcgacccagtcctccactcctcctgtctgccatacgtagtaggacgacaagtacgtacctaaccacttacccgaccgttacgaccggtagggtacccgtaaggtaccgaaaggtaaccgttaaaaagttaaaacgttaaaaaccgttttaaagtttttaaaaacggttttacgggttaaccgttaccgggggaccgtaaccgggtaaacccgggtaccccgggtaaaaaccggggggtaaacccggttacccccccgttaggggtaaaccggttccccttacccggttaacggtactttaacccggttaccggttaagttacccggttacccggttaaaacccgtttaaaacggttttaacccgggaaaaacggtaccgggtaaacccggggttacccccgtaaccgggtttaacggggttaaccgttaacgggttagggaacgggttaacgtacggttacggggtaaccggtaacgttaaccgttaaccgttttacctacccgtaccgtaacccgtacgttaaccaacgggtacccgtacgtccccgtaacggaccgtaccgtaacccggtaggtaaaacgttacctaagtttaccgtaaaccgaaacgtttaatttacgttttaaaccgtacggaaaccgtaacgtaagttacgttacggttaccgttacccgttaccgttaaccccgttagggttaaccccgtttcccggtaaccgggtcccggtaaacccgggttagggtaaccgtaacggggtaacgttaaaaacccgggttaccggaaacgtttaccgggtaacggtcggtacccgttaaccggaaccccg

SEQ ID NO: 249284 - DNA, 876 bp, Homo sapiens
  misc_feature: GYAE6OF01BEZC6.11.73.G07.1.454.CMB.1.raw
  modified_base (137)..(137): a, c, t, g, unknown or other
  misc_feature (137)..(137): n is a, c, g, or t
  modified_base (187)..(187): a, c, t, g, unknown or other
  misc_feature (187)..(187): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtnccagatgtgacatccagttcgacccagtctccatccctccctgtcctgcntactagtaggagaccagacgtcaccatcacttcggcctagggcgacgtacgacggactaagttaaacgtaaactttaagtttaaagtttcgggtaacgttccggacgtacggaccggaaccggaacgggggaaacccgtcccccgtaggtaccgtacccgtaccgtcggtacttccgtacggtacgtccggttaccgtaaccgttaagttaacggaaaacgtaccggtaaccggtacccgaccggtaggttaccgtaggtagggtaggtaggacgtcggtacggtagtaccgttaccgtttactcctacctacctaacgtccgtaacggcctaacccggtccgttacgtacggaaccggtcccttaagggtaaacggttacgtttaacgtacccggtaaaccttaaacgttaacgttttaacccgtttaaaccgttaccggttaacccgttaaacggtttaacggttaacggtttaccggttaaaccgtttccccgttttacccgttaaccccggttttaacccgtttaaacccggggttttcccccggggtaaaccccgggtttaccgggtaaacccgggtacggggtttaaaccggtccggttaaaaccggtaaaaccgttaacccggggtaaaaccgttaacccggggttttcgtacccggggtaccgtttacccggtaaaccccg

SEQ ID NO: 249285 - DNA, 681 bp, Homo sapiens
  misc_feature: GYAE6OF01B77YF.11.73.G07.1.454.CMB.1.raw
  modified_base (202)..(202): a, c, t, g, unknown or other
  misc_feature (202)..(202): n is a, c, g, or t
  modified_base (675)..(675): a, c, t, g, unknown or other
  misc_feature (675)..(675): n is a, c, g, or t
tcagcgagagataccacgaccggtgctcgatttagctctacgctcgagggggcaggagtcagtcccaaccaggacacagcatggacatgagggtccctgctcagctcctggggctcctgctgctctgtctctcaggtgccagatgtgacatccagttcgacccagtcctcccatccctccctgtctgctatactataggganacagacgtccaccatcactcgccgaggcgagtcgaagaactaagttaaagtaaactttaatttaaaagttaggtacgtccggacgaacggaccggaaccggaaacggggaaaccgtacccccgtagaccgtcctccgtagtactccgtacgtacgtcgtaccgttaacctaaagttacggaaactacggtaccggtacccacggtagtacgaggttaggaaggtagacgtacggtacggtaacgtacgttacctttacgtcctaccgaccgtaactaccgaacgccgtaacgtcccgtcgacgacgtaccgtaagaagtaacgtttagtacgaactaacttaacttactaacgtacgtaaccaagttacggttagtacgtacttcccgtaccttaccgttacctacgggttcccggacccgtacgggtaacgaggtacggtacgactaaacgtacgtaaacgcgttagcgtcncgtacc

SEQ ID NO: 249286 - DNA, 677 bp, Homo sapiens
  misc_feature: GYAE6OF01B4CFL.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatcctagttcgaacccagtcctccactccctccctgtctgctatacgtagtaaggagacagactcaccactctacgttcgaccgaggcgtagtacgaaggtactaattaacgtaactttaagtttaagtggtactacggcaacggcggaaccggaacgggaacctcccgtgacgtcctactagactacacgatcgtacgtacctaagttacgaaacgtgaccggtaccgacggtagtacgaggtaggaacggtgtacgtcggtacggtagtaacgttacttactacctacgacacgtaccgagtacgacgtacccgtcgacgtaccgactaggtaacgtacgtttaagtagtaacctaaacgttaattaaaccgtttactaacgttaactaaagttaacgttaacgtacgttaccttcgttaccccttacctaaccggttacccggttacccgtacccggtacggtaccggtaacgtcggtaacgaccgtaagtaacgtaaacggacgttaggtcgtacgtcgtaaccc

SEQ ID NO: 249287 - DNA, 565 bp, Homo sapiens
  misc_feature: GYAE6OF01ED53L.11.73.G07.1.454.CMB.1.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
  modified_base (561)..(561): a, c, t, g, unknown or other
  misc_feature (561)..(561): n is a, c, g, or t
tcagcgagagataccacgaccggtgctcgatttagctctacgctcgaggggggcaggagtcagtcccaaccaggacacagcatggacatgagggtccctgctcagctcctggggctcctgctgctctgtctctcgaggtcgccagtatgtgactatccagttcgacccagtcctccactcctccgtntctgactatctaagtagganacagactccacatctactgaccgaggcgagtacgaaggactaagttaagtaacttaatttaagttggtactcggacagaccgacgaacgggaaccgccctaggactcgtccgtagacttacgtaatcgtcggtacgttaccgtaaaggtttacggaaacgacggtaccggtacccgaacggttaggtacgaggtagggagtggatacggaggactatacttcnctacacatcagnacgctcgcagccagtaactnttatcgactactattatcgatacatagtagctatcgtactctctacgtcggcctaggtacgacggtagtacgacgtagacgtaactcgtggtacgcgtnaccg

SEQ ID NO: 249288 - DNA, 653 bp, Homo sapiens
  misc_feature: GYAE6OF01BXJWN.11.73.G07.1.454.CMB.1.raw
  modified_base (146)..(146): a, c, t, g, unknown or other
  misc_feature (146)..(146): n is a, c, g, or t
  modified_base (156)..(156): a, c, t, g, unknown or other
  misc_feature (156)..(156): n is a, c, g, or t
  modified_base (474)..(474): a, c, t, g, unknown or other
  misc_feature (474)..(474): n is a, c, g, or t
tcagcgagagataccacgaccggtgctcgatttagctctacgctcgagggggcaggagtcagtcccaaccaggacacagcatggacatggagggtccctgctcagctccgtggggcctcctgctcgcttctgtctctcgagggtcnccagatgtanacactccgtagttccacccgtagtcctccacgttccctcctgtcctgctatctaagaggagtacaagtctaccactactacgtcgtacgccggaggacgtagtacgaaggtataaacgttaagtaactttaatttaaggtggttacgacggacgacggacggaaccgaacgggtaaccgtcccgtgacgtccttacgtatactacgtacgactccgtacgtacgtaaagttacggaaacgtcggtaccgaccggtaggtacggtagacgtagggacgtaggtactacggtacggacttacgttaccttactcacgtanactacgacacgtacgtcacgacgatacgaagtagtactagtactactactattacctgtacgacagtatctagtcttacgtactaccgttcgttaacggtcccggtacgtacggtacggacggtagtacggtaacgtaaggtacgtaaacgggtccttagggccttcggccgtaaaccg

SEQ ID NO: 249289 - DNA, 745 bp, Homo sapiens
  misc_feature: GYAE6OF01EZ4IM.11.73.G07.1.454.CMB.1.raw
  modified_base (125)..(125): a, c, t, g, unknown or other
  misc_feature (125)..(125): n is a, c, g, or t
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
tcagcgagagataccacgaccggtgctcgatttagctctacgctcagggggcaggagtcagtcccaaccaggacacagcatggacatgagggtccctgctcagctccgtggggctcctgctgctntgtctctcgaggtgccagatgtgacattccgagttcgaccctagtcctccacttcctccctgtctgcatctagtaggagacagctacacctatcctacgttcgaccgaggcgtacgacgaaggtactaagttaaagtaacttaatttaagttggtancggacagaccgaacgaacgggtaaccncccgtaggacgtccgtaccgtagtactaccgtagtactcggccgttaacgtaaggttaacggaaaccgtcggtaaccgtacccggtaaccggttaggtcgaacgggttagggtaaggtacggtacgttacggtacgggaaccttaacgtttaaccgttttacccgaccttaccgtaacctacgtaccgtacggtaccacggtccttacgacgtacgttaccgaagtaacgttaactttacgttacgaaacctaactttaacgttacgtttaacgtagtaacccgttaagtaaggtttagtaccggttacctttaccggttacctttacccgtacgtttacccggtttacccgccgggtaacggtaccgtagggtacgtacgggtaaactacggtaaaccggtaacgttacggtaccggtacggtccgcgtaacccg

SEQ ID NO: 249290 - DNA, 911 bp, Homo sapiens
  misc_feature: GYAE6OF01EC3WN.11.73.G07.1.454.CMB.1.raw
tcagcgagagataccacgaccggtgctcgatttagctctacgctcagggggcaggagtcagtcccaaccaggacacagcatggacatgagggtccctgctcagctccgtgggctcctgctgctctgtctctcgaggtcgccagtatggtagacactccgagttcgaccctagtcctccacttccctccttgtctgctatctaagtaggagacagtacgtaccacctactccgtaccttcgccgacgggtacgacgtacgaacgtacttaaagttaacgtaaactttaacgtttaaaagtttcgggtaacgttcggaacgacggtaccggaacccggtaaacggggaacccgtccccggtaaggaccgttacccgttaccggtacgtaccgttaccgttacgtacgtacggttaccttaaccggttaaacggtttacggaaaccgtacggtacccggtaaccccggtacgggttacgggttacgtaacgggtagggtaaacggtagggttaccggtaccgggtaaacgggtaaccgtttacggtttaaccgtttacccgttacctaacccgttaccctacgttaaccgcggttccaaccgtttaccgcggaccctaacggttcccgtaaaggtttaaacgtcttttaaacgtaacaacccgtttaaatacgttttaacttaaccggtacgtaacttaaaccggttaacgtttacgttaaccgttccggtttaacccgttacctttaaacccgggtttacccgtttaaaccccggggtttccccgggaaccccgggtttaccggggaaaccgtttagggaacccgggtttaaactaacgggttaaacccggttaaacgggaaaccccggtttacgggtcggggtttaccaccccgggttacctaaaccccggg

SEQ ID NO: 249291 - DNA, 741 bp, Homo sapiens
  misc_feature: GYAE6OF01D00BG.11.73.G07.1.454.CMB.1.raw
  modified_base (392)..(392): a, c, t, g, unknown or other
  misc_feature (392)..(392): n is a, c, g, or t
  modified_base (424)..(424): a, c, t, g, unknown or other
  misc_feature (424)..(424): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttcgacccagtcctcatccctcctgtctgctatctaagtaggagaccaggaccgttacacctactctacttcggaccgaaggcgaacgtcaacgggaactaattaaagtaaacgttaattttaaaacgttagggttactaccggacgacgtacggaaccgtaaggggaaaccgtcccctaggaacgcctaccgtcggtaactcctaacggacttcgacggtacctaagttacggaaacnggtacgtaccacggtagtcacggtgacggttnatcggtaggactacggtactttactcgtactacgtaactaccgaagctaacggtccctacggtacgtaccgtaccggtaagaagtaaaccgttgtttacggaaacctacctaaacggttttacttaaccgtacggttaaccaaacgttacggtttaagtacggttaacttccggttaccctacctttaccggtaaaccggtttccccggggaacccgttaccggggtaacccggtaaaaggttcccgggtaaacggaaacctaaggttaaccggtaaaacgggtaaccttgggttacccgtccggtaggtaaacccc

SEQ ID NO: 249292 - DNA, 747 bp, Homo sapiens
  misc_feature: GYAE6OF01EOZF5.11.73.G07.1.454.CMB.1.raw
  modified_base (163)..(163): a, c, t, g, unknown or other
  misc_feature (163)..(163): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttcgacccgngtcctaccattccctcctgtctgcatctagtaggagacagacgtaccactatctacgttcgaccgagggaccgtaagtaccgaaggaacctaaagtttaaaacgtaacgtttaaagttttaaaacgtttgggtaacgttacggacggtaacgaccggaaccggaaacggggaaaccgtcccccgtaggacgtacccttacgtgactaccgtacgtatcgtaccgttaccttaaggttaacggaaactcggtacggtaccccgaggttacggtacgacggttaggacggtagtacgtcgtacgggactacggttacctttacacctacaccacgtcgagtaccacgtccctacggacaacgtccgtaagtaacgtaattactacggtaaacctaacgtaatttaacctaacgtaacgtaactaaccgtagtacgttacttaccgtaccgtacctttaccgttaaccgttaaaccggtttcccgggacccggtttaaggggaccgttaaggggacgtacgggaaaccgttaacggtaaacccggttaacggtaacggttagggtaccgtccggtaccgtaacccgg

SEQ ID NO: 249293 - DNA, 849 bp, Homo sapiens
  misc_feature: GYAE6OF01BI7VC.11.73.G07.1.454.CMB.1.raw
tcagcgagagataccacgaccggtgctcgatttagctctacgctcgagggggcaggagtcagtcccaaccaggacacagcatggacatgagggtccctgctcagctccgtggggctcctgctgctctgtctctcaggtcgccagattcgtcgactactccgtacgtttccgaacccgtagtcctacctacttccccttcccgtgtccgtgctacttacgtaagtacgggaacgacgtacggtacgtacccaacctacgtaccgtaccttccggaccgtaggggaccgtagtaccgaaggactaaagtttaaacgtaactttaaagtttaaacgttgggtacctacgggcgtaacggaccggaaccggaaacgggtaaaccgtccccggtaggaccgttccgtaccgtagtactacgtaacgtctcggtacgtaacctaagttaacggaacgtacgaccggtaccacgggtagttcgaggtaggaaggtgtagtcggtaggactacgttacttcccgtactaccgaacctatccgaacgtccgtcgtacccgtacggaccgttaaaccggccgtttaaaggtagttaaacgttacgttaccggaaacctttaaacgtttaacgttaacgtttaaccgtaacgttaaccgtaaaaccgtttaacgggttttagttaccgttaaccccgttttacggttacccctttacccgttaaacgggttttaccccgggtacccggttaacccgggtaaccggtacgggttaacccgggttagggttcccgtaaaaacgtaaggggtaaacccggtaaccgtttagggttaaccgtcggtaaccttcccgggtaaacc

SEQ ID NO: 249294 - DNA, 703 bp, Homo sapiens
  misc_feature: GYAE6OF01B5B0R.11.73.G07.1.454.CMB.1.raw
  modified_base (197)..(197): a, c, t, g, unknown or other
  misc_feature (197)..(197): n is a, c, g, or t
  modified_base (438)..(438): a, c, t, g, unknown or other
  misc_feature (438)..(438): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctccctgtctgcatctataggaganagacgtcacctatcacttgccaggcgagtcgaaggactaagttaaagtaacttaatttaaagttggtactacgggcagaccgaaccgaagggaaaccgccccgtaggaacgtctccgtagtactaccgtacgactcggtaccgtaccctaaagtttacggaaaacgacggaccggtaccctacggtaggttcgaaggtagggtaacgtcggtacgtcggtagggacctagttacctttacncgttaccaccgtatacgaacgaccctacggtccctacgaccgtacggtacccgtaaggaacttacgttacttacggaacctaaacgtaattttaaaccgtttaacgttagtaacccgtaaattacggtttaatacgttaacgttccgttacccgttacctaccgtttaaccggtttcccgggacccgttaccggggaaccgttaggacggttacgaaccgtaagtaaaccgaacggttacgttaggccgtaacgtcggtaacccg

SEQ ID NO: 249295 - DNA, 907 bp, Homo sapiens
  misc_feature: GYAE6OF01CV7QO.11.73.G07.1.454.CMB.1.raw
  modified_base (102)..(102): a, c, t, g, unknown or other
  misc_feature (102)..(102): n is a, c, g, or t
  modified_base (276)..(276): a, c, t, g, unknown or other
  misc_feature (276)..(276): n is a, c, g, or t
tcagcgagagataccacgaccggtgctcgatttagctctacgctcagggggcaggagtcagtcccaaccaggacacagcatggacatggagggtccctgctnagctccgtgggctcctgctgctctgtcctctcgagggtcgaccagtattggtacaactacttccgtaagttccgaacccagttcctaccacttccccttcccgttgtcttacgctatacgtaagtaacggacgaaccgaagtccgtaccacctactcctaacgttccggaccgnggtaccgtagtccgaaaggtaacttaaattaaacggttaaactttaagttttaaaaggttcggtacgtaccggacgtacggaaccggaaccggaaccggggtaaacccgtccccggttagaccgtcccgttaccgtacgtaaccgtacgtaaaccgtggtttacccggaccgtttaaccgttaaaaggttaacgggaaacccgtacggtaccccggttaccccgtaacgggttacggttacggtaagggttaacgggtaggtaacgggtccgttaacgggtacggtaacgtaaccgtttaccctttaaccgtccgtaaccctacgtacgtaacccggacgtaccggtaccgtcccggtaacgttccgtaacgggaaccgttaggtaaacgtttacgttacgtaacgaaccttaactaacgtttacgttaaacgttccgtaacttaaacggttacgttaattcccgggttaaaccctttcgtttccttaacccggttaccgtttaaccccgggttcccgggtaacccggttacccggaaacggttaggtaaccccggtaaagtaaccgttaaacggtaaccggggtttaaaaccgtcggtttaccgggttaccgtcggtcccgtaaaccccg

SEQ ID NO: 249296 - DNA, 683 bp, Homo sapiens
  misc_feature: GYAE6OF01DN7CI.11.73.G07.1.454.CMB.1.raw
  modified_base (136)..(136): a, c, t, g, unknown or other
  misc_feature (136)..(136): n is a, c, g, or t
  modified_base (676)..(676): a, c, t, g, unknown or other
  misc_feature (676)..(676): n is a, c, g, or t
tcagcgagagataccacgaccggtgctcgatttagctctacgctcagggggcaggagtcagtcccaaccaggacacagcatggacatgaggtccctgctcagctcctggggctctgctgctctgtctctcgaggtnaccagatgtcgacatccagttcgaccctagtcctccactccctcctcgtctgactatctaagtaggagacgagtactacacctactctacgttcgaccgaggacgtagtacgaaggaactaagttaaacgtaacttaatttaaagttacggtacgtacggacgacggaccgtaaccggaacgggaacctccccgtaggaactccgttaccgtagtaactaccgtacgagtccgtaccgttaacgtaagttaacggaacgtacggtaaccggtacccgtaacggtacgggttacgacgggtaggtaaggtaggtacgtacggtacgggaacttacggttactttaccgtactacctaaccgtactaccgacgtcgaccgtctacgacgtacgtagtaagtagtactacgtactaacgtaatacttaacgttacacgtaactaagtagtactacgtacttcgtccttaccgtaacgttacccggtccgtaccggtacggaacctaggtacgtacgaactaggtaacgtaacgtagtgtacgntacgacc

SEQ ID NO: 249297 - DNA, 680 bp, Homo sapiens
  misc_feature: GYAE6OF01EMLUS.11.73.G07.1.454.CMB.1.raw
  modified_base (328)..(328): a, c, t, g, unknown or other
  misc_feature (328)..(328): n is a, c, g, or t
  modified_base (420)..(420): a, c, t, g, unknown or other
  misc_feature (420)..(420): n is a, c, g, or t
  modified_base (571)..(571): a, c, t, g, unknown or other
  misc_feature (571)..(571): n is a, c, g, or t
  modified_base (582)..(582): a, c, t, g, unknown or other
  misc_feature (582)..(582): n is a, c, g, or t
tcagcgagagataccacgaccggtgctcgatttagctctacgctcgagggggcaggagtcagtcccaaccaggacacagcatggacatggagggtccctgctcagcctccgtggggctcctgctgctctgtctcgtcgaggtcgaccagatcggtgactactcccagttaccgaacccgtattcctacccacttcccttcccttgtctcgactattacgtaagtaggaacgaacgaagtagtaccaacctatcctaacgttcgaccgaggacgtagacaggaactaagttaaaagtaaactttaatttaaagttaggtacgtacgganacggaccgaaaccgaagggaaacccgccctaggactccgttacctgtaactcgtaacgtatcgaccgtaaccttaaagttaacgggaaaacncggtaacggtaccccgagggtacgtagacggtagaagggtacggtatcgtagggaaccttagttaccttactactactactaacgtcgaacgccacgacccgtgaccaagtaccgtaagtaatacttagtacactaaactattacttaacntaaccgaagtntatacgtactcgtactaccttgtaaccgttccgtaccgtaacgggtctaagggacgtagaacttaagtaaccggaaatcggtaagtcgacgtcgaacc

SEQ ID NO: 249298 - DNA, 732 bp, Homo sapiens
  misc_feature: GYAE6OF01AD0W3.11.73.G07.1.454.CMB.1.raw
  modified_base (710)..(710): a, c, t, g, unknown or other
  misc_feature (710)..(710): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacactccagttcgacccagtcctccacttccctcctgtctgctatcgtataggagacagtacgtccactactctacgttcgaccgagggcgtagtcgaaggaactaagtttaaagtaaactttaaagttttaaagttagggttaacgtcggacgaacgaccggaaccggaacgggaaaccgcccccgtaggaccgtccttccgtagtacgttacctaacggtactacggaccgttaaccgttaaacggtttacgggaaaactacggggtaacccggtacccccggtaaccggttagggtttaccgaaggggttacggtaaggtacgggtattacgggtacggtacgtaacgttaccgtttacgtacctacctaccgtactacgacggtaccgaccggttctacgacgtacgtaccgtaaggtaattacttagtacgaaccttaacgtatttaacgttactacgttaacaacgttaagttactagtaccttcgtaccttaccgttacgttaccgttcccggtaccgacggtaccgtaaggtggacctacgtaaagaccggtaaacnggttaggacgttcgctaacccg

SEQ ID NO: 249299 - DNA, 487 bp, Homo sapiens
  misc_feature: GYAE6OF02H1VT0.11.73.G07.1.454.CMB.1.raw
  modified_base (478)..(478): a, c, t, g, unknown or other
  misc_feature (478)..(478): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgacaacataattactgtacaaacagtatgtattcgtctcctcaatttccggccctgggaccagagtggacagtagaaacgactgnggtctgacc

SEQ ID NO: 249300 - DNA, 479 bp, Homo sapiens
  misc_feature: GYAE6OF02GM0H7.11.73.G07.1.454.CMB.1.raw
  modified_base (429)..(429): a, c, t, g, unknown or other
  misc_feature (429)..(429): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtacaacagtatgatcgtctctnaatttcgcctgggaccagagtggacatagaaacgtaactgtaggctgacc

SEQ ID NO: 249301 - DNA, 486 bp, Homo sapiens
  misc_feature: GYAE6OF02G8W9B.11.73.G07.1.454.CMB.1.raw
  modified_base (313)..(313): a, c, t, g, unknown or other
  misc_feature (313)..(313): n is a, c, g, or t
  modified_base (402)..(402): a, c, t, g, unknown or other
  misc_feature (402)..(402): n is a, c, g, or t
tcagcgagagataccacgaccggtgctcgatttagctctacgctcagggggtcgaggagtcagtcccaaccaggacacagcatggacatgagggtcctgctcagctcctgggctcctgctgctctgtctctcaggtgccagatgtgacatccagttgacccagtctccatcctcctgtctgcatctataggacgacagagtcaccaatcgacttgccaggcgagtcaggacattaagaactattaaattggtatcggcagcgaccagggaaagcccctgagctcctgatctacgatgcgtcaatttggaaacngagtccacgaggttcagtgaagtggatctgggacagactttacgctcacatcagcagcctgcagcctgaagatattgcaacatattacngtacaacagtatgattcgtctcctcaactttcggccctgggacccaggtacgtcggacatcgaaacgtactaggtcggctgacc

SEQ ID NO: 249302 - DNA, 493 bp, Homo sapiens
  misc_feature: GYAE6OF02JCEAJ.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctggatctacgatgcgtccaatttggaaacagaggtcccaccgaggttcagtggaagtggatctgggacagactttacgtctcaccatcagcagcctgcagccctgaacgatattgcaaacatattactgtacaacagtatgattcgtctcctctaatttcggcctagggcctagagtggacagtacgaaacgtactggtaggctgaccc

SEQ ID NO: 249303 - DNA, 468 bp, Homo sapiens
  misc_feature: GYAE6OF02GNHRR.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttggaaacagagtcccacgagttcagtgaagtgatctgggacagactttactctcacatcagcagcctgcagcctgaagatattgcaacatattactgtcaacagtatgatcgtctctcaatttcggcctgggaccagagtggacatgaacgactggtgctgacc

SEQ ID NO: 249304 - DNA, 622 bp, Homo sapiens
  misc_feature: GYAE6OF02JI0S7.11.73.G07.1.454.CMB.1.raw
  modified_base (254)..(254): a, c, t, g, unknown or other
  misc_feature (254)..(254): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttgacccagtctccatcctcctgtctgcatctataggagacagagtcaccatcacttgccaggcgagtcaggacattaagaactattaaattggtatcggnagcgacagggaagcccctgagctcctgatctacgatgcgtccaattggaacagagtcccacgaggttcagtgaagtggatcgtgggacaggtactttacgtctcacagtcagcagcctgccagcctaggaaacgtatacgttagaccaaactaattacgttaacctaggttacctaaaacgtacggtttaaattcggtaaatttcccggttaccgttacccctttaccgttaaacgtttttcccgggaccccgtttaccgggggtaaccccttaaggtaacgggtttaaccgggaaccgttaaacggttaacgggtaaaaccggtaaccgttaacggggtttaccgggtaccgttacggtaaccccgg

SEQ ID NO: 249305 - DNA, 276 bp, Homo sapiens
  misc_feature: GYAE6OF02HJHJG.11.73.G07.1.454.CMB.1.raw
  modified_base (251)..(258): a, c, t, g, unknown or other
  misc_feature (251)..(258): n is a, c, g, or t
  modified_base (260)..(276): a, c, t, g, unknown or other
  misc_feature (260)..(276): n is a, c, g, or t
tcagcgagagataccacgaccggtgctcgatttagctctacgctcgagggttcgttcgtggctcacgtccaccaccacgccatgtgacctcaggggtccgggagatcatgagggtgtccgttgggttttgggggaagaggaagactgacggtcccccaggagttcaggtgctgggcacagcggccctgggcctgcctggtcaaggactacgttccgtatctctcgctgagcgggctggcaaggcgcatagnnnnnnnnannnnnnnnnnnnnnnnn

SEQ ID NO: 249306 - DNA, 246 bp, Homo sapiens
  misc_feature: GYAE6OF02GWGCF.11.73.G07.1.454.CMB.1.raw
  modified_base (244)..(246): a, c, t, g, unknown or other
  misc_feature (244)..(246): n is a, c, g, or t
tcagcgagagataccacgaccggtgctcgatttagctctacgctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccgtatctctcgctgagcgggctggcaaggcgcatagnnn

SEQ ID NO: 249307 - DNA, 486 bp, Homo sapiens
  misc_feature: GYAE6OF02HUWPZ.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttggaaacagaggtcccacgaggttcagtggaagtggatcgtgggacagtactttactctcaccatcagcagcctgcagcctgaagatattgacaacatattactgtacaacagtatgatcgtctctctaatttcggcctggaccaggtacgtggacagtacgaacgtactggtagtctgacc

SEQ ID NO: 249308 - DNA, 477 bp, Homo sapiens
  misc_feature: GYAE6OF02G65CF.11.73.G07.1.454.CMB.1.raw
  modified_base (359)..(359): a, c, t, g, unknown or other
  misc_feature (359)..(359): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccacgagttcagtggaagtggatctgggacagactttacnctcaccatcagcagcctgcagcctgaagatattgacaacatattactgtacaacagtatgatcgtctcctcatttcgcctgggaccagtagtgacatacgaacgactgtcggctgacc

SEQ ID NO: 249309 - DNA, 479 bp, Homo sapiens
  misc_feature: GYAE6OF02G5UJ7.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagccctgcagccctgaagatattgcaacatattactgtacaacagtatgatcgtctctctaatttcgcctgggaccagagtggacatagaacgatggtggctgacc

SEQ ID NO: 249310 - DNA, 499 bp, Homo sapiens
  misc_feature: GYAE6OF02I070Y.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatcgtgggacagactttactctcaccatcagcagcctgcagcctagaagatattgcaacatattactgtacaacagtatgatcgtctcctctaatttccggccctgggacccaggtacgtggacagtacggaaacgtaacgttggtcggtctgtacc

SEQ ID NO: 249311 - DNA, 531 bp, Homo sapiens
  misc_feature: GYAE6OF02HYXSN.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatggcagcgaccagggaaagcccctgacgctcctgatctacgatgcgtccaatttggaaacagaggtcccaccgaggttcagtggaagtggatcgtgggacagtactttactctcaccatcagcagcctgcacgcctagaacgtatattcgactaaactataactttactagtaccaactaagttatgtatccgttctcccgtactaactttccggcccttcggggaaccaggtacggtggactaagtacggaaacgaacgttggtacggcctgtacccg

SEQ ID NO: 249312 - DNA, 485 bp, Homo sapiens
  misc_feature: GYAE6OF02GMXHS.11.73.G07.1.454.CMB.1.raw
  modified_base (360)..(360): a, c, t, g, unknown or other
  misc_feature (360)..(360): n is a, c, g, or t
  modified_base (414)..(414): a, c, t, g, unknown or other
  misc_feature (414)..(414): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccacgaggttcagtggaagtggatctgggacagactttacnctcaccatcagcagcctgcagccctgaagatattgcaacatattactgtacaanagtatgatcgtctcctcaatttcgccctagggaccagagtggacagtagaaacgaactggtaggctgtacc

SEQ ID NO: 249313 - DNA, 483 bp, Homo sapiens
  misc_feature: GYAE6OF02HLRWM.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtcaatttggaaacagaggtcccacgagttcagtggaagtggatcgtgggacagtactttactctcacatcagcagcctgcagcctagaagatatgacaacatattactgtacaacagtatgatcgtctcctctattcgcctgggaccaggtacgtggacagtacgaaacgacgtgtcggctgacc

SEQ ID NO: 249314 - DNA, 484 bp, Homo sapiens
  misc_feature: GYAE6OF02JE9TK.11.73.G07.1.454.CMB.1.raw
  modified_base (270)..(270): a, c, t, g, unknown or other
  misc_feature (270)..(270): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattgtatcggcagcgaccagggaaancccctgagctcctgatctacgatgcgtccaatttggaaacagagtcccacgaggttcagtggaagtggatctgggacagactttactctcaccatcagcagcctgcagcctgaagatattagcaacatattactgtacaacagtatgattcgtctctctattccgcctgggaccaggtgtaggactagtagaacgtaactggtggactgtaccg

SEQ ID NO: 249315 - DNA, 516 bp, Homo sapiens
  misc_feature: GYAE6OF02ISFJ0.11.73.G07.1.454.CMB.1.raw
  modified_base (193)..(193): a, c, t, g, unknown or other
  misc_feature (193)..(193): n is a, c, g, or t
  modified_base (361)..(361): a, c, t, g, unknown or other
  misc_feature (361)..(361): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcagtcaggacattaagaactattaattgtatcggcagcgaccagggaaacgcccctgacgctctgatctacgatgcgtacctaatttaggaaacagacggtacccacgagttcagtggaagtggatcgtggacagtactttacnctcaccatcagcagctgcagctagaagtatatagcaacataattactagtacaacagttatagtatcgttactcctataacgttccggaccgttacgggacctaggtagtcggaactaagtacggaaacgtacgtacggtggtacctggtaaccc

SEQ ID NO: 249316 - DNA, 519 bp, Homo sapiens
  misc_feature: GYAE6OF02I7NQ2.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaagcccctgagctcctggactctacgatgcgtccaatttggaaacagaggtcccacgagttcagtggaagtggatgtgggacagactttactctcaccatcagcagcctgcagcctgaacgtatattgacaacatattactgtacaacagttatgtattccgtcttcctactaactttccgggaccctcggggaacctaggtaaggtcggaactagtacggaaaccgtacgtggtacggtcctaggtaccc

SEQ ID NO: 249317 - DNA, 493 bp, Homo sapiens
  misc_feature: GYAE6OF02FQN4B.11.73.G07.1.454.CMB.1.raw
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacataagaactatttaaatggtatcggcagcgaccaggaaagcccctgagctcctgatctacgatgcgtccaatttggaaacngaggtcccacgaggttcaggtggaagtggatcgtgggacagactttacnctcaccatcagcagcctgcagcctgaagatattgacaactatattactgtacaacagtatgaatcgtctcctctaatttccggacctgggacccaggacgtggactagtacgaaaccgtactggtaggctgacc

SEQ ID NO: 249318 - DNA, 472 bp, Homo sapiens
  misc_feature: GYAE6OF02HHPDK.11.73.G07.1.454.CMB.1.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaattggtatcggcagcgaccagggaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtntcctnattcgcctggaccagagtcgacatacgaacgactggtggctgac

SEQ ID NO: 249319 - DNA, 536 bp, Homo sapiens
  misc_feature: GYAE6OF02INOY0.11.73.G07.1.454.CMB.1.raw
  modified_base (429)..(429): a, c, t, g, unknown or other
  misc_feature (429)..(429): n is a, c, g, or t
  modified_base (488)..(488): a, c, t, g, unknown or other
  misc_feature (488)..(488): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttgacccagtctccatcctccctgtctgcatctataggagacagagtcaccatcacttgccaggcgagtcaggacattaagaactattaaattggtatcgcagcgaccgagggaaacgcccctgacgctcctgactctacgatcgcgtacctaatttacggaaacagacggtcccgaaccggtaggttacaggtggaagtggatcgtgggaacagtactttactctcacctatacagcacgcctagcagcctagaatatatgactaacatacttangttacaactagtatagtacttcgtactctactaacgtttccggaccgttacgggaaccnggtaaggtcggaactagtacgaaacggtactaggtacggtactgaacc

SEQ ID NO: 249320 - DNA, 478 bp, Homo sapiens
  misc_feature: GYAE6OF02FT8K9.11.73.G07.1.454.CMB.1.raw
  modified_base (356)..(356): a, c, t, g, unknown or other
  misc_feature (356)..(356): n is a, c, g, or t
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccaggaaagcccctgagctcctgatctacgatgcgtccaatttggaaacagagtccaccgagttcagtggaagtggatctgggacagactttacnctcaccatcagcagcctgcagcctgaagatattgcaacatattactgtacaacagtatgatcgtctcctcaatttcgccctgggccagacgtggacagtagaacgaactggtcggctgaccg

SEQ ID NO: 249321 - DNA, 248 bp, Homo sapiens
  misc_feature: GYAE6OF02GNTX6.11.73.G07.1.454.CMB.1.raw
  modified_base (246)..(248): a, c, t, g, unknown or other
  misc_feature (246)..(248): n is a, c, g, or t
tcagcgagagataccacgaccggtgctcgatttagctctacgctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccgtatctctcgctgagcgggctggcaaggcgcatagnnn

SEQ ID NO: 249322 - DNA, 491 bp, Homo sapiens
  misc_feature: GYAE6OF02FTFYT.11.73.G07.1.454.CMB.1.raw
  modified_base (313)..(313): a, c, t, g, unknown or other
  misc_feature (313)..(313): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacngaggtccacgaggttcagtggaagtggatctgggacagactttactctcaccatcagcagcctgcagcctgaagatattgcaacatattactgtacaacagtatgtatcgtctcctactaactttcggccctagggacccagacgtggacagtacgaacgtactggtggtactgaccg

SEQ ID NO: 249323 - DNA, 514 bp, Homo sapiens
  misc_feature: GYAE6OF02JCCWL.11.73.G07.1.454.CMB.1.raw
  modified_base (254)..(254): a, c, t, g, unknown or other
  misc_feature (254)..(254): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (498)..(498): a, c, t, g, unknown or other
  misc_feature (498)..(498): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttgacccagtctccatcctcctgtctgcatctataggagacagagtcaccatcacttgccaggcgagtcagacattaagaactattaaattgtatcggtanagcgacagggtaaagcccctgacgctcctgatctacgatagcgtacagtttggaaacngacggtccacgaggttcagtggaagtggtatcgtgggaacngtaacgtttacncttacgaccatcagtcngacctgcagcctgaagtntaattgacacgaattatacttagtactaanacgtatgactacgtctcgtactagtttccgccttgggaacctagcgtaggactagtacgaaacgtacnggtacgtgtagtaccg

SEQ ID NO: 249324 - DNA, 494 bp, Homo sapiens
  misc_feature: GYAE6OF02HU7LD.11.73.G07.1.454.CMB.1.raw
  modified_base (356)..(356): a, c, t, g, unknown or other
  misc_feature (356)..(356): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcagtcaggacattaagaactatttaaattggtatcggcagcgaccagggaaagcccctgagctcctgatctacgatgcgtccaatttggaaacagagtccacgaggttcagtggaagtggatctgggacagactttacnctcacatcagcagcctgcagcctagaagattatcgacaactataatttatgtacaacagtaatagtattcgtctcctactaactttcggccctgggacctaggacgtggacatacgaaacgactggtacggtctgacc

SEQ ID NO: 249325 - DNA, 496 bp, Homo sapiens
  misc_feature: GYAE6OF02GT5ER.11.73.G07.1.454.CMB.1.raw
  modified_base (194)..(194): a, c, t, g, unknown or other
  misc_feature (194)..(194): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactatttaaattggtatcggcagcgaccagggaaagcccctgagctcctgatctacgatgcgtccaatttggaaacagaggtcccacgaggttcagtggaagtggatcgtgggacagtactttactctcaccatcagcagcctgcagcctgaagatatgacaacatattactgtacaatagtatgattcgtctcctactaatttccgccctgggaccaggtacgtggactagtacgtaaacgaacgtggtcggctgaccc

SEQ ID NO: 249326 - DNA, 548 bp, Homo sapiens
  misc_feature: GYAE6OF02GAPV3.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgacagggaacgccctgagctcctgatctacgatgcgtccaatttggaaacagacgtcccacgagtcaggtggaagtggatcgtgggacagtactttacgctcaccatcagcagcctgcagcctagaagtacttattacgacctaaactattaacgttaacttacgtaacaaacgtagttagtagtacttacgtaccttcccttactaaccgtttccggaccccgttaggggaacctaggtacggttaggacctaagtaacgaaacggtaacgtggtcggtactcgacc

SEQ ID NO: 249327 - DNA, 491 bp, Homo sapiens
  misc_feature: GYAE6OF02I9YD9.11.73.G07.1.454.CMB.1.raw
  modified_base (193)..(193): a, c, t, g, unknown or other
  misc_feature (193)..(193): n is a, c, g, or t
  modified_base (294)..(294): a, c, t, g, unknown or other
  misc_feature (294)..(294): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcgagtcaggacattaagaactatttaaattggtatcggcagtcgaccagggaaagcccctgagctcctgatctacgntgcgtcaatttggaaacagagtcccacgaggttcagtggaagtgatcgtggacagtactttactactcaccatcagcagcctgcagccctgaagtatattgacaactagtattactgtacaatagtatgatcgtctcctatacttcgcctggccagtagtcgactagtacggaacgtacgtgtcggtctaggtaccc

SEQ ID NO: 249328 - DNA, 507 bp, Homo sapiens
  misc_feature: GYAE6OF02HQMEN.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgacgctcctgatctacgatgcgtcaatttggaaacagacggtcccacgaggttcagtggaagtggatcgtgggacagtactttactctacaccatcagcagcctgcagcctagaagatattgaccaacattaacttactgtacaactagtatgatcgtctcctctaacttccggccttgggaccaggacgtaggactaagtacgaaacggaactgggtacgtcgtagacc

SEQ ID NO: 249329 - DNA, 494 bp, Homo sapiens
  misc_feature: GYAE6OF02IAJSD.11.73.G07.1.454.CMB.1.raw
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagccccctgagctcctgatctacgatgcgtccaatttggaaacagaggtacccaccgaggttacagtggaagtggatcgtggacagactttactctcacatcagcagcctgcagctagaagatattgacaactatattacttgtacaacagtatgatcgtctcctctaactttccggccctgggaccagagtggacagtcgaaacgagttggnggtcngtaccc

SEQ ID NO: 249330 - DNA, 538 bp, Homo sapiens
  misc_feature: GYAE6OF02GPMLO.11.73.G07.1.454.CMB.1.raw
  modified_base (406)..(406): a, c, t, g, unknown or other
  misc_feature (406)..(406): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgacagggaacgccctgagctcctgatctacgatgcgtacctaagtttaggaaacaggacggtacccaccggtaggttcaggtggtaagtggatcgtgggacagtactttactctcacatcagcacgtcctgcacgccgtagaagtntagttgacaactattattactagtacaactagtatagtacttccgtacttcctactacgtttccggcccgtacgggaaccaaggtcggtaggaactaggtacgaaacggtacgtcggtggtactgtaacccg

SEQ ID NO: 249331 - DNA, 486 bp, Homo sapiens
  misc_feature: GYAE6OF02FVGJR.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaagcccctgagctcctgatctacgatgcgtccaatttggaaacagaggtcccacgaggttcaggtggaagtggatctgggacaggacttttactctcaccatcagcagcctgcagcctagaagatattgacaacatattactgtacaacagtatgatcgtctcctctaatttcgcctgggaccagacgtgacagtacgaacgacgtgtcggtctgacc

SEQ ID NO: 249332 - DNA, 520 bp, Homo sapiens
  misc_feature: GYAE6OF02F3D4O.11.73.G07.1.454.CMB.1.raw
  modified_base (432)..(432): a, c, t, g, unknown or other
  misc_feature (432)..(432): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaacgcccctgagctcctgatctacgatgcgtccaatttggaaacagacggtcccacggaggttcagtggaagtggatcgtgggacagacttttactcgtcaccatcagcagcctagcagcctagaagtactattgaccaatataattactgtacaacagttangtatcgtacttcctacttacgtttccggacccgtgggacccaggaggtacgactaagtacggaaaccgtaagtcggtggactgtaccc

SEQ ID NO: 249333 - DNA, 531 bp, Homo sapiens
  misc_feature: GYAE6OF02F3057.11.73.G07.1.454.CMB.1.raw
  modified_base (361)..(361): a, c, t, g, unknown or other
  misc_feature (361)..(361): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctcctgtctgcatctataggagacagagtcaccatcacttgccaggcgagtcaggacattaagaactatttaaatggtatcggcagcgacagggaagcccctgagctcctgactctacgatgcgtccaatttggaaacagacggtcccacgaggttcaggtggaagtggatcgtgggacagactttacnctcaccatcagcagcctgcagcctagaacgtatattgctaaacattaacttactagtacaacgtagtatacgtattccgtcttcccttacaacgttttccggcccttagggaacctaggtacgtcggtaacaagttacggaaaccgtacgttggtacggtactgtacccg

SEQ ID NO: 249334 - DNA, 551 bp, Homo sapiens
  misc_feature: GYAE6OF02IVYH3.11.73.G07.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaattgtatcggnagcgacagggaancccctgagctcctgatctacgatcgcgtacctaatttaggaaaacagacggtacccaccggaggtttccaggtggaagtggatcgtgggacagtactttactctcaccatccagcagcctgccagcctagaacgtattattcgactaaactaattactttaactcgtacaaactagtacttagacttcgtaccttccttactaacgtttcccggaccgtcgggaacccaggtaggtcggtaactaagtacggaaaccgtacgttggtacggtactgtaacccg

SEQ ID NO: 249335 - DNA, 523 bp, Homo sapiens
  misc_feature: GYAE6OF02HREJD.11.73.G07.1.454.CMB.1.raw
  modified_base (194)..(194): a, c, t, g, unknown or other
  misc_feature (194)..(194): n is a, c, g, or t
  modified_base (268)..(268): a, c, t, g, unknown or other
  misc_feature (268)..(268): n is a, c, g, or t
  modified_base (362)..(362): a, c, t, g, unknown or other
  misc_feature (362)..(362): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcagtcaggacattaagaactattaaattggtatcggcagcgacagggaancccctgagctcctgatctacgatgcgtaccaatttaggaaacagacggtcccacgaggttcaggtggaagtggatcgtgggacagtactttacnctacacatcagcacgcctgcagcctagaagattagttacgacaaactattacttactacgtacaactagtatagacttcgtactcctactacgtttccgaccgtagggacctaggacggtacggaactagtacggaaacgtagtcggtacggtctgtaccg

SEQ ID NO: 249336 - DNA, 487 bp, Homo sapiens
  misc_feature: GYAE6OF02G10HQ.11.73.G07.1.454.CMB.1.raw
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (483)..(483): a, c, t, g, unknown or other
  misc_feature (483)..(483): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcacctgagctcctgatctacgatgcgtccaatttggaaacagacggtcccacgaggttcagtggaagtggatcgtgggacagtactttactctcaccatcagcagcctgcagcctagaagatatgacaacatattactgtacaanatatnatctctctactatttccggccgtgggaccagtacgtgacatacgaaacgtacgtaggtcgntacg

SEQ ID NO: 249337 - DNA, 526 bp, Homo sapiens
  misc_feature: GYAE6OF02GH1K4.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaagcccctgagctcctgatctacgatgcgtccaatttaggaaacagacggtcccaccgaggttcagtggaagtggatcgtgggacagactttactctcacctatcacgcagcctgcagcctgaagatattgacaacattattactagtactaacaagttatgactcgttacctacctactaactttccggcccgttagggaccctaggacggtacggacgtagtacggaaacgtaaccttggtacggtcgtcgtaccg

SEQ ID NO: 249338 - DNA, 788 bp, Homo sapiens
  misc_feature: GYAE6OF02FFDZD.11.73.G07.1.454.CMB.1.raw
  modified_base (118)..(118): a, c, t, g, unknown or other
  misc_feature (118)..(118): n is a, c, g, or t
  modified_base (615)..(615): a, c, t, g, unknown or other
  misc_feature (615)..(615): n is a, c, g, or t
  modified_base (736)..(736): a, c, t, g, unknown or other
  misc_feature (736)..(736): n is a, c, g, or t
tcagcgagagataccacgaccggtgctcgatttagctctacgctcgagggggcaggagtcagtcccaaccaggacacagcatggacatgagggtccctgctcagctccgtgggctccngctgctctgtctctcgaggtcacctagattggtacactactccgtacgttccgaccctagttccctacctaccttcccctccgttagtcctacgactaacgttacgtaaggtaacgggactaccgtacgtacctacctaaccctacgtaccctacggtccggaaccggtaacgggtaccggtaagttaaccggtaaacggttaaaaccttaaacggtttaaaaacgttaacgttttaaaacggttttaacggccggttaaccggaccgggaaccgaaccgggtaacccggaaacccgggtaacgtaaccccggtccgtaggtaccttaccgtacgttaacgtacgtaaccggttaccgtacggtaccgtaaaccgttaaaccgtacgggtaaacggaccgtaccggtacccgtaccggtaaggttcggtagtacggtagggacttaccggtagtaccgggtaacttaccgtacctttaccgtaccaccgaccgtaanacgacgtccacggtactacgacgacgtactaaggaatgttacattacatactaatcagtacgattagtcgtacgttctaccgtacctataccgtaccggttacggccaagggactaaaggngtaaccgtaactaacggttaaccgaccggtatcggcggtacctacgtacctc

SEQ ID NO: 249339 - DNA, 544 bp, Homo sapiens
  misc_feature: GYAE6OF02G6534.11.73.G07.1.454.CMB.1.raw
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
  modified_base (405)..(405): a, c, t, g, unknown or other
  misc_feature (405)..(405): n is a, c, g, or t
tcagcgagagataccacgaccggtgctcgatttagctctacgctcgtagggggggcaggagtcagtcccaaccaggacacagcatggacatgagggtccctgctcagctcctggggctcctgctgctctgtctctcaggtgccagatgtgacatccagttgacccagtcctccatcctccctgtctgcatctataggagacagagtcaccatcacttgccaggcgagtcaggacattaagaactattaaattggtatcggcagcgacagggaaacgcccctgagctcctgatctacgatgcgtccaatttggaaacaggacggtcccacgaggttcagtggaagtggatcgngggacagtactttacnctcaccatcagcagcctgcagccctagaagtatattnacaactatattactgtactaacagtatagtattcgtcttaccctactaacgtttccggacccgtcggggaacctaggtacggtacggtaaccgtacgtaacggaaaccgtacgttagggtacggtaccgtagtaacccg

SEQ ID NO: 249340 - DNA, 630 bp, Homo sapiens
  misc_feature: GYAE6OF02JB9BB.11.73.G07.1.454.CMB.1.raw
  modified_base (256)..(256): a, c, t, g, unknown or other
  misc_feature (256)..(256): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttgacccagtctccatcctccctgtctgcatctataggagacagagtcaccatcgacttgccaggcagtcaggacattaagaactattaaattgtaatcgtanagcgacgaaggaaacgccctagacgctcctgatctacgatcgcgtacctaatttaggaaacagacggtaccctaccggtaaggtttcaacggtaggaaggtcggtaataccgtaggggaactaggtaacttttacgtacttacgaacctaacttacgaacgacgtaacgtccgttacgaccgtacgccttaacggaacgtaagtattacgacaaactattaacgttactacggtaactaaactacgttaatacgtaacgttcgtacccgttacctaacgttacgtttacccggtacccgttacggggaacctaaggtacgtacgtaaccgtaagtaacggtaaaccgtaacgttggtacggtacgtagaacccg

SEQ ID NO: 249341 - DNA, 482 bp, Homo sapiens
  misc_feature: GYAE6OF02FISXZ.11.73.G07.1.454.CMB.1.raw
  modified_base (360)..(360): a, c, t, g, unknown or other
  misc_feature (360)..(360): n is a, c, g, or t
  modified_base (477)..(477): a, c, t, g, unknown or other
  misc_feature (477)..(477): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaagcccctgagctcctgatctacgatgcgtccaatttggaaacagaggtccaccgaggttcagtggaagtggatcgtgggacagactttacnctcaccatcagcagcctgcagcctagaagatattgcaacatattactgtacaacagtatgatctctcctctatttcggcctgggaccagagtggacagtacgaacgtacgtgtcggntgacc

SEQ ID NO: 249342 - DNA, 552 bp, Homo sapiens
  misc_feature: GYAE6OF02ISUXH.11.73.G07.1.454.CMB.1.raw
  modified_base (137)..(137): a, c, t, g, unknown or other
  misc_feature (137)..(137): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtnccagatgtgacatccagttgacccagtcctccatcctccctgtctgcatctataggagacagagtcaccatcacttgccaggcgagtcaggacattaagaacttattaaattgtatcggnagcgtacaggaacnccctagagctcctgactctacatgtcctacgtaatttacggaaaacaggtacggtacccacggtaggtttacaggtaggaagtggatacgtaggganacgtactttacgtntaccacatcagcagtcctnacacgtctagaagacttatgaccaatataacttacagtactaaacgattactagcgttaccgtcctactactaacgtttccgggaccttacgggaacctagtagtacggtaactacgttaacggaaacgtacgtcggtagtccgtaagacc

SEQ ID NO: 249343 - DNA, 543 bp, Homo sapiens
  misc_feature: GYAE6OF02I8MB7.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatatgagacagagtcaccatcacttgccaggcagtcaggacattaagaactattaaattggtatcggcagcgaccagggaaagcccctgagctcctgatctacgatgcgtccaatttggaaacagacgtcccacgagttcagtgaagtggatcgtagggacaggtactttacgtctcaccatcagcacgctagcagcctagaagattattacgacaacgtaattacttactacgttactaaactagttattagtattaccggttccttacccttactaacgttttccgggaccccgttggggaaccctaggacggttaggaactagtagaaaaccgtagtacggtcggactaccgg

SEQ ID NO: 249344 - DNA, 744 bp, Homo sapiens
  misc_feature: GYAE6OF02I8C6G.11.73.G07.1.454.CMB.1.raw
  modified_base (181)..(182): a, c, t, g, unknown or other
  misc_feature (181)..(182): n is a, c, g, or t
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttgacccagtctccatcctccctgttcnntactntagaganagagactaccactactctacgtcgcgaggacgacgtacgagactaagtaaacgtaactttaatttaagttagtacgtcgacaggaccgacggaaggaacccgtcccgtagcgtccgtcgaggtactacgtacgtacgtacggtacccgttaacgttaaggtaacgaacgtaacgggtacccggtacccgtacgggttaagttaccgtagggtacgggtaaggtacggtacgtcgggtacgggaactaacggtttacctttaccgttaccacctaacctacgtaccgaccggtacgtacccggtccgtaggaccgtacgtaccgtaagggaaacttacgtttaagtccgaaactaacctttaagtttaaccgtttacgtaaccgtaaaccgtaaacggttagtttacgtaacgtttcccgttaccgtttaaccccttacttaaacggttttcccggttcccggtaccgggtaaccggaccgtaaggttacgggtaccgaacgtaagttaaacccgggaacttaccgggttggacccggtatcccggtaacc

SEQ ID NO: 249345 - DNA, 250 bp, Homo sapiens
  misc_feature: GYAE6OF02HHJOH.11.73.G07.1.454.CMB.1.raw
  modified_base (244)..(250): a, c, t, g, unknown or other
  misc_feature (244)..(250): n is a, c, g, or t
tcagcgagagataccacgaccggtgctcgatttagctctacgctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccgtatctctcgctgagcgggctggcaaggcgcatagnnnnnnn

SEQ ID NO: 249346 - DNA, 524 bp, Homo sapiens
  misc_feature: GYAE6OF02F0W97.11.73.G07.1.454.CMB.1.raw
  modified_base (361)..(361): a, c, t, g, unknown or other
  misc_feature (361)..(361): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccacgaggttcagtggaagtggatcgtgggacagactttacnctcaccatcagtcagcctgccagcctagaagatattgacaaactattaatttacctgtaccaactagttaatgtacttcgttcttccttacgtaactttccggacccttgggaaccaggtacggtggaacagtaggaaacgtacgtaggtcggtctgtacccg

SEQ ID NO: 249347 - DNA, 522 bp, Homo sapiens
  misc_feature: GYAE6OF02G7C8G.11.73.G07.1.454.CMB.1.raw
  modified_base (194)..(194): a, c, t, g, unknown or other
  misc_feature (194)..(194): n is a, c, g, or t
  modified_base (271)..(271): a, c, t, g, unknown or other
  misc_feature (271)..(271): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (423)..(423): a, c, t, g, unknown or other
  misc_feature (423)..(423): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaacttatttaaattggtatcgcagcgacaggaaacncccctgagctcctgatctacgatgcgtactaattagaaacngacgtcccacgagtcagtggagtggatcgnggacagtactttacnctcacatcagcagcctgcagacctgaagtatattagacaaactatattaactgtacaacgtagtanacggtattccgttactccttactaaccgtttccggcccgttacgggaccctaagacggtacgactagtaacgaaacgtacgtggtacggtactcgaccg

SEQ ID NO: 249348 - DNA, 511 bp, Homo sapiens
  misc_feature: GYAE6OF02IW98F.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaaattggtatcggcagcgaccagggaaagcccctgagctcctgatctacgatgcgtcaatttggaaacagaggtacccacgaggttcagtggaagtggatctgggacagactttactctcaccatcagcagcctgcagcctagaagatattgacaacatattactgtacaacagttatgtattcgtactcctactaacgtttccggcccgtacgggaaccaaggacgtagactagtacgaaacgtaaccgtaggtcggtctagaccg

SEQ ID NO: 249349 - DNA, 564 bp, Homo sapiens
  misc_feature: GYAE6OF02HQZ08.11.73.G07.1.454.CMB.1.raw
  modified_base (195)..(195): a, c, t, g, unknown or other
  misc_feature (195)..(195): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctcctgtcctgcatctatagganacagacgtcaccatcacttgccaggcgagtcaggacattaagaactaattaattggtatcggcagcgaccgagggaaacgcccctggacgctcctagatacgtacgatgccgttacaagtttaggaaacagacggtcccaccggtaggttcgaggtggaagtggaactcgtgggacagtactttactctcaccatcagcagcctgccagcctagaagtacttatcgacaatatacttactggtacaactagttatgacttcgtctaccttagtaaccgtttccggacccgttaacggggacctaagggtacggttacggaacctagttaacggaaaccgtacggttaggtaccggacttcggtaacccg

SEQ ID NO: 249350 - DNA, 582 bp, Homo sapiens
  misc_feature: GYAE6OF02IU34W.11.73.G07.1.454.CMB.1.raw
  modified_base (358)..(358): a, c, t, g, unknown or other
  misc_feature (358)..(358): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaaagaacttaatttaaattggtatcggcagcgaccagggaaacgcccctggacgctcctggatctacgatgccgtacctaagtttggaaacagacggtcccacggagttcagtaggaagtggatcgngggacagtactttactctcacctatcagcagcctgacacgccctagaagtataagttcgactaaactattaactttactacgttaacaaacgtagtacttgtaacttcccgttaccttacctacttaacgtttcccgggacccgttacggggaacctaaggacgggtacggaacgtaagttaacggaaaccggttaacgttgggtacggtccgtacgtaacccg

SEQ ID NO: 249351 - DNA, 564 bp, Homo sapiens
  misc_feature: GYAE6OF02GFI6M.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtaccaatttggaaacagaggtacccacgaggttcagtggaagtggatcgtgggacagtactttactctcacatcagcagcctgcagcctagaagatattgacaaacgtattacttactacgtacaaactagttaatacgtaattccgttacctacccttacgtaacgttttcccgggaccccgttacgggaaccccgtaaggtaacggttacggaacctaaggtacggtaaaacgtaaccgttggttacgggtacctaggtaaccc

SEQ ID NO: 249352 - DNA, 505 bp, Homo sapiens
  misc_feature: GYAE6OF02I2BJY.11.73.G07.1.454.CMB.1.raw
  modified_base (448)..(448): a, c, t, g, unknown or other
  misc_feature (448)..(448): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaattgtatcgcagcgaccagggaagcccctgagctcctggatctacgatgcgtccaatttggaaacagacggtcccaccgaggttccaggtggaagtggatcgtgggacagactttacctctcaccatcagacagccctgcacgccctgaagtatattgactaaacgacttattactagtactaacagttatgattcgtctcctntacttcgcctagggcctaggagtacggacagtacgaacgacctgtggtactgacccg

SEQ ID NO: 249353 - DNA, 725 bp, Homo sapiens
  misc_feature: GYAE6OF02HVZYU.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaacttaattaaattaggtatcggacagcgaccgaagggaaacgcccctggacgtcctcctgactctacgactgaccgttacctaaagtttacggaaaacaggtaacggtaccccgaaccggtacgggtttacaaggtagggtaaagttagggacgttacggtaggggaactaagggttaacctttttaaccgccttaccaaccgtaacttaccgaacggtaccgaacggtcccttacggacctacggtacccgttaggaaaacgttaagtttaacgttacgtaaccctaaaacgtaacttaaacgttttaaccgttagggttaacccaaaacgtaagtttaacgtacgttaaccgtttccgttccgttacccgttaaccttaaccgtttttcccggtacccggttacggggaacctaacgggtacggtaacggaaccgttagtaacggaaaaccggttaacggttacgggtacggtccgtacggtaaccc

SEQ ID NO: 249354 - DNA, 573 bp, Homo sapiens
  misc_feature: GYAE6OF02JLQMC.11.73.G07.1.454.CMB.1.raw
  modified_base (259)..(259): a, c, t, g, unknown or other
  misc_feature (259)..(259): n is a, c, g, or t
  modified_base (324)..(324): a, c, t, g, unknown or other
  misc_feature (324)..(324): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtccaccatcacttgccgggcgagtccaggacaattaagaactattaaattgtatacggntagcgaacgaggaacgccctagacgcgtcctgactcgtaacgatgacgtacctaattagaaacgngaacgtcccacgtaggtacaggtaggaagtcgaagtcgtagggactaggtaccttacgtctaccactacgtacacgcgaacgtcctagccgtaagtacccgtaggtaagtaagttaacttacgactaaagtaacttacttaacgtagtacaaactataagtgtactctactctacgtaacgttcgacccgtaggaccgtagtacgtacgtaactagtaacgaacgtacgtagtacgcgtacgacctacg

SEQ ID NO: 249355 - DNA, 508 bp, Homo sapiens
  misc_feature: GYAE6OF02G1LQ1.11.73.G07.1.454.CMB.1.raw
  modified_base (271)..(271): a, c, t, g, unknown or other
  misc_feature (271)..(271): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaattggtatcggcagcgaccagggaaancccctgagctcctgatctacgatgcgtccaatttggaaacagaggtccacgagttcagtggagtggatctgggacagtactttactctcacatcagcagcctgcagcctagaagatattgacaacattattactgtacaatagtatgacttcgtacttcctactaacgtttcggcccgttagggaaccctaggtagtcggacgtagtacggaaacgtacgtgtcggtctacgtaccg

SEQ ID NO: 249356 - DNA, 541 bp, Homo sapiens
  misc_feature: GYAE6OF02FZTXR.11.73.G07.1.454.CMB.1.raw
  modified_base (252)..(252): a, c, t, g, unknown or other
  misc_feature (252)..(252): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
tcagcgagagataccacgaccggtgctcgatttagctctacgctcagggggcaggagtcagtcccaaccaggacacagcatggacatgaggggtccctgctcagctcctggggctcctgctgctctgtctctcaggtgccagatgtgacatccagttgacccagtctccatcctccctgtctgcatctataggagacagagtcaccatcacttgccaggcgagtcagacataagaactattaatgtatcggnagcgacgaggaacgcccctgacgctcctggactctacgatgcgtacctaagtttacggaaactagacggtacccaccggtaggtcaggtaggaagtggatcgngggacagtactttacnctcacctagtcagcacgcctagcacgccgtagaagatattcgacaactattaattactntacaacgtagtatagtactcgtactcctactaacgttccgcccgttagggaacccaggtacgtacggtaacgtacgtaggaaaccgtactgggtacgtacctaggtaaccc

SEQ ID NO: 249357 - DNA, 612 bp, Homo sapiens
  misc_feature: GYAE6OF02IUSPQ.11.73.G07.1.454.CMB.1.raw
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
  modified_base (451)..(451): a, c, t, g, unknown or other
  misc_feature (451)..(451): n is a, c, g, or t
  modified_base (605)..(605): a, c, t, g, unknown or other
  misc_feature (605)..(605): n is a, c, g, or t
tcagcgagagataccacgaccggtgctcgatttagctctacgctcgagggggcaggagtcagtcccaaccaggacacagcatggacatgagggtccctgctcagctccgtggggctcctgctgctctgtctctcaggtgccagatgtgacatccagttcgacccagtctccatccctccctgtcctgcattctaagtaggagtaccaggatccaccattcacttcgaccgaggcgagtcaggactagttaaanaacttaattttaagtggtatcggcaaggccggaacgaacgggtaaccnccccgtagacgtcctctacgataccgtacgagtcgaccgttaactaagtttacggaaacacggtaccggtaccctacgtagggttacgaggttacggaaggtggtattcggacggaactacgttaccttactcgtacacgtactgaccgntccgtcctgacgacgtacgtagaatactttcagaacctaagttaactagttaacctgtaacacgtattagactcttaccgtcttactacgtcggttaccgacggtacggactaggaccgtaggacaggttacgaaccgttgtacgcggtacgtntaccccg

SEQ ID NO: 249358 - DNA, 552 bp, Homo sapiens
  misc_feature: GYAE6OF02G6OTB.11.73.G07.1.454.CMB.1.raw
  modified_base (311)..(311): a, c, t, g, unknown or other
  misc_feature (311)..(311): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattgtatcggcagcgaccagggaacgccccgtgagctcctgactctacgatgcgtccaattggaacngacgtccacgagtcagtgagtggatcgtgggacagtactttactctcacatcagcagcctgcagcctgaagtctattcgacaacgtatacttactcggtacaacgtagttattacgtaacgttcgtaccttaccgttacgtaacgttttcccggtaccttcggttacgtaacccgtaaggtacggtacggtaactaacgttacggtaaaaccggtaaccgttgggtacggtccgttaccgg

SEQ ID NO: 249359 - DNA, 249 bp, Homo sapiens
  misc_feature: GYAE6OF02IWGPU.11.73.G07.1.454.CMB.1.raw
  modified_base (240)..(249): a, c, t, g, unknown or other
  misc_feature (240)..(249): n is a, c, g, or t
tcagcgagagataccacgaccggtgctcgatttagctctacgctcagggtcttcgtggctcacgtccaccaccacgcatgtgacctcagggtccggagatcatgaggtgtccttgggtttgggggaagaggaagacgtgacggtcccccaggagttcaggtgctgggcacagcggccctgggctgcctggtcaaggactacttccgtatctctcgctgagcggctggcaaggcgcatagnnnnnnnnnn

SEQ ID NO: 249360 - DNA, 561 bp, Homo sapiens
  misc_feature: GYAE6OF02GU3KX.11.73.G07.1.454.CMB.1.raw
  modified_base (439)..(439): a, c, t, g, unknown or other
  misc_feature (439)..(439): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaacttaatttaaattggtatcggcagcgaccagggaaacgcccctgacgctcctgatctacgatgcgtacctaagtttaggaaacaggacggtacccacggtaggttcaggtggaagtgagtcgtagggacagtactttactctacaaccatcagcagcctgcacgtcctaggaatattagttcgaccaacgtattattacgtntaaccaagtagtatagtacttccgttactaccttacgtacgttttcccggacccgtcgggtaaccgtaggtacgtacggaactagttaacgaacgtaacgtgggttagtaccgtagtaaccc

SEQ ID NO: 249361 - DNA, 569 bp, Homo sapiens
  misc_feature: GYAE6OF02HSUDH.11.73.G07.1.454.CMB.1.raw
  modified_base (254)..(254): a, c, t, g, unknown or other
  misc_feature (254)..(254): n is a, c, g, or t
  modified_base (364)..(364): a, c, t, g, unknown or other
  misc_feature (364)..(364): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaattgtatcggnagcgacgaggaacgcccctgacgctcctgactctacgatgcgtactaattaggaaacagacggtaccacgtaggttcagtaggaagtggatcgtaggacagtactttacnctacacatcagcacgcctgcacgcctagaagtattatacgacaactatttaattacgtcgtaacaacagttatagtaacgttccgtaccgttaccttaccgtaacgttttcccgggaccccgttagggggtaaccctaacgggtaggttaccggaactagtaacggaaaaccgttacgttagggtcggtacccgtagtaaccccg

SEQ ID NO: 249362 - DNA, 585 bp, Homo sapiens
  misc_feature: GYAE6OF02G6SBN.11.73.G07.1.454.CMB.1.raw
  modified_base (269)..(269): a, c, t, g, unknown or other
  misc_feature (269)..(269): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactatttaaattgtatcgcagcgacgaggaaacncccctgacgctctgatctacgatgcgtacctaagtttcggaaacaggacggtacccaccggtaggttcaggtggaagtggatcgtgggacagtactttactctacaccatcacgcagacctgcagccctagaaacgtattacttcgaactaaactattacgttactagttaccaaacgtagttaacgtgtacgttcgttaccttacctacgttaacgtttcccgggtacccgtacggggtaccaacggtacggtacggaactaaggtaacggtaaaacggttaacccgttagggtaccggtaccgtacgtaacccg

SEQ ID NO: 249363 - DNA, 515 bp, Homo sapiens
  misc_feature: GYAE6OF02HSDM5.11.73.G07.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcagtcagacataagaactattaaatgtatcggnagcgacagggaaacnccctagagctcctgatctacgatgcgtactaatttaggaaacagacggtcccacgtagtcaggtggaagtggatcgtggacagtactttactcgtacaccatcagcagcctgcncgctagaanatatcgacaacaattacttactgtacaacagttatgtatcgtctactactacgtttacgccgtacgggacctaagggagtacggaactagtaacggaaacgaccgttgtacggtcgtactaacccg

SEQ ID NO: 249364 - DNA, 504 bp, Homo sapiens
  misc_feature: GYAE6OF02G00FA.11.73.G07.1.454.CMB.1.raw
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtcaatttggaaacagacggtcccacgaggttcaggtaggagtggatcgtgggacagactttacnctcaccatcagcagcctgcagcctagaagtatattgacaactattattactntacaactgtaatgacttcgtcttcctctaagtttccggaccgttgggaaccaggtacggtaggacctagtacgaacgatggtcgctgaccg

SEQ ID NO: 249365 - DNA, 661 bp, Homo sapiens
  misc_feature: GYAE6OF02JLNIH.11.73.G07.1.454.CMB.1.raw
  modified_base (291)..(291): a, c, t, g, unknown or other
  misc_feature (291)..(291): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcagtctagtaggagacagtacgtcaacctatccaacttcgaccaggcgacgtcaaggactagttaaagaacttaatttaattgtatcggcagtcgacgaggtaacncccgtgagctctgactctacgatcgacgtactaagttaggaaactaggacgtacccacggtaggttcaggtaggtaagtggatcgtaggactaggttacttaacgtcgactaccgtaatcgtagactacgtccagtacacgtacctaagggtaactacgttacgttaggacctaacttaacgttacgttaccgttacgtaactacgttaagtaacttcggtaaccttccggttacccttacccgttaacggtttaacgtttaccccgggtacccgttaacggggtaaccgtaacggtacgggttaccggtaaccgttaaggtaacccgggttaaagtaccggtagggttacggtaccgtcgggtaacccc

SEQ ID NO: 249366 - DNA, 535 bp, Homo sapiens
  misc_feature: GYAE6OF02GCO9U.11.73.G07.1.454.CMB.1.raw
  modified_base (194)..(194): a, c, t, g, unknown or other
  misc_feature (194)..(194): n is a, c, g, or t
  modified_base (266)..(266): a, c, t, g, unknown or other
  misc_feature (266)..(266): n is a, c, g, or t
  modified_base (366)..(366): a, c, t, g, unknown or other
  misc_feature (366)..(366): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcagacataagaactattaatggtatcggcagcgaccaggaacncccctgagctcctgatctacgatcgcgtaccaagtttaggaaaacaggacggtcccacggtacggttcaggtggaagtggatctgggacagtactttacnctcaccatcagtcagcctgcacgcctagaagtatattgacaactatacttactagtacaactagtatcgtagttcctacttccgtactaacgtttccggcccgttagggaccctaggtacggtcgtaacctagtaacggtaaacgtaacgttggtcggtactcggtacc

SEQ ID NO: 249367 - DNA, 511 bp, Homo sapiens
  misc_feature: GYAE6OF02FGF3V.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagaccagagtcaccatcacttgccaggcgagtcaggacattaagaactatttaaatggttatcggcagcgaccagggaagcccctgagctcctgatctacgatgcgtccaatttggaaacagaggtcccaccgtaggttcagtggaagtggatcgtgggacagactttactctcacatcagcagcctgcacgcctagaagatagttgacaactatacttactgtacaacagttatgtatcgtactcctactaacgtttcggccctgggacccaggacgtaggacaagtacgaaacgtacgttggtacggtctagtaccg

SEQ ID NO: 249368 - DNA, 565 bp, Homo sapiens
  misc_feature: GYAE6OF02GRIPA.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccactcctcctgtctgcatctataggagacagatcacatcacgtgccgaggcgagtcgaggacaattaagaacttaatttaaagttggtatcgcagcgacgaaggaacgcccgtagacgcctccgtgactctacgatcgacgtactaagttacggaaacaggaccgtacccgacggtacggttacgacggtagggaacgtggtacgtcgtacgggaactacgttactttactctaccactactcagcacgcctgcacgtcctagaagtacttagtcgaactaatattacttactacgtaacaactagtatagtaccttcgtcctacttacgtacgttccggaccgtacgggactaggtagtcgaactagtacgaaacgtcgttggacggtccacgtacc

SEQ ID NO: 249369 - DNA, 597 bp, Homo sapiens
  misc_feature: GYAE6OF02IT07N.11.73.G07.1.454.CMB.1.raw
  modified_base (195)..(195): a, c, t, g, unknown or other
  misc_feature (195)..(195): n is a, c, g, or t
  modified_base (464)..(464): a, c, t, g, unknown or other
  misc_feature (464)..(464): n is a, c, g, or t
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtcctccatcctcctgtctgcatctatagganacagagtcaccatcacttgccaggcgagtcaggactaattaagtaacttaatttaaagttggtatcggacagcgaaccgagggaacgccccgtagacgtcctacctagactacgtacgactcgcgttacctaagtttaggaaaacgacgaacggtacccgacggtaacggtttacgacggtaggtaaggtggtaacgtcggtagggaactagttactttacctctacacactacgacgcacgctgactagcctagaacgtattacgtanactaaacgtataacttatacgtaacaacgtagtatacgtactcgtacttccgtactacgtttccggaccgttacgggaacctaggtacgtacgactaacggtacgtaaacggtacgtggtacgactcgaaccg

SEQ ID NO: 249370 - DNA, 725 bp, Homo sapiens
  misc_feature: GYAE6OF02ITCUQ.11.73.G07.1.454.CMB.1.raw
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
tcagcgagagataccacgaccggtgctcgatttagctctacgctcgagggggcaggagtcagtcccaaccaggacacagcatggacatgagggtccctgctcagctcctggggctcctgctgctctgtctctcaggtgccagatgtgacatccagttgacccagtctccatcctcctgtctncatctanaggagacagagtcacatctacttgccaggcgagtcaggacaattaagtaacttaagtttaaagttggtacttcggactaggccggaaccggacggggaaaccgccccgtaggacgtcctaccgtagtactacgtaacgtctcggtaccgttactaagtttacggaaactacggaccggtaccccgtaaccggtacggtttaccacggttagggaacggttggaagttccggtacggggacctacggtaccttttaccgtcttaccgaacccgtataccgagtaccgacgtacccgtgacctacggtaccgtaaggagttaattacgtacgaaacctaacgtaatttaccttaacttacgtaaccgtaacgtagttaacgtacgttaaccgttcttacccttaacccgttctttaaccgggtttcccccggtacccggttacggggaaccgtacgggttaacggttaccgggaacgttaaccggttaaacggtaaacccggtaacggtttacgggtacggtcctacccggtaacccg

SEQ ID NO: 249371 - DNA, 564 bp, Homo sapiens
  misc_feature: GYAE6OF02F7JZQ.11.73.G07.1.454.CMB.1.raw
  modified_base (298)..(298): a, c, t, g, unknown or other
  misc_feature (298)..(298): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcacttgccaggcgagtcaggacattaagaacttatttaaagttggtatcggcagcgaccagggaaacgcccctgagctcctgatctacgntcgctacaatttggaaacagacgtccacgagttcagtggagtggatcgtggacagtactttactctacaccatcagcagtcctgcacgcctagaagtatagttacgactaacgtatacttactagtacaacgtagttaacgtgtacttccgttacttacccgtacttaaccgtttcccggacccgttagggaacccgtaaggtacgggttacggaacgtaagtaccggtaaacggtaaccgttcggtacggtccgtacgtaacccg

SEQ ID NO: 249372 - DNA, 635 bp, Homo sapiens
  misc_feature: GYAE6OF02GIQMH.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcacttgccagggcgagtcaggacattaagaacttatttaaattggtatcggcagcgacgaagggaaacgcccctaggactctccgtgactcgtacgatcgccgtactaagtttaggaaactaggacggtcccgaacgggtaggttcaggtagggaagtggacgtcgtagggaactaaggtacttttaccgtctaccgacctaactcacgtccaggccctagccgacgtacccgtagaaacggtattacgttacgaccaaacgttattaactttaacgtcgttaaccaaacgtagtttaacgacgttaacttccgttcccttaccgtactttaaccggtttcccggtaccggttaccgggaacctaagggtacggtaacgtacgtaacgtacggtaaaccggacgtttcgggagtacctcggtaaccc

SEQ ID NO: 249373 - DNA, 585 bp, Homo sapiens
  misc_feature: GYAE6OF02INQ2W.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctagtaggagacagagtccacctatccacttgacccgaggcgagtcgaggacattaaagaacttaatttaattggtatcggcagacgacgaaggaacgccccgtagagctccgtgactactacgatcgccgtacctaagtttacggaaacaggacggtacccgacgtacggttacgaggtaggaggtaggactcggaggactacgtactttaccgtactaccgaaccacgtacacgcgacgtccgtacgcgacgtaccgtagaagtactagttcgaactaactataacttacgtgtaacacgtagttactgacttcgtctaccgtcttacgttccgaccgtacgggcctacggagtacggactacgtacgaacggttacgtggtacggtacgtgtaacccg

SEQ ID NO: 249374 - DNA, 515 bp, Homo sapiens
  misc_feature: GYAE6OF02GFG6L.11.73.G07.1.454.CMB.1.raw
  modified_base (257)..(257): a, c, t, g, unknown or other
  misc_feature (257)..(257): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
tcagcgagagataccacgaccggtgctcgatttagctctacgctcagggggggcaggaggtcagtcccaaccaggacacagcatggacatcgagggtccctgctcagctcctggggctcctgctgctctgtctctcaggtgccagatgtgacatccagttgacccagtctccatcctcctgtctgctatctataggagacagagtcaccatcacttgccaggcgagtcaggacataagaactattaattgtatcggnagcgacgaggaacgccctagagctctgatctacgatgcgtacctaagtttaggaaacaggtacggtacccacggtaggttcaggtagggaagtggatcgtagggacagtactttacnctcactatcagcagctgcngacagaatatattgactaatattattactgtacaactagttatacgtactcttactcttactagtttcccgaccgtggaacctaggacgtaggacagtacgaacgacgttggcggctgaccg

SEQ ID NO: 249375 - DNA, 582 bp, Homo sapiens
  misc_feature: GYAE6OF02GDKFM.11.73.G07.1.454.CMB.1.raw
  modified_base (196)..(196): a, c, t, g, unknown or other
  misc_feature (196)..(196): n is a, c, g, or t
tcagcgagagataccacgaccggtgctcgatttagctctacgctcagggggcaggagtccagtccaaccaggacacagcatggacgatggagggtaccctgctcagctcctggggctcctgctgctctgtctctcaggtgccagatgtgacatccagttgacccagtctccatcctcctgtctgcatctatagganacagagtcaccatcacttgccaggtcgagtcaggacattaagaactatttaatgtatcggcagcgacgaggaacgccctgacgctcctgactcgtacgatgcgtacctaatttacggaaacaggacggtcccacgtacggttacagtagggaagtggatcgtgggacagtactttactctcaccatctacgcacgcctgccgagcccgtagaagtacttatttcggacctaactattaacttactacggtactaacgtagttacgtagtacttccgtaccttaccttaccttaagtttccccggtaccgtacgggtacccgtaaggtacggttaacggaactaaggttacgaaacgggtaacttagggtacggtctacggtaaccc

SEQ ID NO: 249376 - DNA, 481 bp, Homo sapiens
  misc_feature: GYAE6OF02F98ZZ.11.73.G07.1.454.CMB.1.raw
  modified_base (384)..(384): a, c, t, g, unknown or other
  misc_feature (384)..(384): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccaggaaagcccctgagctcctgatctacgatgcgtccaatttggaaacagaggtcccaccgaggttcagtggaagtggatcgtgggacagactttactctcacatcagcagcctgcagccngaagatattgacaacatattactgtacaacagtatgtatcgtctctcatttcgcctgggaccagtagtggacagtacgaacgtactggtggctgacc

SEQ ID NO: 249377 - DNA, 732 bp, Homo sapiens
  misc_feature: GYAE6OF02F5CGU.11.73.G07.1.454.CMB.1.raw
  modified_base (186)..(186): a, c, t, g, unknown or other
  misc_feature (186)..(186): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtcctctcaggtgccagatgtgacatccagttcgacccagtcctccactccctccctgtctncatctataggagacagatcaccatcacttgccgaggcgagtcgaggaactattaaagtaacttaattttaaagttaggttagtcggacacgaccgaaccgaagggaaccgcccgtagacgtcctccgtagtactacctaacgacgtacgtccgttaccgttaagttaacggaaaacgtacggaaccggtacccccgtaaccggtacgggtttacgaacgggttaagggtaacggttcgggtacgttacgggtacgggtaaccgttaacgttaccgttttacctaccgttacccaaccgtaacctacgaacgaccgtaaccggtccctacgacccgtaccgtaccgtacgtaaagttacgttacttacgaacctaaataacgtttaacttaacgttacgtaaccgtaaacgtaagtattaacgttacgtttccgttaccttccgtaccgtttaccgttacccgtacccgggtacggtaacccgtaaggtaccgtacggtaacgtaacgtacggtaaacccgtagttcgggacgttcgtacgtacccg

SEQ ID NO: 249378 - DNA, 587 bp, Homo sapiens
  misc_feature: GYAE6OF02IC1N7.11.73.G07.1.454.CMB.1.raw
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctcatcctcctgtctgcatctataggagacagagtcaccatcacttgccaggcgagtcaggacattaagaacttattaaattggtatcggnagcgacagggaacnccccgtgagctcctgatcgtacgatcgcgtaccaagtttcggaaacagtacggtacccacgaggttcaggtggaagtggatcgtggactagactttactctcgaccatacagctacgccgtgactacgtacctaggaacgtacttagttacgaccaaacttagtaactttaccgtagtacgtaaactagtttaactggtaactttccgtaccttaccgtacgttaacgttccggtacccgttcgggaacctagggacgttacggtaaccgtaagtacggtaaaccgtaacggttcggtacggtacgttcggaacccg

SEQ ID NO: 249379 - DNA, 559 bp, Homo sapiens
  misc_feature: GYAE6OF02GB2VJ.11.73.G07.1.454.CMB.1.raw
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacataagaactatttaaatggtatcggcagcgacgaggaacgccctagagtctcctgactcgtacgatgcgtactaagtttaggaaacagacggtcccacggtacgttcaggtaggaagtggagtcgtgggacagtactttacnctctaccatcgancacgctgcagctagaagtntattgactaatattattactagactaagagttataggtacttccgttcttacctagttaacctttccgggaccgtacggggtaacctaggtacggttacggacgtaacggttaacgaaaccggttacgttcgggtacggtccgttaccgaacccg

SEQ ID NO: 249380 - DNA, 673 bp, Homo sapiens
  misc_feature: GYAE6OF02FYPTC.11.73.G07.1.454.CMB.1.raw
  modified_base (253)..(253): a, c, t, g, unknown or other
  misc_feature (253)..(253): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatgtatcggnagcgacgaggaaacgccccgagacgtcctcgtagtactacgtacgagtcgtccgtaaccgttaagttacggaaacgacggtaccggtacccgaaccggtacggttacgtagggtagggtagtacggtagtcggtacgggaactacgtactttactctaccactacgtcgacgtacacgtcgtcgacgacgcgtacgtaaagtacttacgttcgaacctaacttaagtttaacctttacgttacgtaaaccgtaacgttaagttaacgttacgtacgtttacccgttacccttacgtaaccgttttaaccgggtttccccgggacccgtacggggtaacccggtaaggttacggggtaccgtaacgtaaacggtaaccggtaaacgtacggttacgggtacggtacccgtacgtaaccccg

SEQ ID NO: 249381 - DNA, 774 bp, Homo sapiens
  misc_feature: GYAE6OF02IGD46.11.73.G07.1.454.CMB.1.raw
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttcgacctagtcctccactcctcctgtctgcatctataggagcaaggtactcactactcactcgccaggcgagtcaggacattaagaacttatttaaagtggtatcggctaagccgaacgaacgggtaacgcccctagacgtcctaccgtaggtaaccttactacgtaacgttcgtacccggtaaccgttaaagttttacggggaaaaaccgtacgggtaaccgggtacccccgaacgggttaacgggttacgtaacggttaaggggtaacggttgggaacttacgggtacggggtaaacgaaccgtttacgtttaaccttcgtaacccgtaaccgtataccgtaacgccgtaaacgtccgttacgacgtaccgtacgtacgtaacgtattaacggttacaacccgttaactaactaacgtttaaacgttccgtaaccgttaaacgtaacgttacgttaacgtttaccgtaacccggtttacctaccgttaaccggtttaacccgtttacccgggttacccggttacccgggtaaaccggacgggttaacggttaacggtaaccgttaacgttaacggaaaaccggttcgtaacgggttaccggtagtacccgttaaccgg

SEQ ID NO: 249382 - DNA, 549 bp, Homo sapiens
  misc_feature: GYAE6OF02I1D09.11.73.G07.1.454.CMB.1.raw
  modified_base (314)..(314): a, c, t, g, unknown or other
  misc_feature (314)..(314): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaacgcccctgacgtctcctgatctacgatgcgtccaatttgaaacngacgtccacgagttcagtggagtggatcgtgggacagtactttactcgtcactatcagcagctgcaggcctgaagattattcgactaactataacttactagtaacaacgtagttagtagtacttcgttactccttactaacgtttcccgggacccgtacgggaacccgtaaggtacggtacggtaaccgtacgttaacggaacgtaaccgttggtacggtactaccgtaacccg

SEQ ID NO: 249383 - DNA, 631 bp, Homo sapiens
  misc_feature: GYAE6OF02H1723.11.73.G07.1.454.CMB.1.raw
  modified_base (324)..(324): a, c, t, g, unknown or other
  misc_feature (324)..(324): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatggtgacatccagttcgacccagtcctccatccctccctgtcctgcatctataggagacagacgtaccacatccacttcgccgagggcgagtcgaaggactaattaagaaacttaatttaaagttggtactcggacagacgaccgaacgggaaacgccccttgacgctccgtgactctacgntcgccgtacctaagttacggaaacagtacggtacccacgtaggttcaggtagggagtggatcgtaggactaggtactttacgtctacacctatacgacgtcacgtcctagacacgaccgtagaaagtatacgttacgaacctaaactacgtttaaatttaccgttaacgtacctaaacgtagttaacgtagtacgttcccgttaccttacccttacgttaaccgtttccggacccgttaggggaaacctagggtacggtacgtacgtaagtacggaaacgtaccgtagggtaccgtcgtacgaaccg

SEQ ID NO: 249384 - DNA, 951 bp, Homo sapiens
  misc_feature: GYAE6OF02IGK5X.11.73.G07.1.454.CMB.1.raw
  modified_base (198)..(198): a, c, t, g, unknown or other
  misc_feature (198)..(198): n is a, c, g, or t
tcagcgagagataccacgaccggtgctcgatttagctctacgctcagggggcaggagtcagtcccaaccaggacacagcatgtacatgagggtccctgctcagctcctggggctcctgctgctctgtctctcaggtgccagatgtgacatccagttcgacccagtctccatcctccctgtctgctatctaagtagganacgagacgtcaccatcgtaccttcggccgagggcgacgtcgaaggaactaagtttaagtaaactttaagttttaaagtttcgggtaactccgggacgtaacggaccggaaccgtaaacgggggaaaaccgtccccccgttaggtaaccgtcccgttaccgtaggtacctttaccgtaacggacgttacggtacccgttaacctttaaaacggtttaacggtaaaaccgtaccgggtaaccgggtacccccgtaacccgggttaacgggtttaccgtaaaggggttacggggtaaacggttacggggtaacggttcgggtaaacggggtaaccgtaaacggtttaaccccgttttaaccgttacccgttacccttaaacccgtacgttacccggaacgtaccccggtacggttacccgtacggtaacccggtaccgttaccccggtaaaggttaaaccggttaaactttacggtttaaccggaaacccttaaaacgttaacgtttaaccgtttaacgttacccgtaaaccgtttaaaacgtacggtttaacgttaacggttaccgtttaacccggtttacccttcccggtttaaacctttacccgggttttacccgggtacccccgggttaacggggtaaacccgtaacggggttaaccgggttaaacgggtaaacccgttaacggttaaaccgggtaaaaccgggttaaccggttaccggggtttaacggtaccccgttaacggtaacccccg

SEQ ID NO: 249385 - DNA, 589 bp, Homo sapiens
  misc_feature: GYAE6OF02FLPO6.11.73.G07.1.454.CMB.1.raw
  modified_base (250)..(250): a, c, t, g, unknown or other
  misc_feature (250)..(250): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (481)..(481): a, c, t, g, unknown or other
  misc_feature (481)..(481): n is a, c, g, or t
tcagcgagagataccacgaccggtgctcgatttagctctacgctcagggggcaggagtcagtccccaaccaggacacagcatggacatgagggtccctgctcagctcctggggctcctgctgctctgtctctcaggtgccagatgtgacatccagttcgacccagtcctccattccctccctgtctgctatctataggagacagagtccaccatcacttcgccaggccgagtcgaaggactaagttaaanaacttaatttaaagttggtagtccggacaaggccgaacccgaaggggaaaccgtcccccgtggacgtcctcctcgactcgtacgatcgaccgttacctaagtttaggaaacgaggtaccggtaccccacggtaggttacgaggtaggaggttagatcgtaggactaacgtctttacnctacactancagcncgtctgacacgtctagaanttagtnacaatntactactanactatatagtagtactcgttacctccttagtaccgttccggccgtacgggacctaggacgtacggaactaaggttaacggaaacgtagtcggtacgtacgtctaaccg

SEQ ID NO: 249386 - DNA, 588 bp, Homo sapiens
  misc_feature: GYAE6OF02JDWAD.11.73.G07.1.454.CMB.1.raw
  modified_base (194)..(194): a, c, t, g, unknown or other
  misc_feature (194)..(194): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttcgacccagtctccatcctccctgtctgcatctatagganacagagtcaccatcacttgccaggcagtcaggacattaagaactatttaaactggtatcggcagcgacgaggaaacgccctgacgctctgatcagntncgtcaattgaaacngacgtccacgtgtcagtgagngtntcgtagacagtacttacnctacaccatcgacgcacgcgtgcacgtacctagaagtattagttcaacctaactacttaacttacgtaagtacctaaacgtagttaacgtacgtacttaccgttaccttacccgttaacgttaaccgtttcccgggtacccggttaaccggggaacccttaaacgggtacgttaacggaaccgtttaacggaaacggtaaaccggttaacgttcgggtaccggttacgtacgtaaccccg

SEQ ID NO: 249387 - DNA, 602 bp, Homo sapiens
  misc_feature: GYAE6OF02JZPQT.11.73.G07.1.454.CMB.1.raw
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (571)..(571): a, c, t, g, unknown or other
  misc_feature (571)..(571): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctcctgtctgcatctataggagacagagtcacctatcacttgccgaggcagtcaggacattaagaactattaagtgtatcgcagcgacgaggaacnccctggacnctctgactcgtacgatcgcctactagttagaacgacgtacgccctaacggtggtttacaggtaggtaacgtggtactcgtagggactaacggtactttacgacttcaaccgtgtacacggtcacggacttcgacagtaccgtagtaacgtattacgtgtaaccaacttattacgttacgactacgtaaactgttacgtactaccgttactcccgttaccctagtttaaccgttcccggacccgtaggtaaccgtaacgggacgttaagtacccgtaagtaacggtaaaacccgngtttaccgggacgttacccgtaaggtacccc

SEQ ID NO: 249388 - DNA, 642 bp, Homo sapiens
  misc_feature: GYAE6OF02HSSVV.11.73.G07.1.454.CMB.1.raw
  modified_base (194)..(194): a, c, t, g, unknown or other
  misc_feature (194)..(194): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctcctgtctgcatctatagganacagagtcaccatccacttgaccaggcagtcaggactaattaacgaacttaatttaaagttggtatcggtcagacgaccgagggaaacgcccctagagtcctcctgtactctacgatcgccgtactaagtttaggaaacgaggacggtacccacggtagttcgaggtggtaagtgatcgtagggactagtctttacgtctaccacgtactacaagccacgccgtagtacgaccggtccgtaaagaaagttaacttagtttacgacgttaaaactacgtttaatttaccgtagtaaccgtaaacttaagttagttacgtattacccgttccttaacctacgttaaaccgtttcccggacccggttaccggggaactacgggtaaggttaacggaaccgtaaggttaacggaaccggaaacgtttgggtaccggtaccgtacggtaaccc

SEQ ID NO: 249389 - DNA, 707 bp, Homo sapiens
  misc_feature: GYAE6OF02JH13S.11.73.G07.1.454.CMB.1.raw
  modified_base (136)..(136): a, c, t, g, unknown or other
  misc_feature (136)..(136): n is a, c, g, or t
  modified_base (198)..(198): a, c, t, g, unknown or other
  misc_feature (198)..(198): n is a, c, g, or t
  modified_base (301)..(301): a, c, t, g, unknown or other
  misc_feature (301)..(301): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtnccagatgtgactatcctagttcgacccagtctccactcctcctgtctgctatctagtagganacagacgtcacatcacttcgcaggacgagtacacggactaattaaacgtaacttaactttaaagttggtactcggtacacggaccgaaccgaagggtaaaccnccccggtagacgtaccgtaccgtagtacttaccgtaacgtacgtacggtaccgttacgttaagtttacgggaaaactacggtaaccggttacccgaaccggttacgggttacagggttaacgggaacggtacggtacgtaccgggtaacggggtaacttaacggttaacttttacccgtacgttacccgtaacctacgttacgaacggcctaacggtcccgtacgtaccgtacgtaaccgtaagtaacggtacttacgtacgaactaactagttacttaacgtacgtaacgaaacgtgaacttacgactttccggacctttaccgtacgttaacgttcccgacgtaggaaccgtaggaccgtagaccgttaagtacgaaacgtgttacggacgtaccgtcgtaacg

SEQ ID NO: 249390 - DNA, 615 bp, Homo sapiens
  misc_feature: GYAE6OF02IRGIO.11.73.G07.1.454.CMB.1.raw
  modified_base (288)..(288): a, c, t, g, unknown or other
  misc_feature (288)..(288): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttcgacccagtcctccatccctcctgtctgacatctagtaggagacagacgtcaacatcacttgccaggcgagtcaggactataagaacttattaaagttgtatcgacagacacgaggaacgcccagtacgctcngctacagactgcgtactaattacggaaactaggtaacggtacccgaccgtaggttacgtaggtacgggtaaggtaggtatcggtacggaactagtacctttactactacaccagtacagaccgtagtcttacgactacgacgttagaacgttattacgttagaccgaactaacgttacttaccgttagaactaaccgtaagttacgtagtaccgttaccgttcttaccgttaacttaccggttacccggtaccggtacggtaccgacgtaacggtaccggtaactagtaacggaaaccggttaggtagtaggtaccaccttaaccgg

SEQ ID NO: 249391 - DNA, 589 bp, Homo sapiens
  misc_feature: GYAE6OF02G2J31.11.73.G07.1.454.CMB.1.raw
  modified_base (252)..(252): a, c, t, g, unknown or other
  misc_feature (252)..(252): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtacaccatcacttgccaggcgagtcaggacattaagaactattaatgtatcgnagcgacaggaacgccctagacgctcctagatctacgatcggcgtacctaagtttaggaaaactacgacggtacccaacggaggtttcgaaggtgggaaagtggtatcgtaggggaactaggtaacttttaccgtactcgaaccatcgaacgtcacgcctaggccagacctagaaacgtattagtacgacaaacgtaattaacttacgtacgtaccaactaacgttatacgtacttccgttacctaccgttataacggttttcccggaccgtacgggtaaccaggtacggacgtaagtacgtaacggaaacgtaacttagggcggtactcggtaaccc

SEQ ID NO: 249392 - DNA, 696 bp, Homo sapiens
  misc_feature: GYAE6OF02IN1EE.11.73.G07.1.454.CMB.1.raw
  modified_base (203)..(203): a, c, t, g, unknown or other
  misc_feature (203)..(203): n is a, c, g, or t
  modified_base (552)..(552): a, c, t, g, unknown or other
  misc_feature (552)..(552): n is a, c, g, or t
  modified_base (564)..(564): a, c, t, g, unknown or other
  misc_feature (564)..(564): n is a, c, g, or t
  modified_base (591)..(591): a, c, t, g, unknown or other
  misc_feature (591)..(591): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgaccctagtcctcctactccctccctgtcctgcctatctatagganactagagtccactatctactcgaccagggcgtagtacgaggaactaagttaaacgaaactttaatttaaagttaggtaagtccggtacgaacggtaccggtaaaccggaaggggaaacccggtcccccgtaggtaacgcccttaccggtagtaccttaccgtacgtacggtcgtaccgttaacctaagtttacggaaacgtacggtacggtaccccgaaccggtagggttacgtaagggtacgggaacggtagggtacttacggtaggtaaccgtagttaacctttaccgtcctaccaactactacgtacgacctacggtcttacggacctacgcgtaagaataacgtntacgaaccaatntttactacgtactacgaacgtagttanaccgttatccggttacaccttacgtaccgttccggtcccggtaccggagtacgtgggtaacctactagaaccggtaaacgtggttacggtcgtacgtaccggacc

SEQ ID NO: 249393 - DNA, 592 bp, Homo sapiens
  misc_feature: GYAE6OF02IUGTM.11.73.G07.1.454.CMB.1.raw
  modified_base (197)..(197): a, c, t, g, unknown or other
  misc_feature (197)..(197): n is a, c, g, or t
  modified_base (349)..(349): a, c, t, g, unknown or other
  misc_feature (349)..(349): n is a, c, g, or t
  modified_base (416)..(416): a, c, t, g, unknown or other
  misc_feature (416)..(416): n is a, c, g, or t
  modified_base (463)..(463): a, c, t, g, unknown or other
  misc_feature (463)..(463): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctcctgtctgcatctagtagagacngatcacatcactgaccaggcagtcaaggactaattaaagtaacttaatttaaaagttaggtatacggacaaggccgaaaccgaacggggaaacgtccccgtagaacgccgtaccgtaggactacgtacgatcgacgtacctaagttggaaanagacggtacccacggtagtcgagtaggagtggtatcgtaggactagtacgtttactcgtacaactanacacgaccacgcctagcgacgacctagaactaactgttacgactaanaattaaacgttcgtagtacaaacgtaactagtaacgtactacgttcctaccgtaacttacgttcccgtacggtacggtaacgacggtaggtagaccttaagcgaaaccgtagtgacgtcggtataaccg

SEQ ID NO: 249394 - DNA, 637 bp, Homo sapiens
  misc_feature: GYAE6OF02HQQLJ.11.73.G07.1.454.CMB.1.raw
  modified_base (194)..(194): a, c, t, g, unknown or other
  misc_feature (194)..(194): n is a, c, g, or t
  modified_base (306)..(306): a, c, t, g, unknown or other
  misc_feature (306)..(306): n is a, c, g, or t
  modified_base (451)..(451): a, c, t, g, unknown or other
  misc_feature (451)..(451): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctagtagganacagacgtccacatcacttgaccagggcgagtcaggacattaagaacttaatttaagttaggtatcggactacggacgaacgaagggaacgaccaccgtgacgtctaccgtnactacgtacgagtcggccgtaccgtaagtttaaggaaacgtggtaccggtacccgacggtaggttcgagggtacgggaagtggaacttcggtagggactacggtactttacccgtctaccgaccatcacggcacgtccgtcgacncgtacctagaagtattacgttcaacctaactaactttattaccgttagtaacctaaagtacgttagttagtaacgttccgttaccgttaccgttaaccttacggtttcccggaccggttaccggaacccggtaggtacggtacgtaacgtacgtaacggaaacgttacgcggttacgtacgtaccg

SEQ ID NO: 249395 - DNA, 591 bp, Homo sapiens
  misc_feature: GYAE6OF02HY5Y5.11.73.G07.1.454.CMB.1.raw
  modified_base (183)..(183): a, c, t, g, unknown or other
  misc_feature (183)..(183): n is a, c, g, or t
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (419)..(419): a, c, t, g, unknown or other
  misc_feature (419)..(419): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctcctgtcngacatctataggaganagcgtcacatcactgccaggcagtcagactataagaaacttattaagttgatcgcagcgacgaacggaacgccctagacgtctctgatccacgagtcgacgtactaagttgaaacnggtacgtaccctaccggtagttacgaggtggaagtcggacgtcgtagggactacgtaactttcgactacacancganctacgctagccgacgctagaagtattntagaacattaactattacgtagtaccaagtaagtagttacgtacgttactaccgtaccgttacttacgggtttacccgacccgtttaacggggaacctaacgggtacgtacggtaaacctaagtaaaccggttaaacggtctttaaacggggcgttacccggtaggtaaccc

SEQ ID NO: 249396 - DNA, 619 bp, Homo sapiens
  misc_feature: GYAE6OF02GM5XV.11.73.G07.1.454.CMB.1.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacatccagttcgacccagtctccatcctcctgtctgcatctataggagactagagtcaaccatcacttcgccgaggccgagtacaggactagttaaanaacttaattaaagttcggtatcggcagcgaccgaagggtaacnccccgtagacgtcctccgtagatccgtagactcgacgtacctaagttaggaactacgacggtacccacggacgtttcgaggtaggacgtaggacgtcgtacgggtactaggtaactttactcgtacaccgtatctacgctacgtccctggacctacgaccctaggaagtaacttagttacgaaacctactaacttaacgttacttgaacctaaacgtagttagtactagttccctacgtccttaacgtcgtttccgggaccggttcggaacccgaggttcggtacgtaaccgtagaccgggtaaacgtaccgttgtaccggtcgtacggaccg

SEQ ID NO: 249397 - DNA, 825 bp, Homo sapiens
  misc_feature: GYAE6OF02I8SZJ.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagacgtccaccatacctacttcgacccgacggcgagtacgaacggactaattaaagtaaacttaagttttaaaagttaggttagtaccggtacgacggaccggtaacccggaacggggaaaccgtacccccgtacggtaacgtccgttacccgtacggtaaccttaccgtaaccgtacgtacggtacccggttaaccgttaaagtttacgggaaaacgtaacggtaccgggtaccccgtaacccgggtacggtttaccgtaagggttacgggtaagggttacgggtaacgtcggtagggtaaccgtaacgtttaaccgttttacccgttaccctacccgtaaccctaaccgttaccgaaccggtaccgtaacggtcccttacggacccgtacgtacccgtaagtaacggtaattacggttacaactaaacgttacttaacgttacttaacggtactaaacgtattacgttacggtactttacccgtacctttacccgtaccgtttaaccggtttcccggtaccccggtttaacggggtaacccggtaaggttacgggttaaccgaaacgacggttaaaccggtaaacccgggttaacgttacgggtacggtaccgttacccgaacccg

SEQ ID NO: 249398 - DNA, 608 bp, Homo sapiens
  misc_feature: GYAE6OF02H84BO.11.73.G07.1.454.CMB.1.raw
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
tcagcgagagataccacgaccggtgctcgatttagctctacgctcagggggcaggagtcagtcccaacaggacacagcatggacatgagggtccctgctcagctcctggggctcctgctgctctgtctctcaggtgccagatgtgacatccagttcgacccagtctccatcctccctgtcctgcatctataggagacagagtcaccatcacttcgccaggcgagtcgaaggactaattaagtaaacttaatttaaagttggtatcggtcagcgtaacgaacgggaacnccccgtagacgctacngtactacctagtacgtgaccgtactaaagtttaggaaacgtaggacggtacccgaacggtaggttcgaaggtaggtaacgtggaatcggaggtacagtactttacgctacactntcagcagcgtncacgctagaacgattatgacaatatacttatactacaacgtagtatcgtaactcgttacctaccgttacgtaaccgtttccggaaccccgttagggaaacccgtaaggttcggtaacggtaacccgtaagttaaacggaaaccgtaacggtttacgggtcggtaccgttcgtaaccccg

SEQ ID NO: 249399 - DNA, 846 bp, Homo sapiens
  misc_feature: GYAE6OF02H9H8C.11.73.G07.1.454.CMB.1.raw
  modified_base (206)..(206): a, c, t, g, unknown or other
  misc_feature (206)..(206): n is a, c, g, or t
  modified_base (593)..(593): a, c, t, g, unknown or other
  misc_feature (593)..(593): n is a, c, g, or t
tcagcgagagataccacgaccggtgctcgatttagctctacgctcaggggggcaggagtcagtcccaaccaggacacagcatggacatgagggtccctgctcagctcctggggcctcctgctgctctgtctctcaggtgccagatgtgacacgtccagttcgacccagttcctccatccctcctgtctagcatctagtaggacaanagacgtaccaacctagttccaacgttcggaccgagggtcgacgtcgaaggtactaaattaaacgtaaacttaatttaaagttagggtaactcgggacacggtaccggaaccggaaacgggaaaccgtccccgtaggtacggtaccttaccgtaggtaactaccgtaacggacgttcggtaccgtaccgttaaaacggtttacgggaaaaccgtaacgggtaacccgggtacccgtaaccggggttaaccgggtttacggaacgggttaacgggggtaacggttagggggtaacgttccggggttaacggaaaccgttaacggtttaccttttaaccgttccttaacccgtacgtaataccggaacgttacgaccggtacccggttancccgtaacggtaccgtaaggaaaccggttatttaacgttaccgaaacttaacgttaactttaaaccttcggttaaccaactaacgggtttaactaacgttaccggtaaccgtttccctaccggttaaaccctttaccggttaaccggttccccggtaccgggtaacggggacccttaaaggggccggtaacggtaacgttaaccggtacgggtaaaacctacggttacggtacggttaccggtacgtaacccg

SEQ ID NO: 249400 - DNA, 719 bp, Homo sapiens
  misc_feature: GYAE6OF02IAOR6.11.73.G07.1.454.CMB.1.raw
  modified_base (144)..(144): a, c, t, g, unknown or other
  misc_feature (144)..(144): n is a, c, g, or t
  modified_base (147)..(147): a, c, t, g, unknown or other
  misc_feature (147)..(147): n is a, c, g, or t
tcagcgagagataccacgaccggtgctcgatttagctctacgctcagggggcaggagtcagtcccaaccaggacacagcatggacatgagggtccctggctcagctcctggggctcctgctgctctgtctctcaggtgcctagntgngacatccagttcgaccagtcctccatccctccgtgttacctgctatctagtaggagacaggctcaacatctatcgccgaggacgtacgacgaaggtacctaaagttaaacgtaaactttaaagtttaaaatttacgggttaaacgtcgggtaaccaggaccgtaaacggtaacgggaaacggaccccttaggacgccgtacgtacgaactttacgaacgtaacgtcgtacgttacgtaagtttacggaaaaacgtacgtacggtaccccgacggtacggtacgtacggtaaggtaacggtaaggtacgtcgtaacggggactaacggtaccgtttacggtacctaccgaacctacgtactaaccggacacggtctacgaccgtacgtaccgtaagaacgttaacgtaagttacgaactaaacgtaactaacgtttaactacgtaccgtaaagtaggtaactaggtacttacgttccttaacctacttacgttaccggtcccgttacggaaccctaaggtaccgacggttaacacgtaggtaaaacacggttacgtacgtaccgtagtaaccg

SEQ ID NO: 249401 - DNA, 745 bp, Homo sapiens
  misc_feature: GYAE6OF02H5VPW.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctccctgtctgcatctagtaggacgacaggacgtccacctagtcacttggccagggcgagtcgaaggacaattaaaggaaactttaatttaaaagtttcggtaagtccggactacggaccgaaccggaaacggggtaaaccgccccccgtaggacgtccgtccggtatacgtctaaccgagttcggccgtaaccttaagtttaacggaaacgacggtaccggtacccgaccggttaggtttcgagggtaggaaggtgtagtcggtaggtacacggttaacctttactactacctaaccgtacttacgacgtacctaacggtccgttacgaccgtaacggtcccgttaaggtaaaccgggtatttaacgtacggtaaacctaaagtacttaaacgtttaccgtagtaacccgtaaagtacgttaagtacgttacttacccgttctaacccctttagttaacccggtttcccgacccggtttacggggaaccttaagggtcggtaacggttaactaaccggttaacggaaaccgttaacggttacgggtaccgggttaccgtaacgtaaccccg

SEQ ID NO: 249402 - DNA, 563 bp, Homo sapiens
  misc_feature: GYAE6OF02H8UTH.11.73.G07.1.454.CMB.1.raw
  modified_base (194)..(194): a, c, t, g, unknown or other
  misc_feature (194)..(194): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctccctgtctgcatcatagganacagagtcaccatcacttgccgaggcgacgtcgaggacaagttaagaaacttaatttaaagttggtatcgganacggcgaacgagggaaancccgttagacgctctgatctacgatgactctaattaggaaacagtacgtacccacgtaggttcaggtaggaagtcggaatcgtaggactagtacttactctacgacactcacgtcacgctcgacacgtccgtaagaagtattagttacgactaaacattaacttacgtagtacaactagtactagtactccgttactaccttactaacgttcccgaccgttcgggaactaggtagtacgaactagtaacggaaacgtacgtggtcggtacctgtaacc

SEQ ID NO: 249403 - DNA, 724 bp, Homo sapiens
  misc_feature: GYAE6OF02GX2E7.11.73.G07.1.454.CMB.1.raw
  modified_base (202)..(202): a, c, t, g, unknown or other
  misc_feature (202)..(202): n is a, c, g, or t
tcagcgagagataccacgaccggtgctcgatttagctctacgctcagggggcaggagtcagtcccaaccaggacacagcatggacatgagggtccctgctcagctccgtggggctcctgctgctctgtctctcaggtgccagatgtgacatccagttcgaccctagtcctccactccctccctgtctcgcatctagtagganaacagagtccaacctatccgtaacttcgaccgacgggacgtaggtacgaaggtaacctaaagttaaacggtaaactttaaagttttaaagttggttaacgtccggactaacggaccggtaacccgaaagggggtaaaccctccccgttagaacggtcccgtaccgtaggtaactacgttaaccgagttccggaccgttaccgttaaaggttacggaaacgtacggtaccggtacccgaacggtacgggttacgagtaacggggagtcggtacgtacggtaaggactacggttacttccgacttacacgtatacgacgtacgtacggtccctggaccgtacgtccgtaagaaacgtattacgtacgaattaacgtatacttacacggtaactaacgtagttacgacgtccttacgtcttaccgtaagtttacctcccgggtagtaacccgggtaactaccggggtaagtcggtaacctaggtaaccggaacggttcgtacggtacggtaccgtaccgtaaccg

SEQ ID NO: 249404 - DNA, 643 bp, Homo sapiens
  misc_feature: GYAE6OF02FPKDP.11.73.G07.1.454.CMB.1.raw
  modified_base (284)..(284): a, c, t, g, unknown or other
  misc_feature (284)..(284): n is a, c, g, or t
  modified_base (625)..(625): a, c, t, g, unknown or other
  misc_feature (625)..(625): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctcctgtctcgcatctaataggagacagacgtcaccatccacttgaccaggcgatcgagatacttaagaacttaattttaaattggtatcggcaggacgaccgagggaaacnccccgtagacgcctctagtactcgtacgatcgtaccgtactaagtttacggaaactacggtaccggtcccgaacccggtaggttaccgtaggtacgggtaaggttgggtaactcggtagggtaacctaaggttaccttttaccgtactacccaactacttacggacgtcgacggtccacgggtctacgtcctaggattacgttactagacctaaactctttaacgttaccgttaggtaacctaaacgttagtacgttacgtagttcccgtcttaccctacgttaacgttcccgccgttacggaccgtaaggtggacgtactaagttaacggaacggtacgnggtcggtctacgtacccg

SEQ ID NO: 249405 - DNA, 732 bp, Homo sapiens
  misc_feature: GYAE6OF02JZGGU.11.73.G07.1.454.CMB.1.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (334)..(334): a, c, t, g, unknown or other
  misc_feature (334)..(334): n is a, c, g, or t
  modified_base (724)..(732): a, c, t, g, unknown or other
  misc_feature (724)..(732): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagtatgtgacatccagttcgacccagtctccatccctcctagtctgcatctagtagagacagcgtcacatcacttgccaggcgagtcaagctataagactattaatgtatcgctagcgacgtaggacnccgngtnctctanatcacgatcgcgtacaagttagaacgtagacgtccacgtagtacgagtaggtagnggtatcgtaggacacgtacttacgtctacgactagtacgtaacgcgtaacgtccgtacgtaccgttacggtacccgtaaggtaaacgttaacgtttaagttacggtaaaccttaaaccttaaacgttttaaccgttaaacgttttaaccggttaacgttaaaacccggttaaagttacgggttttaacggtaaacccgtttttacccgggttaccccttttaaaccccggttttaaaccgggttttaaacccccggtttttacccccgggggttaacccccgggggtttaaaaacccgggggtttacccccccgggggggttttaaaaaaaaacggggtttttccccccggggggggttaaaaaccccggggttttttttaaaacccccnnnnnnnnn

SEQ ID NO: 249406 - DNA, 692 bp, Homo sapiens
  misc_feature: GYAE6OF02JAM7X.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcatctagtaggagacagacgtcaccatcacttgccagggcgagtcgaggacaattaagaacttaatttaatggtatcggcagcgaccgaggaacgccctagacgtctcctggactcgtagagtcgaccgtacgtaagttacggaaactacgggaccgtacccgaacggtcggtttacgaggtagggaagttggatcggtagggaactacgttacgtttacctcgtaccacctagtccgtaagccgtaacggtcccttaggacccgtaacgtacccggttaagtaaaccgttaagtaccgttaacggaaacttaaaccgttaactttaaacttaccgttaacggtaaccgtaacgttaaacggttagttccgtaaccgtttacccggttacccttaccgtttaaccgttaccggtttacccgggtacgttaacggggtaccgtaaggtacggtaacgaacgtttaaggaaccgtaacggttaacggtggtacggttcgacgttacccg

SEQ ID NO: 249407 - DNA, 831 bp, Homo sapiens
  misc_feature: GYAE6OF02GK8EU.11.73.G07.1.454.CMB.1.raw
  modified_base (136)..(136): a, c, t, g, unknown or other
  misc_feature (136)..(136): n is a, c, g, or t
  modified_base (235)..(235): a, c, t, g, unknown or other
  misc_feature (235)..(235): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtnccagatgtagactatccagttcgaccctagtcctccacttcctcccgttgtactgactacttcctaagtacggacgtaacaggtacgttaccaaccgtnttaccaacgttcggacccgaggtaccgtacgttaccgaacggtacctaaagttaaacggtaacttaacgttttaaagttacggtacgtaccggctacggaccggtaacgtaacgggaaccgtccccgtaggacgtcctacgtgtactacgtacggactcggtcgttaaccgtaacgtttaggaaaaccgtacgggtaaccggtaccccgtaacggttaacggttcgtaaggttaaccgggtaagacgggttactcggtaaggggtaacctaacggttaacctttacgaccttacgtaaccgtaacgtaccgtacgtaccacggtacctaggtaccgtaacgtaccgtaggtaaacgttaacgttacgttaacgacccgttaaagtactttaaccgtacgttaaccggtaactaacgtttaacgtacgtttaacgtacgggttccctttaacccgttaccgtttaaccgttaaccggttttcccggaacccggtttacgggtaaccgttaaaccgggtacggttaacggtaacccgttaagttacccggtaaacgttaaccggttccggtacgggttacccgtaagttaacccccgg

SEQ ID NO: 249408 - DNA, 638 bp, Homo sapiens
  misc_feature: GYAE6OF02IYAWZ.11.73.G07.1.454.CMB.1.raw
  modified_base (235)..(235): a, c, t, g, unknown or other
  misc_feature (235)..(235): n is a, c, g, or t
  modified_base (301)..(301): a, c, t, g, unknown or other
  misc_feature (301)..(301): n is a, c, g, or t
  modified_base (526)..(526): a, c, t, g, unknown or other
  misc_feature (526)..(526): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtgccagatgtgacactccagttcgacccagtcctccatcccgtcctgtctgcatctaataggagactagacgtcaacctatactacttgccgaggcgagtnaacggactaagttaaagaacttaatttaaagttcggtactcggacacgtacgaacgaagggaaccncccgtagacgtcctactgactacgtaacgctcgcgttaaccgttagttaacggaaactacggaacgttaccccgacggtaacgttacgaggttaacggtaacgtaggaacgttcgtaaggggtaacctaagtttaccgtttaccaccgttaccgaacctatacgtacgaacgcgtccgtatccgacgtactaggaattacgtagttcgaactaagtactaacttntacgtaactacgtattatagtactccgttacttacgacttaacgtccgtacgacggtaacgagtacgtgtaacgtagtaacgtaacggtacctaggtacctcgtacgtaccg

SEQ ID NO: 249409 - DNA, 771 bp, Homo sapiens
  misc_feature: GYAE6OF02IHUAQ.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgcgtgctctgtctctcaggtcgccagatgtgacatcctagttcgaacccagttcctacctactcccttcccgtgtcctcgcctattcgtaagtaggaacgacgagtacgtaccaccaactacttaccgttcgccgagggacgacggtaccgaaggaacctaatttaaaacggtaaactttaattttaaaggttaggtacgtacgggacacggtaccggtaaccggaacggggtaaaaccgtcccccgtaggaccgtacccgttaccgagtaaccgttacgtaacggtacgtccgtaaccggttaaccgttaaagttaacggaaacgtaggaaccggtacccgtaaccggtaaggtacgaagggttaggaaacggttgaacgttcgggtaaggtaacgtaaccggtttaccttttaaccgtacccgtaacgaacccgtaatacgaacgtcgtaaccgtcttaacgcgaacggccgttaaaggaacttagttactacaaacgtaacttaatattaccacgtaacagtaacttaagtctaacgtttcctaccgtaccttacgtacgttcccgggtacccgagggttaccaagggttacgacgtaaacgttagtaaccggtaaacgttaccgggttaggacggttcgaccggtaaccc

SEQ ID NO: 249410 - DNA, 600 bp, Homo sapiens
  misc_feature: GYAE6OF02HF3L8.11.73.G07.1.454.CMB.1.raw
  modified_base (417)..(417): a, c, t, g, unknown or other
  misc_feature (417)..(417): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggactattaaagaacttaatttaaagttggtatcggcagcgaaccgaagggaaacgcccgtgacgctcctagctcgtacgatgcgtacctaagtttacggaacaggacggtacccgacggtaggttacaggtaggaaggtggagttcgtcgggacgtacgtactttacctctaccaccatcacgcacgtccngacacgtcctagaacgtagtagttagaactaactaattactttacgtagttaaccaactagtaacgttagtacgttaccgttacctaccgttacgttaaccgtttcccggacccttacggggtaaccaggtaggtacggtaacctaagtaacggaaacgtacgttagggtctacgtacgaccc

SEQ ID NO: 249411 - DNA, 787 bp, Homo sapiens
  misc_feature: GYAE6OF02HVSK2.11.73.G07.1.454.CMB.1.raw
tcagcgagagataccacgaccggtgctcgatttagctctacgctcagggggcaggagtcagtcccaaccaggacacagcagtggacatgagggtccctgctcagcttccgtgggctcctgctgctctgtctctcgaggtgaccagatgtagacactcctagttacgacccctagtcctccctacgtcccctcctggttctacggactaacttctaaggtaggaacgaccgaggtaactacccacctactacctaacgtcggtaccgaaggtccgtaagacgacgtaacttaaagttaaacgtaaacctttaaagttttaaacgttacgggttaacgtaccggacgtaccggtaccggaaaccgaaggggtaaaacacccgtacgtacgaaccggtccttactcgactaccgtaagtaccgtacgtaccgtaacgttaacggtaacgaaaccgtacggtaccgttaccccgaacggtacggttacgtagggtaacgaaggttggaacttacggtaacgggaattaccgttaactttccgacgttaccaactacgtaccgacgtaccgtacgtacctacggactacgtacttaaggaaacgtattacgttacgaactaattaacgttaacgttactaccgtaacgtaacgtaacgttacgtacgttccgtaccgttacttacccgttacggtttaccgttaccgggtacccgtaaacggtaccgtacggtagttaacgtaaccgttaagaaccggtaaaccgttagtacggtaccgtacggttaacccg

SEQ ID NO: 249412 - DNA, 736 bp, Homo sapiens
  misc_feature: GYAE6OF02IIZA6.11.73.G07.1.454.CMB.1.raw
  modified_base (212)..(212): a, c, t, g, unknown or other
  misc_feature (212)..(212): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcgaggtgaccagtatgtgactactcgtagttacgaccctagtcctacctactccctcccgtgtctacgctatctagagganacagcgtaccactactctacgttcgaccggagcgtagtcgaacggtactaagttaacgtaaacttaagttttaaagtaggtacgtaccggtactacggacccggtaaccggaaggggtaaaacccgtccccggtgggtaaccgtcccgttacccgtgtaaccttaccgtacggtaacgtcggtaccgttaaccgttaaaggttaacggaaaccgacggtaccggtaccccgaaggtacggttacgaggtacggtagtaggtacgtacgtacggtactacggttacttaccgtccaactacgtactaccgcgtacgacgtcgcgacgctacgtagaatattacgtacgtaacattacgtagttactagtaacgtatacgtcgttagtacccttacgttacctcgttaaccgttaccgggttccccggtccggtaacgggtaacccgttaagggtacggtaacggtaaccgtaaacgtaccgggtaaacgtacccggttacgggacgtcccgtaccgtaacccggg

SEQ ID NO: 249413 - DNA, 711 bp, Homo sapiens
  misc_feature: GYAE6OF02IUZJQ.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccactccctccctgtctgcatctataggagacagactcaccatcacttcgccaggcgagtcaggactattaaagaacttaatttaattggtatcggacagacgaccgaaggggaaacgccccgtaggacgccttccgtaggtacttccgtaacgagtacgtccgttacctaagtttaggaaaacctacggtaccggtaccccgaacgggtacggtttccgtaagggttagggaaaggttgggtactacggtagggacctaacgtacttttacctacctaccaaccctagtaccgagccacgtcccgtcgacgacggtcctaaggaacgttaactttagttacgaaccgtaaaccttaattaacgttttaaccgtagttaacccaaacgttaacgttaagtacgttacgttccgttacctttacccgttaaccgttaaccggttttccccggtaccccgggttacgggtaacccgtagggaggttaccggaacgttaacggttaaccggaaaccggtagttacggtacggtaccgtcgtaacccg

SEQ ID NO: 249414 - DNA, 904 bp, Homo sapiens
  misc_feature: GYAE6OF02GL835.11.73.G07.1.454.CMB.1.raw
tcagcgagagataccacgaccggtgctcgatttagctctacgctcagggggcaggagtcagtcccaaccaggacacagcatggacatgagggtccctgctcagctcctgggctcctgctgctctgtctctcgaggtgccagatgtgacatccagttcgacctagtctccactccctcctgtctcgactatctagtaggagacgacgtacgtaccacctatacctacgttcgaccggaggtacggacgtacgaggtaactaagttaaacgtaactttaagtttaaacggttacggttacgtacgggtacctaacggaccgggtaaccgggaaacgggtaaaccccgtaccccggtaggtaccggtaccccgttaccggttacgtaacgttaccgtaaccggtaggtaccgggttaccggttaaccgttaaacggtttaaccgggaaaaccggaccggttaacccggtaccccggtaacgggttaacggttacggtaacggggttaagggtaacggttacggtacggttaccgggtaacgggtaaccgttaacgtttacccgtttacccgtacccgttactaacccgttaacgtcggtaaaccggtccaccggttaccgtaccggaacccgtaccgggtaaccgttaacggtaaacggttaacgttaacgtttaccgtaaaccttaaacgttaacgttttaacgttaaccggtaacgttaaccggttaaacgttaacgttacggtttaacgttaccggttcccgttacccgttaaccgttaaccgtttcccgggttacccggtacccgggtaacggtaaccggttacgggaacggttacggtaacggtaaccttaacgggtaaaccgttacccgggttgtacccgggttaccgttaccggtaaccg

SEQ ID NO: 249415 - DNA, 744 bp, Homo sapiens
  misc_feature: GYAE6OF02JCYW0.11.73.G07.1.454.CMB.1.raw
tcagcgagagataccacgaccggtgctcgatttagctctacgctcagggggcaggagtcagtcccaaccaggacacagcatggacatgagggtccctgctcagctccgtgggctcctgctgctctgtcctctcgaggtcgaccagattgtagactactaccgtagttacgaccctagtcctcctacttccctcccgtgtacctgacctattacgtagtaagggacaacgaagtacgtaccaaccgtataccgtaccgttccggacccgagggtcgtacgtacgaacggtaaccttaaagttaaagtaacctttaagttttaaacgttcggttacgtaccggacgtaacggacccggaaccggtaaaccggggtaaccctccccgtaggtaccgtaccgtaccgtaacgtacgttaccgtagtacgtcgtaccttaacgttaacgttacggaacgtacggtaccgtacccgacggtacgttagacggtagtagtcgagtcgaggtacctagtactttcacgtacacgtatacgagtacacgtactcgacgtacgacgtagaagttctatacactatagtttactacgtacgtactaacgttagtacgtacgtctttacgtcttaaccgtacggttacccttaccgggccggtttaaccggaacgtaggttaaccggtaactaaccggttaaacgttaaaccggttacggtaaccggttcggtaacggtaccgtaccgttaacccg

SEQ ID NO: 249416 - DNA, 780 bp, Homo sapiens
  misc_feature: GYAE6OF02JHYC3.11.73.G07.1.454.CMB.1.raw
  modified_base (384)..(384): a, c, t, g, unknown or other
  misc_feature (384)..(384): n is a, c, g, or t
tcagcgagagataccacgaccggtgctcgatttagctctacgctcagggggcgaggagtcagtcccaaccaggacacagcatggacatgagggtccctgctcagctccgtgggcctccgtcgctgctcttcgtcttcctcgaggttgacccgtagagttcgtgacctagtccctagttaccgaccacggtcctaccctacgtcccttccctgtctgactatactagtacggacgacgacggtactcaacctattacctacgttacggcccaacgggtacggtactacggaacggtaaccgtaagttaaaacgtaactttaaagtttaacgttacggttagtaccggacgtaccgtacggaaccgtaacggtaaccgtaccccgnggactaccgtactacgcttaactacggtactagtaccgtaacgttaaacgttaaggaaccgtaaacggaccgtttacccgaacggttacggttaacggtaggtaacgggtaggttacggtaacggttacggtaaggttaacgtaacggtttaacctttacgaccgtttaccgaaccgtacgtacgtaccaggtacccacgttcgaacgtagaccgttaagaccgtattactacgaacttaacgtatacgtaactacggtaacctagttaacagttactacggtcttcccgtacttacccgtacggttcccgtacggtaaccggtaaccggttagtacggtacgtaagttaacgttacggtaaacccgttacggtacggtaccggtcaccgttaccg

SEQ ID NO: 249417 - DNA, 627 bp, Homo sapiens
  misc_feature: GYAE6OF02HB7B9.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatcctcctgtctgacatctataggagacagagtcacatcactcgcaggcgagtcagactaattaagaacttaatttaaattggtagtcggactagacgaaccgaagggaaacgtcccccgtagacgtcctccgtagaactctaacgagtcgacgtacctaaagttacggaaaacagtacggtacccgaccggtacggttacaggtaggaacgtaggtacgtacgtagggactaacgtactttactcgtactaaccagttaccagtccacgtcctagcgacaccgtaagaacgtaactattacgaactaaactaagtaacttaacgtgtaacctaaacgtattagtagtactaccgtacccttaacctaccgtaagtttcccgaccggttaccggaacgtacgagggttacgaacgtaagtaaccgaaacggtaccgtagggtacggtctacgtaccc

SEQ ID NO: 249418 - DNA, 768 bp, Homo sapiens
  misc_feature: GYAE6OF02GR87U.11.73.G07.1.454.CMB.1.raw
  modified_base (207)..(207): a, c, t, g, unknown or other
  misc_feature (207)..(207): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatggtgacatcctagttcgaccctagtcctcctactccctccctgtcctgcctattctagtagganacagtgtaccaccatcacttgaccgaggcggtagtccgaggtactaattaaagaacttaatttaaacgttggtaactcggcacgacgaccgaagggaacctcccgagaccgtctaccgttagtacgtacgtaacggtactacggtaccgttaaccgttaaaacgtttaacgggaaaaaccgtaacggggtaaccggtaacccccgtaacggggttaacggtttacgtaggggttaagggggtaaacggttcgggaacgttaccggtacgggggaacctttaacgggttaaccctttttacctacccggtaccctaaccgtacgtaaccgtacgtacggttaccgcccgttgaccgtaaccggtaccgtaaagtaaacgttaacgtttataccggttaacctaagttaacttaacctttacgtagtaaccgtaagttacggtaacttacggaactttccgtactttacctaccggttaccggtttccggtaccggtacgggaaccgtacggtacggtaaccggagttaacgaacgttaacgacgtacggtcgacgtacgacc

SEQ ID NO: 249419 - DNA, 663 bp, Homo sapiens
  misc_feature: GYAE6OF02HOB4M.11.73.G07.1.454.CMB.1.raw
  modified_base (196)..(196): a, c, t, g, unknown or other
  misc_feature (196)..(196): n is a, c, g, or t
  modified_base (627)..(627): a, c, t, g, unknown or other
  misc_feature (627)..(627): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtcctccatcctccctgtctgcatctagtagganacagtagtcaccatccacttcgaccaggcgagtcgaaggactaagttaaacgtaaacttaattttaaagttaggtaatcggacgagtaccgaaccggaagggaaaccgaccccgtggacgcctccgtagatctacgatcgacgtacctaagtttacggaagacgacggtacccaccggtaggttacgaggtaggtaaggtaggacgtacgtagggaactacgttactttacgttaccacctaccgtactcctaagctacgtccgtacgactaccgtaccggtaagaacggttaacgtttagtaccgtaacgtaaactacgtttaacctttaaccgttcgtaaacgtaaacctagttacttagactttaccgtacctttacctaaccgttcgtttacccggaccggttaacggacgtagtacggtacgtaanagtaacggtaacgtacgtacggtcgtcgacgtaccg

SEQ ID NO: 249420 - DNA, 871 bp, Homo sapiens
  misc_feature: GYAE6OF02IGYB9.11.73.G07.1.454.CMB.1.raw
  modified_base (150)..(150): a, c, t, g, unknown or other
  misc_feature (150)..(150): n is a, c, g, or t
tcagcgagagataccacgaccggtgctcgatttagctctacgctcagggggcaggagtcagtcccaaccaggacacagcatggacatgagggtccctgctcagcttcccgtggggctcctgctgctctgtctctacaggtgccagattgngactactactagttcgaccctagtcctccacttccctcctgtctacgctactactagtaggacgaacaggtctaaccacctatacctacgttcgccgtacgggtacgacgtacgaagtaacctaaagttaaagttaaactttaaattttaaaaggttcggtaaggtaccggcgaacggtaaccggaaccggaaacggggtaaaccgtcccccggtaggaccgtaccttaccgtagtaccgttacctacgtacgtcgtacccggttaacttaaacgtttacggaaaaccgcgtaacccggtacccgaaccgggtacgttacgaagggtgggtaaacgttgggtactacgggtaacgggtacttaaacggttacccttttaacgtacccgttactaacccggtacgtaccgtaccgacgaaccggttcgtaaccgtacgtaccggtacccgttaaaggtaacgtaaccgttttaagacctaaaacgtaacgtttacttaacctttaaccggtaaacgtaacgttaaaacgtcgtttaaacgttacgtacccgttaaccggtttacctacccgtttttaacgaccccggttttcccggggtaaccgttaccggggaacggttaaacccggttaggggtaaaccgttaaccggtaaccggtaaccggttaaaaaccggtcccggggtttaaacggttaaccgggtccgttaacccgttaacccgg

SEQ ID NO: 249421 - DNA, 762 bp, Homo sapiens
  misc_feature: GYAE6OF02FKBHK.11.73.G07.1.454.CMB.1.raw
  modified_base (138)..(138): a, c, t, g, unknown or other
  misc_feature (138)..(138): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
tcagcgagagataccacgaccggtgctcgatttagctctacgctcagggggcaggagtcagtcccaaccaggacacagcatggacatgagggtccctgctcagctcctggggctcctgctgctctgtctctcaggtcnccagagtgtgacatccagttcgacccagtctccactccctccctgtctgcatcgtanagganacagacgtcaccatcacttcgccgaggcgagtcgagtacaattaacgaacttaattttaaagtcggttaacgtccggacgtacggaccggaaccgaacggggaaaccgtccccgtagaacgtacccgttccgtacggtactacgttacgacgttcggtaccttaaccgtaaaggtttaacggaaactaacgggtaaccggaccccgtaaccgggtaaggttccgaagggttacgggaaacggttcggtacggttacggttagggaacctacgttaaccgtttaccgttactacccgaactaataccggaacgtacccaacggtcctacggacccgtacggtccgtaaaggaacgttataacgttaccgaaccgtaaacttaactttaacttacgtaccgtaaacctaacgttaacgtttaaggaacgtttaccgtacgtttccctaccggttaacgttacgtttcccgggaaccggtcggtaaacccggtagggtacccgtaggtaaaccgtaggttaaacccggaacgttacgtacgggtaccgtagtacccgttaacccg

SEQ ID NO: 249422 - DNA, 785 bp, Homo sapiens
  misc_feature: GYAE6OF02HPB5O.11.73.G07.1.454.CMB.1.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtagacatcctagttacgaccctaggtcctacctactcccctcccttggtaccgtcgtcctaagttccgtaagttaacgggtaagaaccgaacgcgtaaccctaacccctagtaccttaccggttcgacccgtacgggaccgtacgtacgaaggaacctaaagttaaacgtaaacgtttaattttaaagttggtacgtaccgacgacggaccgtaaccggaacggaaccgtaccccgtaggaccgtctccgtagtacttcgtacgtgtacggtaccgtaacctaagttacgaaacgtacggaccgtacccgaacggtgttaccgaggtaggagtcggtaatcgggtaggaactacgttaccttacctactaccgtactactacgaaccgtaccgtacgccgttacggacgtaccgtccgtaaaggtaacttacttacggacgtaaacctaaacgtttacctaaacggtttcttaacggtaacctaaacgtaacggtttactacggttaccgttaccctccggttaaaccgttaccggttaaccggtaccccgggtaccgggtaaacgggtctaaccgggtactaacgggtaacccgagtttaaacggggacttacgggttaccggtacggtaccttacaccg

SEQ ID NO: 249423 - DNA, 638 bp, Homo sapiens
  misc_feature: GYAE6OF02FGETD.11.73.G07.1.454.CMB.1.raw
  modified_base (198)..(198): a, c, t, g, unknown or other
  misc_feature (198)..(198): n is a, c, g, or t
  modified_base (342)..(342): a, c, t, g, unknown or other
  misc_feature (342)..(342): n is a, c, g, or t
  modified_base (537)..(537): a, c, t, g, unknown or other
  misc_feature (537)..(537): n is a, c, g, or t
tcagcgagagataccacgaccggtgctcgatttagctctacgctcagggggcaggagtcagtcccaaccaggacacagcatggacatgagggtccctgctcagctcctgggctcctgctgctctgtctctcaggtcgccagatgtgacatccagttcgaccctagtcctccatccctccctgtctgcatctatagganacagcgtcaccatccacgttgcccaggtccgagtcgaggactattaaagacttaatttaatggtatcggacagaccgaccgaggaaccgcccgtagagccttccagactactaacgatcgaccgttacgtaagtttaggaaacnggtacggtccctaacgggtacggttacgaggttagggaagttcggatcggtagggaactaggttacctttacgtcctaccgaactagtcacgactaccgtcctacgacgtagtacctaggaagttagtactttacggaacctaataacgtttattacgtaataacccgaagtaacgttatacgtactccgttacncccttagtaacccgttttcggacccgtcgggaaaccttgggaccgttaaggtaccaagtaccgtaaaaccggtacgttgggtaccgtgtacccgtaacccg

SEQ ID NO: 249424 - DNA, 761 bp, Homo sapiens
  misc_feature: GYAE6OF01DDUNK.35.51.E07.1.454.CMB.1.raw
  modified_base (235)..(235): a, c, t, g, unknown or other
  misc_feature (235)..(235): n is a, c, g, or t
tcagtacagatcgtcacgaccggtgctcgatttagcatactctacaacacacaaagggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcagagggtcacctatttccngcacgtgggactccaccagcagtcggggcaggcgtttggcgtacactggtaccagcgaggttccaacggaaccggccccaaactcctacatctaataactaagtaactcaagccggtaccctacgacgggtactccccgtagtaacccggtattttccgtaccttcgggtaccctacccgtaaacgttccgttaccgggtcccgtaccccgttaccgaccggtcccccttccccgtacgggtacccctaacgttccgtaacgggttccggggtcccttacccgtaacggtttccgtacgggtaacgggtacgtacgggtaacggggtacccttaggttaacgtttaacgttcccgtaacgtttcgggttacggacccgtaacggtaccggtaacgttacgggggggtaaacttacgggtaacccggtaacgggttacccgttaggggtaaacgggttttcgggggggtttaggggtttagggggtttttacgggggaccggggggttaacggggtaaaaccccggg

SEQ ID NO: 249425 - DNA, 690 bp, Homo sapiens
  misc_feature: GYAE6OF01AOTG9.35.51.E07.1.454.CMB.1.raw
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
tcagtacagatcgtcacgaccggtgctcgatttagcatactctacaacacacaaagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccagggccaggacgggtccacctattttcctgcacgtggggactccaccagcagtcggggcaggtctttggtntacacgtggtaccngcaggttccaggaaccggccccagacctcctcgacttctttgataacgtacgaacaaaccgtaccctcggtacgggtcccctaggaccgtccttcctcgtcggccttccgacggttccgtcggccgtcccttccgtcgtccccttcccgtacgggtcccagttcccgaccgttccggtccccgtaccgacgggtccttacggtaaccgtacgtcggacgggtccttacgggtaacttttaccggtttaaccgttccggtacccgtacggttcccggttaagttccggaaccgttacctccggtcccgttaggtaaccggttacgggtacgttcgggttacgggttccggtttaccggggaccgggtacccgggaaccggtaaacgttccccggg

SEQ ID NO: 249426 - DNA, 714 bp, Homo sapiens
  misc_feature: GYAE6OF01CDXL2.35.51.E07.1.454.CMB.1.raw
  modified_base (241)..(241): a, c, t, g, unknown or other
  misc_feature (241)..(241): n is a, c, g, or t
tcagtacagatcgtcacgaccggtgctcgatttagcatactctacaacacacaaagggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtccgtcggggccccagggcaggacgggtccacctatttccngcacgtcggggacctccaccagcacgtccggggcaggtcgtttggtgtacacgtcggtaccaggccgaggttccgacggaaccggccccagcctcctctacttcctttagaacttaagtacgaaccaaaccgtacccgtcggaaccggggttcccctcggaacccgttccttacgtccgttcggtccgtaccgtacgggtcgtacgggcctcccgttcgtccgtccccgttccccgtcgccctactccgaccgttcggcccctcccggagtccgtacggacgtacgtcgggaacgttcgtacgttagtttaccttacgggttcgtaccgtacggtttacgttaacgtaccggtaacctaccggttcccgtacccgttaggttaaaccgggtaccgttacgggtttccgggttcgggttcccgggtttaccgggggaccggggaccccgggttaaccggacgggttaccccggg

SEQ ID NO: 249427 - DNA, 775 bp, Homo sapiens
  misc_feature: GYAE6OF01BQUL3.35.51.E07.1.454.CMB.1.raw
  modified_base (239)..(239): a, c, t, g, unknown or other
  misc_feature (239)..(239): n is a, c, g, or t
tcagtacagatcgtcacgaccggtgctcgatttagcatactctacaacacacaaagggggctctgcttcagctgtgggcacaagaggcagcactcaggacaatctccagcatggcctggtctcctctcctcctcactctcctcgctcactgcacgagggtcctgggcccagtctgtgctgacgcacgcccgccctgagtgtcgtcggggccccagggcaggacgggtcacctatttccngccgtacgtcggggacctccgaccacgcagtcgggctacggtcgtttggtcgtacacgtcggtaccgacgtcgtacgggttccgaacgggaacccggcccccaaggacccttcccgtactaccgtttccgttttacggaacttaaacgttacggaaacctaaaacccggtaccccgttaccggtaccgggggtttaccccctacgggtaaccccggtccgtttaccgttccggttaccggtacccttacccggtacgggttcccgtccgggtacccgttccccgttaccggtccgtcccccgtttccccgtaccgggtaccctaacgttcccgtaaccggttccggtcccccgtaccgggtaaccggtcctaaccggtaaccggtacggtacgacggttcgttaacggtactttaacgttacgtccgtaccgtacgtaccggtataccgacctaccgtcggtccttaggtacggtacggtacgttcgggttcggttccgggttacgggaccggggttacgaaccggtgttacccgg

SEQ ID NO: 249428 - DNA, 627 bp, Homo sapiens
  misc_feature: GYAE6OF01C5UR1.35.51.E07.1.454.CMB.1.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (476)..(476): a, c, t, g, unknown or other
  misc_feature (476)..(476): n is a, c, g, or t
tcagtacagatcgtcacgaccggtgctcgatttagcatactctacaacacacaaagggggctctgcttcagctgtgggcacaagaggcagcactcaggacaatctccagcagtcggcctggtcctcctcctcctcctcactctcctcgctcactcgcacgtacgggtcctcgggcctagtctcgccctgactcacgcctcgcctcgtgtcgtcggtctccgngacngtacgactcacnctctcgnacncgacgacngcgnggttgtacgttggtacgttaatacgtattcgttccgtccgtacgacccaaccgaccgaacccgaggaaccaacccaaccctaatcattaagttaattcgtacgtacgtacgtacgtaacgttcgtccgtacgttacggtagtttactacgttcttcttactcgtcgttaccgtacgtaacgttccgacggacctaccgacccggtcctaccgtacnccttgtcgtcgcgtactcggtacgccgtaggacggacgtacggtctaagttacgttacgtcacgtcgtagtctaactagtaacccaacgacctagctaaccgtccgttacgttcggtcgggttacggacgggaaacgacggtaaccctcgg

SEQ ID NO: 249429 - DNA, 672 bp, Homo sapiens
  misc_feature: GYAE6OF02GX0E3.35.51.E07.1.454.CMB.1.raw
  modified_base (241)..(241): a, c, t, g, unknown or other
  misc_feature (241)..(241): n is a, c, g, or t
tcagtacagatcgtcacgaccggtgctcgatttagcatactctacaacacacaaagggggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcgggggcccccagggcaggacgggtccaccgtatttccngccacgtggggacctccaccagcagtcggggcaggtctttgggtgtacacgtcgggtaccagcgaggttccgagggaacccggccccagacctccctcacttctttagataatacgaaccaaaccgtccctacgacggggtccctacggacccgtcttcctcgtcggtcctccgtacggtcgtcggccgtcccgtcgttacgcccgttacccgtggtccctacgttccgaccgttcggcccctcccgacggtcctacgtaccgtagtcgggacggcttaggtaactttacgttacgtcgtaccgtacggtacgttacgtacgaccgtaccggttccgtcccgttaacggtacgggttaaccggtacgggtttcggttcggggtttaccggttccggggaccggggtaccgggtaaccgtacggttcccggg

SEQ ID NO: 249430 - DNA, 814 bp, Homo sapiens
  misc_feature: GYAE6OF02JRRXJ.35.51.E07.1.454.CMB.1.raw
  modified_base (144)..(144): a, c, t, g, unknown or other
  misc_feature (144)..(144): n is a, c, g, or t
  modified_base (249)..(249): a, c, t, g, unknown or other
  misc_feature (249)..(249): n is a, c, g, or t
tcagtacagatcgtcacgaccggtgctcgatttagcatactctacaacacacaaaggggctctgcttcagctgtgggcacaagaggcagcactcaggacaatctccagcatggcctggtctcctctcctcctcactctccgtcnctcactgcacagggtcctgggacccaggtctgtagctgacgcacgccgccctacagtgtccgtaggggcccccagggcacggaggggtccacccgtattttccgngccgtaacgtcggggaccttacccgaccgaacgccgagttccgggggactacgggtccgttttgggtcggtaacctaccggttacggttacccgaacggtccgtaaccggtttcccggaacgggtaaaccccggcccccgtaacggtacccgttaccctaccgtaacgttcgtttaccgtaagttaaacgttaccgaaacctaaacccggtaaccccgtaccgtaaccgggggtttcccctacggtaacccggtcctttaccgtccgtcgggtaccccttcgtaaccggttcgtcggccgtcccgttcgtccggacccttccgacggtcccttaacgtcccgtaaccgtccggtacccttccggtaaccgggtccttacgggaaccgtccggtttcggaaaccggttcgttacgttacgttttaaacgttccgttacgtacccgtaaacggttcccgttaagtacgacccgttacgtaccggtacccgttaggtacgtaccgtacggttacggttccggttcgtacccgggggtccggtaacccggggttaccacggttacccgg

SEQ ID NO: 249431 - DNA, 735 bp, Homo sapiens
  misc_feature: GYAE6OF02HBXHQ.35.51.E07.1.454.CMB.1.raw
tcagtacagatcgtcacgaccggtgctcgatttagcatactctacaacacacaaagggggctctgcttcagctgtgggcacaagaggcagcactcaggacaatctccagcatggcctggtctcctctcctcctcactctcctcgctcactgcacgacggtcctcgggcccagtcgtgtcgctcgaccgcacgccgtcctcgagtcgtccggtccgggcccagggcgacggcggtaccacttacgtttccgacgccgtacggtacgggtacctccgaccgacgtcgtacgtccggggactacggttcgtttacggtacgtaccgtacgttcgggaccgacggtaccggtaaccggttaccggaaccggaacccggcccctaacgtccgttacctacgtactttacgtttacgaaacgttaacgacgaaaaccgtaaacccgtaccgttacggtaaccggggtccctacggtacccgttccgtttaccgtacgtccgggtacccttaccggtacggtccgtacggtccgttacccgtcgttccccgtccttacccggtcgacctactccgtcctccggccgttacgacggacgtaccgaacggtcgtacggcgtaacgtttacttacgtttacgtacgcgtaccgtacgttctaacgtccgacgtccgttcgtaccggtgtaaccgtacgggttcgtggtttcccggcgttccgggccggtaacgacctaggtcccg

SEQ ID NO: 249432 - DNA, 547 bp, Homo sapiens
  misc_feature: GYAE6OF01AD3SM.9.25.C03.1.454.CMB.1.raw
  modified_base (534)..(534): a, c, t, g, unknown or other
  misc_feature (534)..(534): n is a, c, g, or t
tcagtgatacgtctcacgaccggtgctcgatttagtagtgtagatttgggtttgggagtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcgagggatccctgagcgattctctggctccaactctgggaacacggccaccctgaccatcaggcggggtcgaaggccggggatggaggccgactatttctgtcagctgtgggattctcatgatggtagtgggggaatcgttcggcgggtagggaccgaggctggaccgtcgtagtcacgcccgaaggcctcgccccctcggtccacgtcctcgttccccnccctcctcgtacg

SEQ ID NO: 249433 - DNA, 593 bp, Homo sapiens
  misc_feature: GYAE6OF01B0XHW.9.25.C03.1.454.CMB.1.raw
tcagtgatacgtctcacgaccggtgctcgatttagtagtgtagatttgggtttgggagtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaaacaaataatgtgcattggaccagcagaagccaggccaggcccctgtcctggtcgtctttgatgatagtgaccggccctcgagggtactccctgacgcgattctctggctccaactctgggaacacggccacccgtgaccatcgaggcggggtacgaacggccggggatggacggccgactagtttctgtcagctgtgggtattcgtcagtgagtggtaggtgggggaatcggttcggacgggagggaccgagggtcgtaggacccgtccgtaacgtcgacgcccgaaggcctccggtccccccgtcgggtccctaccgtccttcccgttacccccaccccttcccgtccgtaaccgg

SEQ ID NO: 249434 - DNA, 567 bp, Homo sapiens
  misc_feature: GYAE6OF01A78A0.9.25.C03.1.454.CMB.1.raw
tcagtgatacgtctcacgaccggtgctcgatttagtagtgtagatttgggtttgggaacctatgaacattctgtaggggccactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacaattaaaaacaaataatgtgcattggtaccagcagaagccaggccaggcccctgtcctggtcgtctttgatgatagtcgaccggccctcgagggactcccgtgagcgatttctctggctccaactcgtagggaaccaccggccaccctgacccatcgacggcggggtacggaaggccggggatggacggccgactatttctgtcagctggtggattctcatgagtgggtaggtggggtaatcgttcgggcggacgggaccgaggcgtcgaccgtccgtaagccgacgacccgaacggccgtaccgcccccgtcggtcctacccg

SEQ ID NO: 249435 - DNA, 613 bp, Homo sapiens
  misc_feature: GYAE6OF01C58GM.9.25.C03.1.454.CMB.1.raw
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtcggcccctggaaagacggccagcataacctgtgagggagacaaacaattaaaaacaaataatgtgcattggtaccagcagaagccaggccacggcccctgtcctggtcgtctttgatgatagtcgaccggcctcgagggactcccgtgacgcgacttctcgtggcctccaaactcgtagggaacaccggccacccgtgaccatcgaggcgggtacgaacggccggggagtaggacggaccgtacgtaagtttcgtgtcgagtcgtggttgggtatttcgtactagtgagtgggtagggtaggggtaattcggttacggggacgggacgggaccgacgggcgtacggtacccggtaccgtaacggtccgacggaccccgaacggcccgtaccggacccccgtcgggtccaccgttcccg

SEQ ID NO: 249436 - DNA, 630 bp, Homo sapiens
  misc_feature: GYAE6OF01A5H8W.9.25.C03.1.454.CMB.1.raw
tcagtgatacgtctcacgaccggtgctcgatttagtagtgtagatttgggtttgggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtccctggtcgtctttgatgatagtgacccggccctacgagggactccccgtgacgcgtattctcgtcggcctccaaacttcgtagggaaccaccggcccacccgtgacccagtccgaggcggggtacggaacgggccggggatcggacggccgtacttagtttcgtgtcgagtcgtggtgggtacttcgtacgagttgtacgttaggggttagggttaggggggtaattcggttacgggcgggacgggaccgacgggcgtacggtacccgttaccgtaacggtccgaacggacccgaaacgggtccgtacccggtcccccgtccggtccctaccgttcccg

SEQ ID NO: 249437 - DNA, 626 bp, Homo sapiens
  misc_feature: GYAE6OF01AZSSX.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacaattaaaacaaataatgtgcattggtaccagcagaagccaggccaggcccctgtcctggtcgtcttgatgatagtgaccggccctcagggactccctgacgcgatttctctggcctccaactcgagggaacacggcccaccctcgaccatcgacggcggggtacgaagggccggggatcggaggccgtacgtactttctgtcaggctggtgggattctcgatgagttgggtaggtagggggtaacttcggttacgggcgggtacgggaccgaggcgttacggacccgttccgtaacgtaccgaccggacccgaacgggtccctcccggtcccccgtccggtcccgacccgttccgttcccgttaccccctaccccttccctccgtaacggtaacccg

SEQ ID NO: 249438 - DNA, 671 bp, Homo sapiens
  misc_feature: GYAE6OF01EUNXJ.9.25.C03.1.454.CMB.1.raw
  modified_base (374)..(374): a, c, t, g, unknown or other
  misc_feature (374)..(374): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtcggcccctggaaagacggccagcataacctgtgagggagacaaacaattaaaaacaaataatgtgcattggtaccagcagaagccaggccacggcccctgtcctggtcgtctttgatgatagtcgacccgccctcgagggactcccgtgacgcgtattctcgtggcctaccaactcgtacgggaaacnccggcccacccgtgaccatcgacgggcggggtacgaacggccggggatcggacggccgtaacttacttcgtcgtcagtcgtggtacgggtacttcgtactagttcggtagttgggtagggttacggggtaacgttccggttacggggacgggtaacggggtaccgtacgggtctaccggtacccgttacgtaacggtaccgaccggacccgtaacgggcccgtcccggccccccgttcggccctaccgttcccgttacccggttcccccgtaccccgttccctccgtacggtaaccg

SEQ ID NO: 249439 - DNA, 816 bp, Homo sapiens
  misc_feature: GYAE6OF01C4BRM.9.25.C03.1.454.CMB.1.raw
tcagtgatacgtctcacgaccggtgctcgatttagtagtgtagatttgggttgggggtggagggttgagaacctatgaacattctggtaggggccaccgttctcctcctcggcctcctctctcactgcacagtctttgtagactctgtgaccttcatgtgctgactcagccaccctcggtgtcagtggcccctaggaaagcggccagtcataacctggtggacgggagacaaacaattaaaaactaaataactgtagctagttaggtaccagacaagaagccgaggccacggccctgtcctggtcgtctttgatgtatacggtgaacccggccctcgacgggactccgtaggacgtcgtattctcgtcggtcctacctaacgtcgtacgggaacctaccgggacctaccctacgaacctacgtcgacgggccggggtacgaacgggccgggatacggacggtaccgtacttacgttacgtcgtacgtaggttacgtgggtttaacgggtctttaccgttcgtaaacggtggttaaggtttacggggttaacggggttacggggggttaacctttccggggttttacccgggggaaccggggtaacccgggggttaccggaacggggttacccgttaccggggtaaaccccgggtttacggtaaaaccgggtcccgtaaaacgggaaccccgtaaaccggggtccgttacccccgggttccccccggttacggggttacccctaacccgtttcccgttccccggtttaaccccccgttaccccttccccggttaaccgtaccgggtttaaacccccg

SEQ ID NO: 249440 - DNA, 783 bp, Homo sapiens
  misc_feature: GYAE6OF01DNM0S.9.25.C03.1.454.CMB.1.raw
  modified_base (226)..(226): a, c, t, g, unknown or other
  misc_feature (226)..(226): n is a, c, g, or t
  modified_base (370)..(370): a, c, t, g, unknown or other
  misc_feature (370)..(370): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtcggcccctaggaaagacggccagcataacctgtgaggganaacaacaattaaaacaataatgtgcagttggaccagcagaacgccaggccaggcccctgtcctggtcgtcttgatgatagtcggaccggtcctagaggactccgtgagcgtattctcgtcggcctaccaactcgtacgggaacnccggacccaccgtcgaccagtcgacgggtcggggtacgaacgggccggggaatcgggacggtaccgtaacgtttacgtttcgtacggttacgtacggtcgttagggtacgggtactttacgttacgtaaggttaggtaaggtttaggggttaaggggttacgggggtaacgtttcgggttaccggggaccgggggtaacggggtacccggtaacggggtaccgttaccgggtacccgggttaaccgttaaacggttacccgaaccggtaccccggaaaccgggttccccgtaccccgggttacccccccgggttaccgggttaccccgttaaccccgtttccccggttccccggttttacccccccggtaccccccgtttccccgtaaccggtaacccggtttaaaccccggg

SEQ ID NO: 249441 - DNA, 576 bp, Homo sapiens
  misc_feature: GYAE6OF01BIXTL.9.25.C03.1.454.CMB.1.raw
  modified_base (310)..(310): a, c, t, g, unknown or other
  misc_feature (310)..(310): n is a, c, g, or t
  modified_base (465)..(465): a, c, t, g, unknown or other
  misc_feature (465)..(465): n is a, c, g, or t
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaaacattaaaacaaataatgtgcattggtaccagcaagaacgccaggccacggcccctgtcctggtccgtcttgntgatagtcgacccggccctcgagggtactcccgtgacgcggattctctcggcctaccaactcgtacgggaaccaccggccaccctgaccatcgaggcgggtacgaacggccggggatggacggccgtacttacgttcgtgtcagctggtggcttntcatgagtgggtacggtggggtaattcggtcgggcggacgggaccagggcgtaggaccgttcaagtccgaacgcccaacggtcctaccggcccccgttcggctcgttcccg

SEQ ID NO: 249442 - DNA, 653 bp, Homo sapiens
  misc_feature: GYAE6OF01AP2SR.9.25.C03.1.454.CMB.1.raw
  modified_base (235)..(235): a, c, t, g, unknown or other
  misc_feature (235)..(235): n is a, c, g, or t
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagcccaccctcggtgtcagtcggcccctggaaagacggccagcataacctgtgaggganacaacattaaaacaaataatgtgcattggtaccagcagaagccaggccaggcccctgtcctggtcgtcttgatgatagtcgacccggcctcgagggactccccgtggacgtcgtactttctcgtcggctacccaactcgtacgggaaccaccgggacccacccgtgaccctagtccgacgggtcggggtacggaacgggccggggagtcggacgggacccgtacgttacgtttcgtcgtacgacggtcgtggttacgggtattccgtcgtagtgtagttggggtagggttagggggaacgttcggtacgggacgggtagggacccgagggtccgtacggtacccgttaccgtaacggtcccgacggaccccgaacggtcccgtacccggccccccgtcgggtcccgtccgttccccgg

SEQ ID NO: 249443 - DNA, 637 bp, Homo sapiens
  misc_feature: GYAE6OF01A6EHI.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcgagggatccctgagcgattctctggcctccaactcgtcggaacacggcccaccctgaccatcgaggcggggtacgaacggccggggatcggacggccgacgttactttcgtgttcgagtcgtggtgggtactttcgtacagttcggattcgggttagggtagggggtaacttcggtttacgggacgggacggggaccgacgggcttcgggacccgttccgtaacggtccaaccggtccccgaaggtcccgtcccggacccccgttcggtccctaccgttccgttcccgttacccctaccccgtcctccgaacggttaacccg

SEQ ID NO: 249444 - DNA, 609 bp, Homo sapiens
  misc_feature: GYAE6OF01BGLC9.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactcgtgggaacacggccaccctgaccatccaggcggggtacgaacggccggggatcggacggccgacttatttcgtgtcagcgtgtgggattcgtctatggagttgggtaggtgggggtaattcggttacgggcgggacggggtaccgagggtcgtcggtacccggtccgtaaggtccgacggaccccgaacgggcctaccggccccccgttcggtcccgaccttccgttaccgttcccccgccctcccgttccgacgtacccg

SEQ ID NO: 249445 - DNA, 753 bp, Homo sapiens
  misc_feature: GYAE6OF01C1C9G.9.25.C03.1.454.CMB.1.raw
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcaggtcggcccctaggaaagaccggccagcaataacctgtagagggagaacaacaattaaaaacaaataatgtagacagttacggtaaccagacaaggaaacgccaggacccaacgggccccctggtcctggtccgttcgtttgagtgaagtcggtacggacccggccctacgagggtacctcccgtgacgtcgtattcctacgtcggcctaccgaaacgttcgacggggaaacccacccgggtacccaaccccgtacggaaccctaacgtcgaacggggtaccggggtacggaacgggcccgggggtaagtcgggacgggtacccgtaacgttacggttttcgtacggttctaaggtcgtttacgggtacggggttaacttccgttagtaacgtttagggtacggtttagggggttacggggttagggggttaaacgtttccgggttaccgggggacggggtaacggggtaccgacgggtccgtacgggtaacccgttacgtaacggtaccgacgtacccgaggtcccgtacccgccccgttacggtcctccgttacccgg

SEQ ID NO: 249446 - DNA, 721 bp, Homo sapiens
  misc_feature: GYAE6OF01BNJC4.9.25.C03.1.454.CMB.1.raw
  modified_base (231)..(231): a, c, t, g, unknown or other
  misc_feature (231)..(231): n is a, c, g, or t
  modified_base (495)..(495): a, c, t, g, unknown or other
  misc_feature (495)..(495): n is a, c, g, or t
  modified_base (584)..(584): a, c, t, g, unknown or other
  misc_feature (584)..(584): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcacgcccacccgtggtgtcaggtcggcccctaggaaagaccggccagcataacctggtgaggganaacaactaaattaaaaacaaataatgtagctagttcggaccagcaagaacgccgaacggccgacgcccctgtcctggtccgttctttgatgatacggtacggacccgcctacgaggtacctcccgtagacgcgtacttctcgtcggcctaccgtaactcggtaggaaccaccggtcccaaccgtcggaacctagtccggaacggggtccgggtaacgaacgggcggtacgacgggaccggtacgttaacttgtttcgacggtcncggttacgttgggtacgtacttccgtagtagtagtagggtggttaaggggtcgggttacttcgggtacgggacgggaaccggtaaccgngggttactaccggtacccgttacgtaacgtccgaccgtaacccggcggtacccgtccccggaccccggtttggcccctacccgttttccggtcccccgttacccccgtacccgttaccgtaacggtaccggttaccg

SEQ ID NO: 249447 - DNA, 680 bp, Homo sapiens
  misc_feature: GYAE6OF01A8F4H.9.25.C03.1.454.CMB.1.raw
  modified_base (283)..(283): a, c, t, g, unknown or other
  misc_feature (283)..(283): n is a, c, g, or t
tcagtgatacgtctcacgaccggtgctcgatttagtagtgtagatttgggtttgggggtgagggttgagaacctatgaacattctgtagggccaccgttctcctcctcggcctcctctctcactgcacagtctttgtagactctgtgaccttccatgtgctgactcagccaccctcggtgtcagtggcccctggaaagacggccagcataacctgtgagggagacaacaattaaaacaaataatgtgcattggtaccagcaagagccaggccagccctgtccngtcgtacttgatgatagtgaccggcctcgacgggactcccgtgacgcgacttcgtcgtggtcctaccaacgtcgtagggaaccaccgggccctacccgtcgaacctaatcgacgggccggggtacgaacgggccggggtatacggacggacccgtaacttacgtttcgtgttcgaacgtcgtagggtcgggtatttccgacgtagtggtagttaggggtagggttaggggtaacttccgggtttacgggaccggggtaacggggacccgagggtccgtaaccgggtacccgttacgtaaccggtacgaccggtacccgaagggtccctcccggtcccccgttacgggtcctaccgttccgtacccggttccccacccgttcctacgtacggtaaccc

SEQ ID NO: 249448 - DNA, 579 bp, Homo sapiens
  misc_feature: GYAE6OF01BMCPB.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgacccggccctcgagggatccctgacgcgtattctctggcctccaactctagggaacacggccacctgaccatcaggcggggtcgaacggccggggatggacggccgactatttctgtcagcgtgtggattctcatgagtgggtaggtggggaatcgttacgggcgggagggaccgaggctacggacccgtacgtaacgtcacgcccgaaggcctccgacccccgtggtaccctaccgttccctttccccaccccttccctcgtacgtccgtacg

SEQ ID NO: 249449 - DNA, 741 bp, Homo sapiens
  misc_feature: GYAE6OF01AJ3GY.9.25.C03.1.454.CMB.1.raw
  modified_base (224)..(224): a, c, t, g, unknown or other
  misc_feature (224)..(224): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgaggganacaacaattaaaaacaaataatgtgctattggtaccaggcagaagccgaaggccacggccctgtccgtggtcgtcttgatgatagtgaccgcctagaggactccgtagacgcgtattctcgtcggtcctaccgaactcggtacgggaaccgtaccggacccgaaccctcgaaccctagtccgaacgggtccggggtacggaaacgggcccgggggtatacgggacggtacccgtaacgtttacgtttacgtgttaccgaggtacgttgggttacgggtacttttcctaacgtacgttacgtaggttcgggttaacgggtaggggggtaacttccgggttacggggacggggtaacgggacccgaaggtcggtacggtaacccggttaaccgtaacggtaccgaaccggaaccccgtaacgggtccgtcccggtccccccggttccgttacccgaacccgtttcccgttaccccggttcccccgtaaccccgttcccgttaacccgacggtaaacccg

SEQ ID NO: 249450 - DNA, 720 bp, Homo sapiens
  misc_feature: GYAE6OF01A4JHU.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtcgacccggccctagacgggtactccctggacgcgtactttctcgtggcctaccaactcgtagggaacctgtcggacccacccgtgaacccatccgaggccggggtacgaacgggacccggggatcggacggcccgtacttacgtttcgtgtccgaggtccgttgggtcgggtactttccgtacgtagttaggtaggttaggggttaggggtagggggtaacttccgggtttacggggaccggggtaggggtaacccgtagggtacccgtacggtaaccccggttaccgtaacggttacccgacggtacccccggtaaagggtcccgtaccccggtcccccccgttaccgggtcccgtaacccgttcccgtttacccgttacccccccgtacccctttccccgtccggtaaacccgg

SEQ ID NO: 249451 - DNA, 762 bp, Homo sapiens
  misc_feature: GYAE6OF01E0VFI.9.25.C03.1.454.CMB.1.raw
  modified_base (179)..(179): a, c, t, g, unknown or other
  misc_feature (179)..(179): n is a, c, g, or t
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
tcagtgatacgtctcacgaccggtgctcgatttagtagtgtagatttgggtttgggaggtgagggttgagaacctatgaacattctgtagggccaccgttcctcctcctcggcctcctctctcactgcacagtctttgtagactctgtgaccttcatgtgctgactcagccacctggtntccagtcggccctggaaacgcggcagcactacctgtgagganacaacaattaaaacaaattaatgtnactagttcggtaccagacaagaacgccgacggccacgtccctgtcctggtcttcttgatgatagcgaccgtcctagacgggctcccgtgacgcgtacttcgtcgtggcctacacgtcgagggacctaccggccaccctacgacctagtccgacgggtccggggtaacgaaccgggccggggtaagtaccgggaaccgggtacccgttaacgtttacgttttaccggtacggttaccgtaacggttccgttacgggtttacggggttaactttccggttacgtaggttacggtaaggtttcggggttaacgggttcgggggttaacttccggggtttaccggggtaccgggggtaacggggtacccggtacggggttccgtaccgggtaaccggttaccggtaacgtcccggaaccgtacccgggtaacgggtcccgttaccccggtcccccggttcggtacccctacccgttcccggttacccgttcccccgttccccttacccgtcgtaacccgg

SEQ ID NO: 249452 - DNA, 762 bp, Homo sapiens
  misc_feature: GYAE6OF01C7TBE.9.25.C03.1.454.CMB.1.raw
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgagactctgtgaccttccatgtgctgactcacgcccaccgtcggtgtcaggtcggccccgtaggaaacggaccggccagcaacgtaaccgtggtaggagggacgaacaaactaaattaaaaacaaaagttaataggtcactaagttcggaaccagacaagaacgaccgacggaccaccggtcccctggtcccgtggttcgtcgtttgacgtgtagtacggtaccggacccggtccgtacggacgggtacttccccgaggacggtccgtatttccgtcgtcgggtacccttacccgaaacgttcggaacgggtaacccgacccggccccaaccgtacgaccaccgtacggaacgggccggggtaccggaacggggtaccggggacgtacgggaacgggtacccgttacgttacgtttaccgtcgggtactacggtcgttaggggttacgggttacttcggtacgtagtacggtaggtaggggttaggggtagggttacgtccgggttacggggacgggtacggtaccggacggtacgtacggtacccggtacgtaacggtccgaacggacccgacgggtcccgtacccgtacccccggtcggtccctccggttccccg

SEQ ID NO: 249453 - DNA, 700 bp, Homo sapiens
  misc_feature: GYAE6OF01B9HW4.9.25.C03.1.454.CMB.1.raw
  modified_base (430)..(430): a, c, t, g, unknown or other
  misc_feature (430)..(430): n is a, c, g, or t
tcagtgatacgtctcacgaccggtgctcgatttagtagtgtagatttgggtttgggaacctatgaacattctgtaggggccactggtggtgcctcagccatggcctggaccgttctcctcctcggcctcctctctcactgcacagtctttgtagactctgtgaccttccatgtgctgactcagcccaccctcggtgtcagtcggccctaggaaagacggccagcataacctggtagagggagaacaactaattaaaaacaaataagtgtagactagttcggaaccaggacaagaacgccgaggcccacgggtccccttggtccgttggtccgttctttagagttgattacggtcgacccggcctacggacgggtactcccgtagacgtcgtacttcgtctacggcctaccgaacttcggaacgggaaccnccggaccctaccgtagaccatcggacgggtcgggtacgaacgggccgggtagtacgggacgtaccgtattacgttcgtgtacgtagtcgtaggtaggtacttcgtacgtaaggtggtaggttacgggtagggttacggggtaacttcggtcggggtaccgggacgggaccggacgggtccgtaccgggtaaccgtacccggttaaggtacccgaaccggtacccgtaaccgggtcccgtaccccggtccccgttcggtaccgttaccccg

SEQ ID NO: 249454 - DNA, 617 bp, Homo sapiens
  misc_feature: GYAE6OF01EPPBK.9.25.C03.1.454.CMB.1.raw
  modified_base (275)..(275): a, c, t, g, unknown or other
  misc_feature (275)..(275): n is a, c, g, or t
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtcggcccctggaaagacggccagcataacctgtgagggagacaacaattaaaacaaataatgtgcattggaccagcagaanccaggccaggcccctgtcctggtcgtctttgatgatagtgaccggcctcgagggactccctgacgcgtattctctggcctccaaactcgtcggaacaccggccacctgaccatcgaggcggggtacgaggcgggatggacggccgattagtttctgtcagtctggtggtactttctacgagtaggacgttaggggtaagggttagggggtaacttccggttacggggaccggggtaacggggtacccgaaggggtcccgtacgggtaccccggttacgtaacgggtccgacggaccccggaacggccgttacccgccccccggttcggtaccaccgttcccg

SEQ ID NO: 249455 - DNA, 771 bp, Homo sapiens
  misc_feature: GYAE6OF01CB836.9.25.C03.1.454.CMB.1.raw
  modified_base (252)..(252): a, c, t, g, unknown or other
  misc_feature (252)..(252): n is a, c, g, or t
tcagtgatacgtctcacgaccggtgctcgatttagtagtgtagatttgggtttgggggtgagggttgagaacctatgaacattctggtagggccaccgttctcctcctcggcctcctctctcactgcacagtctttgtagactctgtcgaccttccatgtgctgactcacgcccacccgtggtgtcgaggtccggaccccgtagggaaaacggaccggccagactaacttaaaccgtggtaggaaggggaanaaaccaaaactaaaactttaaaaaacaaaagttaaatcgtagaccttagttacggaaccagacgaaaggaacgccgacggacccgacggtcccctgtccttggtcgttacttgatgaagtacggtccggacccggtcccgtcggaacgggtcctccgtaggacgtacgtacgttccgttacgtcggacctaccgaacgttccggtaacgggaaaccctacccggacccaccgtacgaaacctagtaccggaccggggaccgggggtaacggaacgggccggggtaagtacgggaccggacccgttacgtttaacgtttcgtcggtacgtacgttcggtacgggttcggtacttcgttacgtacgttaggtaggtgggttaagggtacggggtacgttcgggtaccgggcgggacggtcggagtccgttacggaccgttacgtagaccgaccgacggacgtcccgtcccggccccgttgccctcgttccgtacccttccccaccttccctcgacgtaccg

SEQ ID NO: 249456 - DNA, 671 bp, Homo sapiens
  misc_feature: GYAE6OF01BLDK8.9.25.C03.1.454.CMB.1.raw
  modified_base (224)..(224): a, c, t, g, unknown or other
  misc_feature (224)..(224): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (444)..(444): a, c, t, g, unknown or other
  misc_feature (444)..(444): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccacctcggtgtcagtcggccctaggaaacgcggccagcataacctggtgagganacaacaattaaaacaataatgtgactagttggtaccagcagaacgccgaggccacggccctgtccgtggtctcttgatgatagcgaccgcctcgaggtctccgngagcgtattctctcggcctaccaacgtcgtacgggaaccnccggccctacctcgacctacgtcggacgggtcgggtacgacgggacgggatcggacggtccgtacttacgtttcgngtcgacgtgtagggtggtacttcgtcgtagtgtaggttacggtagggtacgggtactcgggtaccgggacgggaccgggtacgacgggttacgtccggtacccgtcgtaacggccgtaaccggacccggtaacggtcccggttccccggaccccgttcggtacccgttacccgttcccgttaccccgttacccccgtaccccgtttaccgtcccgtaacggtacccg

SEQ ID NO: 249457 - DNA, 674 bp, Homo sapiens
  misc_feature: GYAE6OF01D56ON.9.25.C03.1.454.CMB.1.raw
  modified_base (238)..(238): a, c, t, g, unknown or other
  misc_feature (238)..(238): n is a, c, g, or t
tcagtgatacgtctcacgaccggtgctcgatttagtagtgtagatttgggtttgggaacctatgaacattctgtaggggccactggtggtgcctcagccatggcctggaccgttctcctcctcggcctcctctctcactgcacagtctttgtagactctgtgaccttccatgtgctgactcagcccaccctcggtgtcagtcggccctaggaaagcggcagcataacctgtgaggganacaacaattaaaacaaataatgtgactattggtaccagcagaagccaggccaggcccctgtccgtggtcgttcttgatgatggtcgacccgcctgacggtactcccgtagacgtcgtattcgtcgtcggcctacccaaacgtccgtaacgggaacccaccgggacccctacccgtgaaccctagtaccgacgggccgggggtacggaacgggacggggtaagtcgggacggtccgtacgttacgtttcgtcgtacgtagtcgttaggtggtacttcgtagtacgtagtaggttagggttaagggtacggggtaagttccgggtacggggacgggtacggggaccgacgggtccgtacgggtacccgttacggtaccggtaccgaccggacccggtaacggtcccgtacccggtccccccggttcggtccctacccg

SEQ ID NO: 249458 - DNA, 797 bp, Homo sapiens
  misc_feature: GYAE6OF01BQY2A.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtcgaccttcatgtgctgactcacgccctacctggtgtcaggtccggaccccgtaggaaacgccggccagctacgtaaccgtggtaggaagggacaacaaactaaagttaaaaacaagttaatggtacgtactagtttaccggaactacgaccgaagaaccgccggacgcccgtaccggtcccttcggtccgttcggttaccgttgttacggtataggtacgttaacggtccgggaaccccgtcccgtacggacgggtacctccggtagacgtcgttaccgttctaccggtaccggtacctaccgtaacgttacgggaccgggtaaaccgacccggaccctaaccgtacgaccgtacgtccgggaccggggtaccggggtacggaacgggtccggggaacgttacggaccggtacctttattacgtccgtgtaccgtggtcggtaacgtggttacctgagttaggtgagggtggtaagggacggtcgtacgggtaagggccggtaaaggccgtcgggactaacccggttcggtacgaacgttcccggaaccggtacccgtacggtccggtacccccgttcccggtaacgtaccccgttaccggttccccgttaccccgcccccttaaccctcgggaacttaccgggtacccg

SEQ ID NO: 249459 - DNA, 768 bp, Homo sapiens
  misc_feature: GYAE6OF01ALQBY.9.25.C03.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (258)..(259): a, c, t, g, unknown or other
  misc_feature (258)..(259): n is a, c, g, or t
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (394)..(394): a, c, t, g, unknown or other
  misc_feature (394)..(394): n is a, c, g, or t
  modified_base (571)..(571): a, c, t, g, unknown or other
  misc_feature (571)..(571): n is a, c, g, or t
tcagtgatacgtctcacgaccggtgctcgatttagtagtgtagatttgggtttgggaacctatgaacattctgtaggggccactggtggtgcctcagccatggcctggaccgtttctcctcctcggcctcctctctccactgcactagtcttttgtagactctggtcgaccttccatgtgctgacctcacgcccacccgtggtntcaggtcggccctggaagcgccagcatactgngagganacanataaacatatgnntagtcgacagcagacgcaggccacgcccctgtccgtggtctcttgntgatcggtcgaccggtccctaggacggtcctccgtanacgcgtacttcctcgtcggaccttaccgaccgttactaccgggggaaacccnccgggtacccacccgtactaacccgtaagtccgggtaccggggtccggggtaccgggtaacgggggtaccggggacgttaaccggggacccggtaacccggttacgttttacctttaccgggtcgggttacccaacgggtttcggtaacgggtttccgggttaactttacccgggtntaagggttcggtaagggggttacgggttaacgggggtttaacggggtacccgtttcgggggttaccgggaaccggggggtacggttaccgggaacggtttccggacccggtttaacccgggtaccgttaaccgtcgggaaccccgcgggttaaccggccccttccccgggacccccgtttgggaacccttccccggg

SEQ ID NO: 249460 - DNA, 777 bp, Homo sapiens
  misc_feature: GYAE6OF01BDHCO.9.25.C03.1.454.CMB.1.raw
  modified_base (344)..(344): a, c, t, g, unknown or other
  misc_feature (344)..(344): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagcggccagcataacctgtgagggagaacaacaattaaaaacaaataatgtgcattggtaccagcagaagccaggccaggcccctgtcctggtcgttctttgatgatagtgacccggcctgagggactcccgtagacgcgtattccncgttcggctacccaacgtccgtacggggaaacctacccgggacccacccgtcgaacccgtataccggaacgggtccgggggtaaccggaaacgggtcccgggggtaattacgggaaccgggtacccgtaacgttacgttttaccgtgtaccgtaacgccgttagggtacgggtacttaccgttacgtacgttaggtagttaggggtacgggttagggggtaactttccgggtttacggggaccggggtaaggggtaacccgtagggtaccgttaccgggtaacccggttaccgtaaacggttcccgaaaccgggaccccgtaaacgggtcccttacccggacccccccggttcgggtacccctaacccggtttcccgttcccggtttaccccccctaacccccgttcccgttacccgtaaccgttaaacccgg

SEQ ID NO: 249461 - DNA, 842 bp, Homo sapiens
  misc_feature: GYAE6OF01BWALF.9.25.C03.1.454.CMB.1.raw
  modified_base (377)..(377): a, c, t, g, unknown or other
  misc_feature (377)..(377): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagcggcagcataacctgtgagggagacaacaattaaaaacaaataatgtgcagttggtaccagcagaacgccaggccacggcccctgtcctggtcgtcttgatgataggtcgaccggccctcgagggactcccgtggacgcgtacttcgtcgtggcctaccaacgtcgtacggggaaccnccgggaccctacccgtacggaaccacgttaccgaacggggtccgggggtaacggaaacggggcccggggtaagttacgggaaccgggacccggttaaacgtttacgttttaccgtttacggttacccgaacgggttccggttgggttcggggttaacgtttaccgttacgtaagtttagggtaaggttggggtttaaggggttaacggggggtaacgtttaccgggtttacccgggggtaccggggtaaaccggggtaacccggtaacggggttacccggttaccgggtaacccggttacccggttaaacggtacccggaaccggtacccccgggtaaacgggtccccggttaccccggtcccccccggttcccgggttaccccgttaccccgtttaccccgtttaccccggtttaccccccttaccccccgtttaccccgttaccgtaaccggttaaaccccgg

SEQ ID NO: 249462 - DNA, 868 bp, Homo sapiens
  misc_feature: GYAE6OF01CL0NQ.9.25.C03.1.454.CMB.1.raw
  modified_base (222)..(222): a, c, t, g, unknown or other
  misc_feature (222)..(222): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgactgactcacgcccaccttcggtgtcaggtcggcccgtaggaaacgcggccagcactaaccngtggaggagacaaactaattaaaacgaataatgtgactagttacggaccagcgaagacgaccgaggccgacgtcccctgttccgtggttaccttgttagagttgagtacggtccgacccggtccctaggaccgggtactcccgtaggaccggtcttacgttctaccggttcggacccttacccgaaacgttccggaaacgggaacccgtacccggaccccgtacccgtacgaaccgacgttacgggaccggggtaccgggggtaacggaaaccgggtccgggggtactcggggtaaccggtaccggtttaacgtttaccgtttccgtacggtacgtcggtacggttagggttacggttacgttcgtaacgtagtacggttaacgggttggggttaacgggggttaggggtaaccggtttcccgggttaacgggggccggggtaaaccggggtaccggttaacggggtacccggttaaccgggttacccggttaaacccggtaacggtaccccggaaccggtaccccggtaacgggtccccggttaccccggtacccccgggttcggttaccccgtaacccgtttccccggtttaccccggtacccccttacccgtttacccggtaaccccggttaacggtaacccg

SEQ ID NO: 249463 - DNA, 770 bp, Homo sapiens
  misc_feature: GYAE6OF01AJZO2.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagttctttgtagactctgtgaccttcatgtgctgactcacgccacccgtcggtgtcagtcggccccgtaggaaaggcggccagcataacctggtggagggagaacaaactaattaaaaacaaataatgtgctagttcggtaccagcaagaacgccgacggccgaccggcccctggtccgtggttcgttcgttgatgtagtacggtcgacccggccctcgacggactcccgtgacgtcgtacttctcgtcgtacctacctacgtcgtacgggaaccgacccggacccacccgtacgaacctacgtacggacggggaccggggtaccggaacggggacccggggtagtacgggggaacggtacccgttaacgtttacgttttccgacgtaccgaaggttcgttagggttacgggtactttcgctaggtggtaagggtttggggtaggggttacgggtacgtttccgggtaccggggacgggtaacgggtacccgtggtaccgtaccggtaccgttacgtaaccggtccggaaccgaccgggtaccggtccccgttaccccggtcccccggttcggacccgtttacccgttcccggttacccccggtaccccccgtacccgtccgttaacggtacgttaacccg

SEQ ID NO: 249464 - DNA, 764 bp, Homo sapiens
  misc_feature: GYAE6OF01DXLJC.9.25.C03.1.454.CMB.1.raw
  modified_base (217)..(217): a, c, t, g, unknown or other
  misc_feature (217)..(217): n is a, c, g, or t
tcagtgatacgtctcacgaccggtgctcgatttagtagtgtagatttgggtttgggggtcacaagaggcagcgctctcgggacgtctccaccatggcctgggctctgctgctcctccaccctcctcactcaggacacacgggtcctgggccctgtcctcgccctgacctcacgcctgccctccgtgtcgtgggtctccgtggacagtcgatccaacnttcctcctgccacgtccggacccaccactgtacttagttcgggacttaactttacgttaaccttttcgtaccttccgttacggtaactaccaaaaccaaccgacccgaaacgaaccaaaacccgccccccctaacctaacctttaccttttaaagtttagtacgggtacggtaaccgtaaccgtaccggcccgggtacccgtttcgggttaacggggttttcgttcggttccgtcgtttacctcctaccgacccgtacgtaacgtccgttacggacccaaaccgtcccggtcccctcccgtaacgaacctaacgttcctccggttcggtcctacgtcgtcgtacgacggaggtcgtgtacgtaactttactacgtcgctacgtcctattattacgtgtacttacggtttcctttacccttactttaacgagttacgttacggtcggggtaaccggggtccgtacggccggtgtaccccggttacgttcccgttagtcccgtacgaccggtacccacgggtcccctcccgttccccggtcgttacccg

SEQ ID NO: 249465 - DNA, 870 bp, Homo sapiens
  misc_feature: GYAE6OF01B0DSJ.9.25.C03.1.454.CMB.1.raw
  modified_base (161)..(161): a, c, t, g, unknown or other
  misc_feature (161)..(161): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgntgactcacgccacccgtcggtgtcgaggtcggccccgtagggaaacggaccggaccagaccaacttaaccgtggtaggaagggaagaaccaaaactaaattaaaaaacaaaattaagtgtagactaagttacggtaaccgagaccaaggaacgccgaacggcccgaaccggtccccttggttcccgtgggttccgtttcgtttagagtaggtagttaacggtccgggaccccggtcccgtacggaacggtccgtacccgtggaacgtcgtactttccgtcgtacggtcctacgaccgttacgacggaaccgaccgggtacccctaccgtacgaccgtacgaccggacggggtaccgggtaacggacgggaccgggttacggtacgggaaccggttaccgtttaacgttttacttcggtacgtacggtacgttcgggttaggtacgtttcttaaccgttggtaaccgttggggttaaggttacgggggtttaggggttaaccggggtaacgttttccggggacggggtaacccggggaagggtaaccccgtagggttcccgggttaaacccggttaccggttaccgtaaaccggtcccggaaacggtaccccgggtacccgtccgggttcccctccccgggttaactacccggttacccttccccggtttaaaccctccccaacccggtttaccgtccgtaacgttaccg

SEQ ID NO: 249466 - DNA, 536 bp, Homo sapiens
  misc_feature: GYAE6OF02HB42Y.9.25.C03.1.454.CMB.1.raw
  modified_base (531)..(531): a, c, t, g, unknown or other
  misc_feature (531)..(531): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcgttcggcggagggaccagggctggaccgtccgtaagtcagcccaaggctcgcccctcggtcactctcgttcccaccctcctcngtacg

SEQ ID NO: 249467 - DNA, 567 bp, Homo sapiens
  misc_feature: GYAE6OF02GRKD0.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcgagggactccctgagcgattctctggctccaactctagggaaacgccacctgaccatcagcagggtcgaagccgggatggaggccgactattactgtcaggtgtgggctggtgatatgatcatggcggggttgttcgggcgggacgggaccgaagcgtacggaccgttccgtaagtcacggcccaagggcctccggcccccgtcggtccaccgttccgttccgttccccaccccttcccgtaccacgtaccg

SEQ ID NO: 249468 - DNA, 721 bp, Homo sapiens
  misc_feature: GYAE6OF02GUF77.9.25.C03.1.454.CMB.1.raw
  modified_base (369)..(369): a, c, t, g, unknown or other
  misc_feature (369)..(369): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtcggcccctggaaagacggccagcataacctgtgagggagacaacaattaaaacaaataatgtgcattcggtaaccagcagaagccaggccaggcccctgtcctggtcgttctttgatgatagtgaccggccctcgagggactcccgtgacgcgtattctctggcctccaaactcgtaggaacncggccacctgaccatcgaagggccggggtacgaaacgggtccgggatacggacggtcccgtaagtttacgtttccgtacggttcgtaggtccggttgggtacggggttacttttccgtacgtacgttcggtaaggttacgggttaggggttacggggggttaacgtttccggttaccggggtccggggtaacggggtaacccggtacggggttaccgtaccggtaacccggtttaaccgttaaacgtaccgtaaccggaccccgtaaacgggccgtcccggtcccccggttccggtaccctaccgttcgttccccgttaccccgacccctttcccgtacctaccggtaacgg

SEQ ID NO: 249469 - DNA, 570 bp, Homo sapiens
  misc_feature: GYAE6OF02HAW1J.9.25.C03.1.454.CMB.1.raw
  modified_base (373)..(373): a, c, t, g, unknown or other
  misc_feature (373)..(373): n is a, c, g, or t
tcagtgatacgtctcacgaccggtgctcgatttagtagtgtagatttgggtttgggaacctatgaacattctgtaggggccactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaaacaaataatgtgcattggtaccagcagaagccaggccaggcccctgtcctggtcgtctttgatgatagtgaccggccctcagggatccctgagcgattctctggctccaactcgtagggaacncggccaccctgaccatcaggcggggtcgaacggccggggatggacggccgactagtttctgtcgagcgtggtggtattctcatgtagtggtaggttagggggaattcggttcgggcgggacgggaccgagggcgtcggacccgttaccgtaagtccgtacggcccgaagggcctccggcccccgttcggtcctaccg

SEQ ID NO: 249470 - DNA, 631 bp, Homo sapiens
  misc_feature: GYAE6OF02JAASU.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaaataatgtgcattggtaccagcagaagccaggccaggcccctgtcctggtccgtctttgatgatagtgaccgggccctcaggggatcccgtgagcgattctctggcctcactctgggacacggccaccctgaccatcagcggggtacgaaggccggggatggaggccgactatttcgtgtcagctggtgggtattctcagttgagttagggtagggtaggggggtaagttccggttacggggacgggtacggggacccgtagggtccgttacggacccggttaccgtaaaggtccacggacccgaacgggtccgtaccggccccccgttcgggtaccctaccgttccgttcccggtttaccccgacccccttccctaccgtacgtaacccgg

SEQ ID NO: 249471 - DNA, 607 bp, Homo sapiens
  misc_feature: GYAE6OF02GU240.9.25.C03.1.454.CMB.1.raw
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgacccggccctcagggactcccgtgagcgattctctggcctccaactcgtgggaacacggccaccctgaccatcgaggcggggtacgaaggccggggatggacggccgtactagtttctgtcacgtctggtggattctcagtgagtgggtaggtggggaattcggttcgggcgggtagggaccgagggcgtacggacccgtaccgtaagtccacgacccgaacgggcccgtcccggtcccccgttcggtaccctaccgttcccgttccgttcccccaccccgttccgttaccgacgtaacccg

SEQ ID NO: 249472 - DNA, 616 bp, Homo sapiens
  misc_feature: GYAE6OF02JJIPF.9.25.C03.1.454.CMB.1.raw
  modified_base (479)..(479): a, c, t, g, unknown or other
  misc_feature (479)..(479): n is a, c, g, or t
  modified_base (606)..(606): a, c, t, g, unknown or other
  misc_feature (606)..(606): n is a, c, g, or t
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtcggcccctggaaacgcggccagcataacctgtgagggagacaacaattaaaacaaaataatgtgcattggtaccagcaagaagccagggccaggcccctgtcctgggtccgtctttgatgataggtggacccggcctcgagggactcccgtgagcgtattctcgtggcctaccgaactcgtagggaacaccggcccaaccctgaccatcgacggccggggtacggaacgggccggggagtggacgggccgtaacgttagttccgtgtcgtagtcgtggtaggtnttctgatgtagtgggtagggtggggtaacttcggttcgggacgggtacgggaccgtaggcgtacgtaccggtaccgtacggtaccgtacggacccgaacggtccggtacccgtcccccgtcggtccnccgttcccgg

SEQ ID NO: 249473 - DNA, 734 bp, Homo sapiens
  misc_feature: GYAE6OF02HJ3RM.9.25.C03.1.454.CMB.1.raw
  modified_base (227)..(227): a, c, t, g, unknown or other
  misc_feature (227)..(227): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagcccaccctcggtgtcagtcggcccctaggaaagacggccagcataacctgtgaggganaacaactaattaaaaacaaataaatgtgactagtttcggtaccagacaagaagccgaggccacggtcccctgtcctaggttcgtctttgatgactagtacggaccggtccctacgacgggtactcccgtgacgtcgtaacttctacgtcgggccttaccaacgttcgtacggggaaaccaccgggtacccacccgtagaaccaatccgagggtaccggggtacgaaacgggccggggtatcgggacggtacccgtactttagtttcgtgtaccgagtcgttaggtagggtactttcgtacgtagttacgaggttagggtagggtagggggtaaacttcgggttaaccggggtcgggaaacggggaccgtaacgggtcgttaaccggacccgttacgtaacggaccgtaccggacccgtaaggtcccgttccggacccccggttacggtaccctaccgttcccgttaccgttaccccctacccgttaccgttacccgagttaacccgg

SEQ ID NO: 249474 - DNA, 687 bp, Homo sapiens
  misc_feature: GYAE6OF02HIH0Y.9.25.C03.1.454.CMB.1.raw
  modified_base (442)..(442): a, c, t, g, unknown or other
  misc_feature (442)..(442): n is a, c, g, or t
  modified_base (525)..(525): a, c, t, g, unknown or other
  misc_feature (525)..(525): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagttctttgtagactctgtgaccttccatgtgctgactcagccaccctcggtgtcagtcggcccctaggaaacgaccggcagcaactaacctggtaggagggagaacaaacaaattaaaaaaacaaaagttaaatgtacgtacaagtttcggtaaccagacaaggaacgaccaggccgacggcccctgtccgtggtcgttcttgatgactagtcgaccggtcccagaacggtctcccgtgaacggtcgtactttcgtcgtcggtacctacccaacgtcgtacggggaaacaccggcccaaccgtcgacctaanacgaggaccggggtaggaaacggtccgggggtaatcggacgaccggtaacttacgtttactagttacgagtcgtgggtacggngttacgtactaagtgagttagggtaggtaggggtaacgttcggttacgggacgggacgggaacgacgggtacgtacggtaccgtacgtaacgctacgaccgtaacgtcgaccgtcccgtcgtaaccgtcctacctacgttcccacccgtctaccgacgtacg

SEQ ID NO: 249475 - DNA, 665 bp, Homo sapiens
  misc_feature: GYAE6OF02FWWIN.9.25.C03.1.454.CMB.1.raw
  modified_base (265)..(265): a, c, t, g, unknown or other
  misc_feature (265)..(265): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaaacaaataatgtgcattggtaccagcagancagcacgccctgtcctggtcgtctttgatgatagtgaccggcctacgaggactcctgacgcgtattctcgtggctaccaactcgtagggaaccacgcccaaccctgaccatacacggcggggtacgaacggccggggtatggacggccgacttattctgtcgagcgtggtggtattctctacgtgagttagggtaggtaggggtaacgttcgttacgggcgggtaacgggaccgacgggtcgtacggtaacccggttaccgttaaccggttcgaccgggacccgtaaacgggcccgttacccggtacccccccgttaaccgggttaccctaacccgtttccgtttacccggtttaccccccgtaacccccgtttccccgtacccgtaccggttaacccgg

SEQ ID NO: 249476 - DNA, 697 bp, Homo sapiens
  misc_feature: GYAE6OF02G2APD.9.25.C03.1.454.CMB.1.raw
  modified_base (237)..(237): a, c, t, g, unknown or other
  misc_feature (237)..(237): n is a, c, g, or t
tcagtgatacgtctcacgaccggtgctcgatttagtagtgtagatttgggtttgggaacctatgaacattctgtaggggccactggtggtgcctcagccatggcctggaccgttctcctcctcggcctcctctctcactgcacagtctttgtagactctgtgaccttccatgtgctgactcagccaccctcggtgtcagtcggcccctggaaagcggcagcataacctgtgaggganacaacattaaaaacaataatgtgcattggtaccagcagagccaggccaggcccctgtcctggtcgtctttgatgatgtgacccgccctcgagggtactcccgtgacgcgtattcctcgtcggtcctaccaacgtcgtacgggaaccacggcccacccgtagacccgtatccgaagggtccggggtacgaacgggccgggggtatacgggaacgggtcccgtaacgtttctttcgtcgtacgacgtcgttggtgggtactttccgtagtagttgtaggttaggggttacggggttagggggttaacttccgggtttaccgggggacgggtaaccggggtaccgtaggggtacccgttacgggtaaccccgtttaccggttaaacggtcccgtaaccggtaccccggtaaacggggtcccgttaccccgggtccccccggttacggtacccctttaccccgg

SEQ ID NO: 249477 - DNA, 706 bp, Homo sapiens
  misc_feature: GYAE6OF02G18AT.9.25.C03.1.454.CMB.1.raw
tcagtgatacgtctcacgaccggtgctcgatttagtagtgtagatttgggtttgggagtggagggttgagaacctatgaacattctgtaggggccaccgttctcctcctcggcctcctctctcactgcacagtctttgtagactctgtcgaccgttccatgtgctgactcagccaccctcggtgtcagtggcccctaggaaagacggccaggcataacctgtgagggagacaacaattaaaaaccaaataactgtagactagttacggtaccaggacaaggaacgccaaggacccaacgggccccctaggtcccttcgggtcgttcttttcgatagtatacggtcgaacccggtccctacggacggggtactcccgtaggaacgcggtacttccgtcccggcttaccgaaggttcgtcggacaacgtactcgacgcccttccgtcggacctacgtccaacggtcgggtcctccggaaggtctacggaggtatggacgtactacgtacgttactacgtgtacctaggttaccgagttacgaccgtaggtcgtaaccgtaagtaccgtacgttacgttccgttaaccgaacggtccggaacctagggttaccctaccggttccggtggtacccgaccgaacccgtaaccggcccctaaacccgtacgttccggtaaccctaccgttcccgtttccgtaccccctaccc

SEQ ID NO: 249478 - DNA, 706 bp, Homo sapiens
  misc_feature: GYAE6OF02F4BTZ.9.25.C03.1.454.CMB.1.raw
  modified_base (224)..(224): a, c, t, g, unknown or other
  misc_feature (224)..(224): n is a, c, g, or t
  modified_base (407)..(407): a, c, t, g, unknown or other
  misc_feature (407)..(407): n is a, c, g, or t
tcagtgatacgtctcacgaccggtgctcgatttagtagtgtagatttgggtttgggggtgagggttgagaacctatgaacattctgtagggccaccgttctcctcctcggcctcctctctcactgcacagtctttgtagactctgtgaccttccatgtgctgactcagccaccctggtgtcagtcggcccctgggaaacgcggccagcataacctgtgaggganacaaataattaaaaacaaaataagtgtgactagttacggtaccagccagaaacgccaggaccacggtcccctgtcctggttccgttctttgacttggattacggtcgaacccggtcctaggacgggtactcccgtagacgcgtactttctcggtcggcctacctaacgtcgttacgggaaccnccggacccaccgtagacctacgtacgagggtccgggtaacggaaccggccggggtatacggggaccggtacccgtatttacgtttcgtacgtacgtaggtcgtcgggttagggactttcgtacgtagttcggaaggtttcggggtagggttacggggtacttcggttacgggacggacgggacgcggtccgtaacgtacccgttaacgtacgtaccgtacggaaccgtacggtcccgtacccggccccgtacgttccacgttccgtcccttacccgccctaaccgttcgtacgtaaccg

SEQ ID NO: 249479 - DNA, 690 bp, Homo sapiens
  misc_feature: GYAE6OF02HQ1V2.9.25.C03.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (354)..(354): a, c, t, g, unknown or other
  misc_feature (354)..(354): n is a, c, g, or t
  modified_base (403)..(403): a, c, t, g, unknown or other
  misc_feature (403)..(403): n is a, c, g, or t
  modified_base (492)..(492): a, c, t, g, unknown or other
  misc_feature (492)..(492): n is a, c, g, or t
tcagtgatacgtctcacgaccggtgctcgatttagtagtgtagatttgggtttgggaacctatgaacattctgtaggggccactggtggtgcctcagccatggctggaccgttctcctcctcggcctcctctctcactgcacagtcttttgtagactctgtgaccttccatgtgctgactcagcccaccctcggtgtcagtcggcccctaggaaacgcggccagcataacctgngaggagacaanaattaaaacaaataatgtancagttcggtaccagcaagaacnccacggccacggcccctgtcccgtggtcttctttgatgatagtgggaccccgtccgtagagggtccncccgtgtacgcgtattccgtagtcggtctaccaacgttcgacgggaacncccgggaccctccctagaccctagtccacgggtacggggtaccgagggacccgggattcgggaacgggtcccttaagtacgtttttcgnggttaccaggtccgttggggttacggttcttactaccgttagttaggtaaggtttgggttaacggggtgggttaaaccggttccgttccgggggacggggaacgggtacccgtacggggtccgacggtcccggttaaccgttaacggccgaaccggtcccgtagtcccgtcccggtacccccttggtaaccccgtccg

SEQ ID NO: 249480 - DNA, 645 bp, Homo sapiens
  misc_feature: GYAE6OF02HN7Z9.9.25.C03.1.454.CMB.1.raw
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (394)..(394): a, c, t, g, unknown or other
  misc_feature (394)..(394): n is a, c, g, or t
tcagtgatacgtctcacgaccggtgctcgatttagtagtgtagatttgggtttggggtgagggttgagaacctatgaacattctgtaggggccaccgttctcctcctcggcctcctctctcactgcacagtctttgtagactctgtgaccttccatgtgctgactcagcccaccctcggtgtcagtcgggcccctaggaaacgacggccagcaataacctgtagaggganaacaaanaattaaaaacaaataatgtagactattcggaccagcaaggaagccgaggccgacggccccgtgtccgtggtcgttctttgatgatacgtcggaccggtcccgtcgacggacctccgaggacgccgtattcctcgtgcctaccactcgacgggaaccnccggccaccgtcgacagtcgagggcggggtacgacgggcgggtagtcggacggccgtaacttagttttcgtagcgtagtcgtggtacggtcttactcgagttggagtgggttagggacgggttactccggtacgggacgggaggtaccgacgggtcgtaccggtaccgtacgtagcccgacgaccgaccgtccgtacccgccccgtggttcccacgttccctccgtccccgtacctccgtacgcgtaaccg

SEQ ID NO: 249481 - DNA, 658 bp, Homo sapiens
  misc_feature: GYAE6OF02I7HPI.9.25.C03.1.454.CMB.1.raw
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
  modified_base (360)..(360): a, c, t, g, unknown or other
  misc_feature (360)..(360): n is a, c, g, or t
tcagtgatacgtctcacgaccggtgctcgatttagtagtgtagatttgggtttggggctgggcctaaggaagcagcactggtggtgcctcagccatggcctggaccgttctcctcctcggccctcctctctcactgcacagttcttgtagactctgtgaccttccatgtgctgactcgacgccaccctcggtgtcagtcggccccgtaggaagaccgacagcaataccgtgtaggagganaccaaactaaattaaaaacaaagtaatgtagctattacggtaacagacaaggagtaccgacggcacgccctatccgtgtcgtnttgatgatgtcggacccgcctacgaggactccgtagngacgtcttctcgtacggcctacctacgtcgtacgggaaccaccgccctaccgtacaaccagtaccggtcgggaccgggtaaccgggacgggaccgggtagtacggacggaccgtaacctttacgtttaccgtagttctagtcgtggttggtacctcgttacagttagtaggttacgggtaggtacggggtttaacgtacgggtccgggaacgggacgtacggtacgccgtacggtccgtaaccgtacggtacgaccgaccgacggtcctcccggtacccggccttaccgtcttccccg

SEQ ID NO: 249482 - DNA, 886 bp, Homo sapiens
  misc_feature: GYAE6OF02HDBLZ.9.25.C03.1.454.CMB.1.raw
  modified_base (137)..(137): a, c, t, g, unknown or other
  misc_feature (137)..(137): n is a, c, g, or t
  modified_base (262)..(262): a, c, t, g, unknown or other
  misc_feature (262)..(262): n is a, c, g, or t
tcagtgatacgtctcacgaccggtgctcgatttagtagtgtagatttgggtttgggctgggcctaaggaagcagcactggtggtgcctcagccatggcctggaccgttctcctcctcggcctcctctctcactgcanacgtctttgtagactcgtggtcgacccttcagtgtgctaggacctcgacgccctacccgtcggtgtcaggttccggccccgtagggaaaacggccgccaagtctaattaaccgtggtgagggaanaacctaaaacgtaattaaaaacaaagtaatcgagtctagttacggaaccgtacgacgaaggaaaccgccgaggtaacccgcggtaccccctcggtaccttcgggttcgtcttttaggactaggtataacggttcgaccccgggtaccgtacggtaacgggtccgtaccgtacggaacggttcggtccgtttaccgtacgtcgggtaccttaaccggtaactcccgggtaaagggtaccccgtaacccgggtaacccctaccggtacccggtaaacctacggttaccgtaccggggtaaccgggggtaccgtaaaccgggggtaccggggtaaacgtccggggtaaccggaaccggttaccgttaacgtttacgtacggttacgacggtaacggttcgttagggtaacctttccgtaacgtaacgttcggttaagtacgggggtttaaccggttagggggaaactttcccggggttacgggaccgggttaacgggaaccgggttacgtacccgggtagttaaacccccgggtaacgttaccggtaaccggtaaccggttaacccgtaacggtcccgggttacccgtacccccggtttaacggttcccggtaccttaacccccggg

SEQ ID NO: 249483 - DNA, 773 bp, Homo sapiens
  misc_feature: GYAE6OF02IOGYL.9.25.C03.1.454.CMB.1.raw
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (466)..(466): a, c, t, g, unknown or other
  misc_feature (466)..(466): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcactgttctttgagccttcgtcgtacacccttccagttgtcgctagacctcaccgcccacccgttggtatcgacggtccggcccgtaaggaaacgcccggctacgtacctaacttaaccgtggtacggaacgggaacaacctaaagtaaaactttaaaaaccaaagtttagtggtacgtaccttaggttaccggtacacgacgaaggaaccgtccgaacggcccgcggtccctgtccgtggttactcgttgatcgtatacgacgtccgcncgtaacggtccnccggtagacgtctcgttcgtcgtaacgtccctaccgtacgttaccggcgggtaacccncccgggaccctaccggtaacgccctttaaaggtcggaacggggacccggggtacggaacgggtccgggtatacggaccgtacgtacgttacgttccgtggtctacggtcgttacgggtcgttacgtccgtgtacgaggttcgggtacgggtttagggtaccggtacggttcggaccgggttacgggacggacggtaccgtcgttaccgtaccgaccgttaacgccggtaccgaacgtccggtcgtcccgtccggttccgtaccgtccgttcccgtcccggtaaccctcccgtacgacgtacgtaccg

SEQ ID NO: 249484 - DNA, 705 bp, Homo sapiens
  misc_feature: GYAE6OF02FI9C7.9.25.C03.1.454.CMB.1.raw
  modified_base (224)..(224): a, c, t, g, unknown or other
  misc_feature (224)..(224): n is a, c, g, or t
tcagtgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgaggganacaacattaaaacaaataatgtgcattggtaccagcagaacgccaggccaggcccctgtcctggtcgttctttggatgataggtcgacccgggccctcgagggactcccgttagacgcgactttctcgtggcctccaaacctcgtggggaaccaccggccctaaccgtgacccatccgacgggccgggggttacgaacggcccggggtatcggacgggaccgacgttacgttttccgtcggttcaggtccgttggttaggggactttcgtactacgttgtaaggttcgggttagggtacgggggtaaacttccggtttaccggggacgggggtaacggggacccggtagggtaccgtaccgtaccggttaccgttaacgtccgtacgtacccgaacgggtccgtccggcccccgttcgggtccttaccgttcccgtaccggtttacccccgtccccgttacccgtacgtaccgtaacccgg

SEQ ID NO: 249485 - DNA, 812 bp, Homo sapiens
  misc_feature: GYAE6OF02FOY9F.9.25.C03.1.454.CMB.1.raw
  modified_base (235)..(235): a, c, t, g, unknown or other
  misc_feature (235)..(235): n is a, c, g, or t
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtcggcccctaggaaagacggccagcataacctgtgaggganacaaacaattaaaaacaaataatgtagactagttcggtaaccagcaagaagcccgaggcccaacgggccccctgtccgtgggtcgttctttgatgtataggtcgacccggccctacgacggggtactccccgtagacggtctaacgtttcctcgtcgggtacctaccctaacgttacgtacggggaaccgacccgggtcccctaacccgtacgaccctatccggaacggggtccggggtacggaaacggggtccggggtacgtacgggaaccgggtacccgtaaccgtttaacgttttcccggttaacggttacccgtaacgggttcggttacggggttaaggggttacctttttaccggaccgttaaaggtttgggtaacggtttacggggggttaagggggttacggggggtaaacctttcgggttaaccgggggtacggggttaaaccggggaccggtacggggtacgttaccgggtaacccgttaacccggtaacggtcccggtaaaccggacccgtaacggggtcccttccccggggtacccccgttccgggttacccacccgtttacccgg

SEQ ID NO: 249486 - DNA, 660 bp, Homo sapiens
  misc_feature: GYAE6OF01CD4O2.31.33.C11.1.454.CMB.1.raw
tcagcagtagacgtcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaaccatcaactgcaagtccagccagtagttgtttattcggccccacaataacaactacttagcttggtaccagacaagaaagtaggacagcctcctaaactcctgtatttacgtggtccttccgtacccgggcgacgttcccggggttacctaaccggtacttacctagttcgggctacgggtccggggttcgtcggggaacccgtactttaccgtaccttcccttaccgaccctactccgacgccacgtccctggccgagggtcctaggaagtagttggtcggtacttaagtttacttactgtacagactaactatttaattacctttcctttcgtaccttccggtttccgggacgggtacgggaccgtaaggggtaggaaggtaacgtaccgtaaaacggacgttcggtacggccgttacggacctacccgtacttccgttgttccttaccg

SEQ ID NO: 249487 - DNA, 677 bp, Homo sapiens
  misc_feature: GYAE6OF02IB3IR.31.33.C11.1.454.CMB.1.raw
  modified_base (251)..(251): a, c, t, g, unknown or other
  misc_feature (251)..(251): n is a, c, g, or t
  modified_base (318)..(318): a, c, t, g, unknown or other
  misc_feature (318)..(318): n is a, c, g, or t
  modified_base (490)..(490): a, c, t, g, unknown or other
  misc_feature (490)..(490): n is a, c, g, or t
tcagcagtagacgtcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtcagccagagttgttttatcggccccaanaataacaactacttagcttgaccagacaagaaagtgacagccctaccaaactcctagtactttacgnggtccttccgtacccgggctacgttccgggttaccaaccgtattcgagttcggcacggtcggtacgtcgggaccttacgtttcaacgttcctaccaacctatccgagtccgacgtcctcgacgaggtctagaacgtagttcggtggacttaaggtttactacgtcgtacganacctaaacttatttaacttaccctttttccgtttaaccgttcccgttaacgttttaccgggggaccggtaaacggggttaacccgtagggtagggttaaccgtaactaacccggaaaacggttcgttacgggttaccggacgttaccggaacctaacccgtagtttaccttcggttacctttacccg

SEQ ID NO: 249488 - DNA, 178 bp, Homo sapiens
  misc_feature: GYAE6OF01ETDWB.13.50.E06.1.454.CMB.1.raw
  modified_base (177)..(178): a, c, t, g, unknown or other
  misc_feature (177)..(178): n is a, c, g, or t
tcagtcacgtactacacgaccggtgctcgatttagatctactgacaacacacaagggcccatcggtcttcccctggcgccctgctccaggagcacctctggggcacagcggccctgggctgcctggtcaaggactacttcctagtacgtgactgagcgggctggcaaggcgcatagnn

SEQ ID NO: 249489 - DNA, 180 bp, Homo sapiens
  misc_feature: GYAE6OF01A2SEW.13.50.E06.1.454.CMB.1.raw
  modified_base (178)..(180): a, c, t, g, unknown or other
  misc_feature (178)..(180): n is a, c, g, or t
tcagtcacgtactacacgaccggtgctcgatttagatctactgacaacacacaagggcccatcggtcttcccctggcgccctgctccaggagcacctccgagagcacagcggccctgggctgcctggtcaaggactacttcctagtacgtgactgagcgggctggcaaggcgcatagnnn

SEQ ID NO: 249490 - DNA, 180 bp, Homo sapiens
  misc_feature: GYAE6OF01COOGN.13.50.E06.1.454.CMB.1.raw
  modified_base (177)..(180): a, c, t, g, unknown or other
  misc_feature (177)..(180): n is a, c, g, or t
tcagtcacgtactacacgaccggtgctcgatttagatctactgacaacacacaagggcccatcggtcttcccctggcgccctgctccaggagcacctccgagagcacagcggcctgggctgcctggtcaaggactacttcctagtacgtgactgagcgggctggcaaggcgcatagnnnn

SEQ ID NO: 249491 - DNA, 559 bp, Homo sapiens
  misc_feature: GYAE6OF01AEGIZ.13.50.E06.1.454.CMB.1.raw
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
tcagtcacgtactacacgaccggtgctcgatttagatctactgacaacacacaagggggctggggtctcaggaggcagcactctcgggacgtctccaccatggcctgggctctgctcctcctcagcctcctcactcagggcacaggatcctgggctcagtctgccctgactcagcatcgctcagtgtccgtgtctcctggacagtcagtcaccatctcctgcactggaagcaacagtgatattggtggttatacctatgtctcctggtaccaacagcacccaggcaaacgcccccaaactcattatttangtatttcactaagcgaccctcaggggtcccngatcgcttcnctgctcagtctggcaacncgcctcctgaccatctctcgggcctccgaggctgaccgtagtcggaggcctgacgttacttccgtgctgctacacgttcgtggacggtcctaacccgttacgtttactttaaagttacgtttccggggaccgggtaacggggtacccctaagggtcccttacggaaccccgtttccgtaagggtaccccg

SEQ ID NO: 249492 - DNA, 179 bp, Homo sapiens
  misc_feature: GYAE6OF01CLCJO.13.50.E06.1.454.CMB.1.raw
  modified_base (176)..(179): a, c, t, g, unknown or other
  misc_feature (176)..(179): n is a, c, g, or t
tcagtcacgtactacacgaccggtgctcgatttagatctactgacaacacacaagggcccatcggtcttcccctggcgccctgctccaggagcacctctggggcacagcggcctgggctgcctggtcaaggactacttcctagtacgtgactgagcgggctggcaaggcgcatagnnnn

SEQ ID NO: 249493 - DNA, 183 bp, Homo sapiens
  misc_feature: GYAE6OF01E0AGE.13.50.E06.1.454.CMB.1.raw
  modified_base (179)..(183): a, c, t, g, unknown or other
  misc_feature (179)..(183): n is a, c, g, or t
tcagtcacgtactacacgaccggtgctcgatttagatctactgacaacacacaagggcccatcggtcttccccctggcgccctgctccaggagcacctccgagagcacagcggccctgggctgcctggtcaaggactacttcctagtacgtgactgagcgggctggcaaggcgcatagnnnnn

SEQ ID NO: 249494 - DNA, 181 bp, Homo sapiens
  misc_feature: GYAE6OF01CL304.13.50.E06.1.454.CMB.1.raw
  modified_base (178)..(181): a, c, t, g, unknown or other
  misc_feature (178)..(181): n is a, c, g, or t
tcagtcacgtactacacgaccggtgctcgatttagatctactgacaacacacaagggcccatcggtcttcccctggcaccctcctccaagagcacctctgggggcacagcggccctgggctgcctggtcaaggactacttcctagtacgtgactgagcgggctggcaaggcgcatagnnnn

SEQ ID NO: 249495 - DNA, 188 bp, Homo sapiens
  misc_feature: GYAE6OF01AEXFL.13.50.E06.1.454.CMB.1.raw
  modified_base (176)..(188): a, c, t, g, unknown or other
  misc_feature (176)..(188): n is a, c, g, or t
tcagtcacgtactacacgaccggtgctcgatttagatctactgacaacacacaagggcccatcggtcttcccctggcgccctgctccaggagcacctctggggcacagcggcctgggctgcctggtcaaggactacttcctagtacgtgactgagcgggctggcaaggcgcatagnnnnnnnnnnnnn

SEQ ID NO: 249496 - DNA, 511 bp, Homo sapiens
  misc_feature: GYAE6OF01CFPEO.13.50.E06.1.454.CMB.1.raw
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcccccaggctcctcatctacgatgtattcaggaggaccactgacatcccagacaggttcagtggcaggtgggtctgggacagacttcactctcaccatcagcagactagaacctagaagtcttgactactttattctgtcacctagtagtggtaggtctaccgtactacgtttggcgagggaccagctaggagtactagaacgcgaacgtgtacggctgacacctatcgtacg

SEQ ID NO: 249497 - DNA, 664 bp, Homo sapiens
  misc_feature: GYAE6OF01BKT26.13.50.E06.1.454.CMB.1.raw
  modified_base (230)..(230): a, c, t, g, unknown or other
  misc_feature (230)..(230): n is a, c, g, or t
  modified_base (272)..(272): a, c, t, g, unknown or other
  misc_feature (272)..(272): n is a, c, g, or t
tcagtcacgtactacacgaccggtgctcgatttagatctactgacaacacacaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaancaacagtgatattggtgttatacctatgtctctggtaccaanagcaccaggacaaacgccccaaatcattattatgtatttcactaagccgacctcgacgggtccctgactcgcttctctggcctaccaagtctggaccaacgaccggtccctccctacgaccctattcctcgtcgggcctaccgaggctggaccgtagtacggacggtcttaggtacgtttactttccgtaggtccgttcgtaccttactacgttccggtacgggaaccgtacccttaacccgtttaccgtttaaccgtttttaaaccggtaccggttttacccgggggacccggggttaaaccgggtaaccccccgtaaggaccccgtttacccgggtaacccccggtttacccggttaacggggtaccccgaacccgggtaaacccccggg

SEQ ID NO: 249498 - DNA, 584 bp, Homo sapiens
  misc_feature: GYAE6OF01AY0WR.13.50.E06.1.454.CMB.1.raw
  modified_base (273)..(273): a, c, t, g, unknown or other
  misc_feature (273)..(273): n is a, c, g, or t
tcagtcacgtactacacgaccggtgctcgatttagatctactgacaacacacaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaagcaacagtgatattggtggttatacctatgtctctggtaccacngcaccaggcaaacgccccaaatcattattatgtatttcaactaagccgaccctcgacgggtccctgactcgtctttctctggcctccgaacgttctcggaccaaccgaccggccctcccgtcgacccattcctccgtgggtccctccgaggtctacgacgagtggacgtcgtagtacgttactttccgtgccttgcttcagttccgtggaacgtccgtaaccttacttaccgttttaatcgtttccgggacgggtacgggacccctacggtcgttaccggaccgttccgtaacggtccgacggtaccccgg

SEQ ID NO: 249499 - DNA, 510 bp, Homo sapiens
  misc_feature: GYAE6OF01EE560.13.50.E06.1.454.CMB.1.raw
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatctatggtgcatccagcagggccactggcatcccagacaggttcagtggcaggtggtctgggacagacttcactctcaccatcagcagactggagcctagaagtattttgctagtgttattacgtgtcagctagtagtggtagctcaccgttcggacgttcggccgaagggaccgaaggtacggaaactacgaaacgtacgtagtcggcgtgtaccg

SEQ ID NO: 249500 - DNA, 675 bp, Homo sapiens
  misc_feature: GYAE6OF01BBNJI.13.50.E06.1.454.CMB.1.raw
  modified_base (231)..(231): a, c, t, g, unknown or other
  misc_feature (231)..(231): n is a, c, g, or t
tcagtcacgtactacacgaccggtgctcgatttagatctactgacaacacacaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcacgtggaancaacagtgatagttggtaggttataccttagtcgtctccgtacggtaccaacacgccacccgaggaccaaaccgacccccaaactctaatttatttactgtactttacactaacgccgaccctacgacgggtccctagtacgtccgtcttctcgtcggtacctaccagttccgtcggacctaaccgacccggtccctacccgtacgaccctacgttccgtcgtcgggtccctaccggacggtccgtacggaacgtagtacggtacggtcttagacgtttacttccgtcgtcgtcgtaccgttaccgtacgttccggtagggaccgtaccctaaccgtttaccttacgttttaacggttcggttaccggggaccggggtaccgggacccgtacgtaccgtaccggtaacccgttccgtaacgggtacccgacccgggtaccccgg

SEQ ID NO: 249501 - DNA, 642 bp, Homo sapiens
  misc_feature: GYAE6OF01CW82W.13.50.E06.1.454.CMB.1.raw
tcagtcacgtactacacgaccggtgctcgatttagatctactgacaacacacaagggggctggggtctcaggaggcagcactctcgggacgtctccaccatggcctgggctctgctcctcctcagcctcctcactcgagggcacaggatcctgggctcagtctgccctgactcagcctcgctcagtcgtccggtctccgtggacagtcagtccacctatcctcctgcacgtggaagcaactagtgatagttggtgttatacctatgtctccgtagtaccagagccaccgaggacaacgaccccaaatctattattatgtactttacactaacgccgaccctcgacgggtccctagtactccgtctttcttcgtggtcctaccgtaagtccgtacggaccaacgtccggcccttacccgtcgaacccctattccgtcgttcgggaccttcccgagggtcctacggacgtacgtaggacggtactaggtacgttactttcccgagtccgttcgtacctacgtacgttccgtggacggtaccctacccgttacttaacgtttacgtacggttaccgggacggtaccgggtaccccaggtccgttaccggacccggttcgttaacgggtccgaccggtaaccccgg

SEQ ID NO: 249502 - DNA, 697 bp, Homo sapiens
  misc_feature: GYAE6OF01ELQLZ.13.50.E06.1.454.CMB.1.raw
tcagtcacgtactacacgaccggtgctcgatttagatctactgacaacacacaagggggctggggtctcaggaggcagcactctcgggacgtctccaccatggcctgggctctgctcctcctcagccctcctcactcagggcacaggatcctgggctcagtctgccctgactcagcctcgctcagtcgtccgggtctcctggacagtcagtcaccatcctcctgcacgtggaacgcaacagtgatattggtggttactacctatgtctccgtgtaccaacagccaccaggaccaaacgcccccaaactccaatttatttatgtactttacactaagccgaccctcgacgggtccctagactcgtcttctcgtcgcctacgacgtcgtagaccaaccgccgtccctcccgtacgacctacgttcctccggtcgggtccctaccgtacggtccgtacggtaaccgtaagtcgggaacggtccgttacggtaacggtttactttcccggttcggtccttccgggtaccttacgttaacgttccggttaacggggtaccgtacccttaaacccgtttacctttaaccgttttaaaccggtttacgggttaccggggtacccggggtaaccgggaaccccgtacggtacccgttaccgggttaccccgtaccgttacgggttaccgaacccggtaaccccgg

SEQ ID NO: 249503 - DNA, 545 bp, Homo sapiens
  misc_feature: GYAE6OF01CG89M.13.50.E06.1.454.CMB.1.raw
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagtcacgtactacacgaccggtgctcgatttagatctactgacaacacacaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcagtccaccatcctcctgccacgtggaancaacagtgatagttggtagttataactntgtctctagtaccaacacaccagacaacgccccaaaatcatgtattatgatgtacagtacgccgacctgacgggtcctgatcgtctctctcgcctcaagtcgngacacaccggtccctccgacgacctactcgtcgtcggctcgngcgtgagtntgtagtcgtagtacttatacgtgtctacgtctacgtagtatggcgagccgtagtacgtacctacgttacggtacgtacggtaccgggagggtaacccggtaacaggtccgtaccggaccgttaccggg

SEQ ID NO: 249504 - DNA, 192 bp, Homo sapiens
  misc_feature: GYAE6OF01DYVNF.13.50.E06.1.454.CMB.1.raw
  modified_base (184)..(192): a, c, t, g, unknown or other
  misc_feature (184)..(192): n is a, c, g, or t
tcagtcacgtactacacgaccggtgctcgatttagatctactgacaacacacaagggcccatcggtcttccccctggcgccctgctccaggagcacctcgtggggcacaggcggcccgtgggctgcctggtcaaggactacttcctagtacgtgactgaggcgggctggacgaaggcgcatagnnnnnnnnn

SEQ ID NO: 249505 - DNA, 629 bp, Homo sapiens
  misc_feature: GYAE6OF01D9PMA.13.50.E06.1.454.CMB.1.raw
  modified_base (213)..(213): a, c, t, g, unknown or other
  misc_feature (213)..(213): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (493)..(493): a, c, t, g, unknown or other
  misc_feature (493)..(493): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctcagtcaccctgtctgtgtctccgaggggaatcgcaaccctntcctgcaggccagtcagtagtgtagcagcagtcttagcctgtaccagcagagcctggccaggcctccgaggcctcctctatttanggtcnctactccgacgagggcccacgttggactccccgagacccggttcaggtcggcgtaggttcgggtacgtcgggtacacgtactttccaccgttctaccgacctacgtcaacgtcgtacgttcgtcgtacgtacgttacgttacggtaacgtttacgtttacgaccgtttaagtttacttacgttcgtacgnggtaactaacgttaactaacgttacgtacgtacccgttacgtactagttacgtaccttacgtttacggaccggtaccgggtaaccttaccggtggtacgtactaccggacgtaacgtacgttcggtcggcgtaacg

SEQ ID NO: 249506 - DNA, 693 bp, Homo sapiens
  misc_feature: GYAE6OF01BZ77O.13.50.E06.1.454.CMB.1.raw
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctctcctgcagggccagtcagagtgttagcagcagcttagcctggtaccagcagaagccgtggccaggcctcccgaggtcctcctcacttcctacgattacgtattccgaggacggaccctacgtcgaacctacgtaccccgaaggaaccgtacgggtttaccaaggttcggacccgtaggttcggggtcttacgggggactacggtaccgtttacgaccgttcctaccgtacccgtacttaccgaacgtaccaacggtacgtacgggaacccgttacggaacgtacccgtttagtaccgttacgttttactttccttacggttacctaccgtacgttaacgttcggttacggttacctaccgttacgttacgttttaccggcccgtaacgggtaccgtaacggtacgttacggtacgtaatacggaacggaccgtaaacgttacggtacggtaccgttagaccgtaacccgtacgttacccg

SEQ ID NO: 249507 - DNA, 873 bp, Homo sapiens
  misc_feature: GYAE6OF01ER2LI.13.50.E06.1.454.CMB.1.raw
tcagtcacgtactacacgaccggtgctcgatttagatctactgacaacacacaaggggggctggggtctcaggaggcagcactctcgggacgtctccaccatggcctgggctctgcctcctcctcagcctcctcactcagggcacaggatcctgggctcagtctgccctgactcagcctcgctcgagtcgtccgggtctccgtggacagtcagtcaccatctcctgccacgtggaactacaacgtaggtacgtattagttggttaggttaactaccgttagttcggtccttaccgttacgggttaaaccaacgtaacggaccctaaccccgaacgggtaaccgaaaaacccggacccccctaaaacgttacttaaacttttaaacgttttaaacgtagttaacttttaccgaaaaccgttaaaccggtacccggtaacccgtccgggttaaacccgggggttccccgttacggtaaccgttcccggttaccgtttaccgtttcggttaccggttacccgtaaccggtaaacggttccgtaacggggtacctaaacccggtacccggggtccccttaccccgttaccggaacccttaacgtttcccgtttaacggtaccggggtacccttacccgggtaacggtcccggttaacggtaaccggtagtacgggtacgggtcgttaacgtacgttaacgttcccgttaggtccttcgggtacttaccgtactacgggtacggaccgtaccgttaaccgtttacctttaacgtttaaaccggttcggtttacccggggacgggtaaccccgggaccgtcggtaacccgtacccggtacccgttaaccggttacgttacccgaaccgggtaaccccgg

SEQ ID NO: 249508 - DNA, 866 bp, Homo sapiens
  misc_feature: GYAE6OF01BIHD8.13.50.E06.1.454.CMB.1.raw
  modified_base (853)..(853): a, c, t, g, unknown or other
  misc_feature (853)..(853): n is a, c, g, or t
  modified_base (859)..(859): a, c, t, g, unknown or other
  misc_feature (859)..(859): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggcctccagactactacgtggagaaatagtgctgacgcagtctcacgtccacctgtctgtcgtctacggaaggggaaactacgaccctaacccttcctaccgtcggaccgacggggtcctaacggttcgtaacggtaggttacggtttacggaccgtaacggtaccgtaaggttccgttaacggtaccccggttacgggtaaccccgaaggaccgaacggtaaaccggtcccggtacgggaccccggtaaccgggtccctaccccgggtaacgggtcccccgtttaccttaacccgtttaaggttttaacggttccggtcggtaaccgtaccgttaacccgaacgggttaccgggaacccctttacggttccgggttacccgttaccccggtaacggttccggttaacgggttacccgaggggtacccgggtacgtacggggtttaccgggtaccggtacgggggaaaccgttaccgttcccgtttaaaccccgtaaccgttccgttaacccgtaacccgtacgttaaccggaccgtaccggtacggttcccgtacgaccgtacggtcgttaacgtacgtttaggttctacgttactactttacgtactcggctacgtaactacgttattaccgttacggtacgaccggttaccacgggacgaacggtacgacgtcggtaaggtacgtaaaggttagaccgttaggacgtacaccgtaaccncggttnttaccgg

SEQ ID NO: 249509 - DNA, 814 bp, Homo sapiens
  misc_feature: GYAE6OF01BUMD3.13.50.E06.1.454.CMB.1.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
tcagtcacgtactacacgaccggtgctcgatttagatctactgacaacacacaagggggctggggtctcaggaggcagcactctcgggacgtctccaccatggcctgggctctgctccctcctcagccctcctcactcgagggcacaggatcctgggctcagtctcgccctgactcacgcctcgctcgagttcggtccgggtctcgtggactgtcagtccacctntcctcctgctacgtacggaaacngcagtgattcgttaggtactagtacgtcttcgtcctccgtacggtaacccaaccacccgacccgacggaccgaacccggccccgaaggtactctaacgttcctaagtttacggtcggggactaaggtacgggtcccggtaccgtaccgggtaacggttaccctttacccgaccgttccgttacctttccgtcccgttcggtacccgttaacctaaggttcccgtaacggacccgtaaccggtacccggtccccgttacccgtaccgtaaccgtaacttccgttacgttaccgggttccctaccgggacggttaccggtacgggtaacgggtacccggtaacgggttcccttaccggttaaccgtttaccgtttaccggttccgttaaccgttccggtaccgttaccgttaacgttaccggtaccgttacggtttaccgttttccggttcggtttaccgggttccgggtttcccgggtaccggggttacggggtaaccggttaccggtaacgggttcccgtaccggttacggtaccggtaccgacccgtccggtaccgggtaccccg

SEQ ID NO: 249510 - DNA, 811 bp, Homo sapiens
  misc_feature: GYAE6OF01BARJK.13.50.E06.1.454.CMB.1.raw
  modified_base (197)..(197): a, c, t, g, unknown or other
  misc_feature (197)..(197): n is a, c, g, or t
tcagtcacgtactacacgaccggtgctcgatttagatctactgacaacacacaagggggaggaactgctcagttaggacccagacggaaccatggaacgccccagcgcagcttctcttcctcctgctactctggctccagatactactggagaaatagtgctagacgcagtctccagtccaccctgtcgtgtcgtcnccgaaggggaatacgaccaaccctctcgtgcgacggccagtcagtagtgttagcagcagtcgttacgccgtcggtaccacgacgaagacgccgtggacccgacggtccctacccggacggtccttacctcgttacgttttacgtcgggtactactaccgttacccgaacggtaccgggtacccgttacggtccgggttaccgtacccgtacggtaccgttacggttaccggacgggtccggacggtgggttcggggtaccggtacgggtaccgttaacggtaccgttaccctacggttaccctaaccgtaccgtaacgttccgacggtcccgtaccggtcccgtaaggtccgttacggttaacgttaacgggtttactttacggtttaccgtacgttacgtttttaccggtttaaccttacggttagttaccggtacgtaacgtttaagggtttaacgtttaaccggtttacgaacggggttaaccgttaccccggtaacggggaaaccggtacgggtaaccgtaaaccgggtaggttaacgtaaaacgggttacgttaaaggtccgggttaggttacccgtggtaacccggtaccctaggttcgtttacccgg

SEQ ID NO: 249511 - DNA, 178 bp, Homo sapiens
  misc_feature: GYAE6OF02HROQF.13.50.E06.1.454.CMB.1.raw
  modified_base (178)..(178): a, c, t, g, unknown or other
  misc_feature (178)..(178): n is a, c, g, or t
tcagtcacgtactacacgaccggtgctcgatttagatctactgacaacacacaagggcccatcggtcttcccctggcgccctgctccaggagcacctccgagagcacagcggccctgggctgcctggtcaaggactacttcctagtacgtgactgagcgggctggcaaggcgcatagn

SEQ ID NO: 249512 - DNA, 180 bp, Homo sapiens
  misc_feature: GYAE6OF02HAY06.13.50.E06.1.454.CMB.1.raw
  modified_base (177)..(180): a, c, t, g, unknown or other
  misc_feature (177)..(180): n is a, c, g, or t
tcagtcacgtactacacgaccggtgctcgatttagatctactgacaacacacaagggccatcggtcttcccctggcgccctgctccaggagcacctccgagagcacagcggccctgggctgcctggtcaaggactacttcctagtacgtgactgagcgggctggcaaggcgcatagnnnn

SEQ ID NO: 249513 - DNA, 179 bp, Homo sapiens
  misc_feature: GYAE6OF02FLG6R.13.50.E06.1.454.CMB.1.raw
  modified_base (177)..(179): a, c, t, g, unknown or other
  misc_feature (177)..(179): n is a, c, g, or t
tcagtcacgtactacacgaccggtgctcgatttagatctactgacaacacacaagggcccatcggtcttcccctggcgccctgctccaggagcacctctggggcacagcggccctgggctgcctggtcaaggactacttcctagtacgtgactgagcgggctggcaaggcgcatagnnn

SEQ ID NO: 249514 - DNA, 178 bp, Homo sapiens; identical to SEQ ID NO: 249488
  misc_feature: GYAE6OF02IT6ZB.13.50.E06.1.454.CMB.1.raw
  modified_base (177)..(178): a, c, t, g, unknown or other
  misc_feature (177)..(178): n is a, c, g, or t

SEQ ID NO: 249515 - DNA, 542 bp, Homo sapiens
  misc_feature: GYAE6OF02GUQHF.13.50.E06.1.454.CMB.1.raw
  modified_base (344)..(344): a, c, t, g, unknown or other
  misc_feature (344)..(344): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
tcagtcacgtactacacgaccggtgctcgatttagatctactgacaacacacaagggggctggggtctcaggaggcagcactctcgggacgtctccaccatggcctgggctctgctcctcctcagcctcctcactcagggcacagggtcctgggcccagtctgccctgactcagcctgcctccatgtctgggtctcctggacagtcgatcaccatctcctgcactggaaatgcagtgatgttggacttatgaccttgtctcctggtaccgacaacacccaggacaaacgcccccaaactcattagtttacggggtacaataagccggccctcgagggtctttcngatcgcttctctggctccaagtctggcaacaccggcctcctgactaatctctggacctccgaggccgaggacgaggcttgtattttacngttnttcattatgacaggaagagtagtattagtgttcgtttaggagttggactaggtcctaccgttcgttaggtcacgacccgaacggcccaacccgcgtcgtctaccg

SEQ ID NO: 249516 - DNA, 540 bp, Homo sapiens
  misc_feature: GYAE6OF02G5KII.13.50.E06.1.454.CMB.1.raw
  modified_base (346)..(346): a, c, t, g, unknown or other
  misc_feature (346)..(346): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggcctcctcatttatggtgcatccactagggccactggtcgtcccagtcaggttcagccggnaggtgggtctgggacagacttcactctcaccatcagcagcctgcagtctgaagtattttgactagtcttattactgtcagctagttaattagttacgtaggtacgtaacccgttcggaccgaagggaccaacggtacgtaggaaggtaacgttaaaggaacgttaggtacggtacgtacggactaccgtatccg

SEQ ID NO: 249517 - DNA, 515 bp, Homo sapiens
  misc_feature: GYAE6OF02F2NMW.13.50.E06.1.454.CMB.1.raw
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccaggctcctcatttanggtgcatccactagggccacgtggtntccccagtcaggttcagcggcaggtgggtctggggacagacttcactctcaccatcagcagcctgcagtctgaagtatttgctagtcttattactgtcagcagtatagttactggacgtaaccgttcggaccgagggacacggacgtaggagtagttaaaggtacgttaggtggtactgactacctatcg

SEQ ID NO: 249518 - DNA, 541 bp, Homo sapiens
  misc_feature: GYAE6OF02IQ75F.13.50.E06.1.454.CMB.1.raw
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagccaaccctctcctgcagggccagtcagagtgttagcagcagcttagcctggtaccagcagaagcctggccaggcctcccaggctcctctatttanggtncatccacgtagggccacgtggtctcccagtcaggttcagcggnaggtggtctgggacagacttcactcctcaccatcagcacgcctgctagtctagaagttattttcgactagttctattacgtgtcgtagtctagttattagttacgtggtacgtaaccgttcggaccgaacgggaccacggtaacgtgggaagtaagttaaaggtacgtaggtaggtcgtcgacgacctagtcg

SEQ ID NO: 249519 - DNA, 533 bp, Homo sapiens
  misc_feature: GYAE6OF02JD1XA.13.50.E06.1.454.CMB.1.raw
  modified_base (301)..(301): a, c, t, g, unknown or other
  misc_feature (301)..(301): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccaggcctcctctatttanggtgcatcccacgtacgggccacgtggtctcccagtcaggttcagcggctaggtgggtctggggacaggtaccttcgactctacaccatccagcacgcctgcagtctagaagttatttgctagttctattactgtcagtctagttatagttacgtggtacgtaaccgttcgaccgaggacacggacgtaggaagtaagttaacggacgttaggtcggctagccacctattcg

SEQ ID NO: 249520 - DNA, 583 bp, Homo sapiens
  misc_feature: GYAE6OF02H935H.13.50.E06.1.454.CMB.1.raw
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccgaggcctcctntatttanggtgcatcccgacgtacgggcctacgtggtcgtcccagtacagggttcaggcggacgtaggttcgggtctgggaacagtaccttcacttcctcaccactcgacgcacgtcctgcgacgtcgtagtaagtgttttcgacgtagtacttattactgtacgagtcaagttagttagttaacgtcggtaacgtaaccgttacggaccgaacgggtactaacggtacgtaggaacgtaacgttaaacggacgttggtacggtacgtacggactaccgtagttaccg

SEQ ID NO: 249521 - DNA, 616 bp, Homo sapiens
  misc_feature: GYAE6OF02G3ZCD.13.50.E06.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagataccaccggagaaatagtgatgacgcagtctccagccaccctgtctgtgtctccaggggaaanagccaccctctcctgcagggccagtcagacagttagcaacaacgtagcctggtaccagcaagaaacgtggccaggcctcccaggctcctcatctatggtncactcccaaccgagggccacgtggtactcccgaggtaccggtttagcggctaggtggggtctggggacagtacttcacctctacaccatcagcagtctgctacgtctagtaagtatttcgacttagtttattactgttacgtagtactaagtaattaaacgttaacgttcggtacccgttaccgttaacgtacttacgttaaccttacgttttacgggacccggtaacggggtacccgtaaccggtaggtaacgtacgtacgtaacggtaacgtaacgttggtacggccgttacgaccgtacctacgttccg

SEQ ID NO: 249522 - DNA, 523 bp, Homo sapiens
  misc_feature: GYAE6OF02GM3VM.13.50.E06.1.454.CMB.1.raw
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccaggcctcctcatttatggtgcactccactacgggccacgtggtcgtccagtcgaggttcaggcggcaggtgggtcgtgggacaggtactcactctcaccatcagcacgctgcagtctagagtatttgctagtctattctgttcacgtctagttatagttactaggtacgtaaccgttcggaccgagggtacacggacgtaggacgtaagttaaagagtagtaggactcgactacatccg

SEQ ID NO: 249523 - DNA, 547 bp, Homo sapiens
  misc_feature: GYAE6OF02F050B.13.50.E06.1.454.CMB.1.raw
  modified_base (344)..(344): a, c, t, g, unknown or other
  misc_feature (344)..(344): n is a, c, g, or t
  modified_base (530)..(530): a, c, t, g, unknown or other
  misc_feature (530)..(530): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaacctctcctgcagggccagtcagagtgttagcagcagcttagcctggtaccagcagaagcctggccaggcctcccaggctcctcatttatggtgcatccactagggccacgtggtcgtcccagtcaggttcagcgnaggtggtctgggacagacttcactctcaccatcagcagactggaacctgaacgtactttgctacttttacttcgtcttctaccgtagttacgtggttacggtcctaaccgttactacgttttcggaccgtaaggggtaccaacggtcgtaggagtacgtaacgaacgacgtacgtcggacgtcganaccacgtacttcgtacg

SEQ ID NO: 249524 - DNA, 739 bp, Homo sapiens
  misc_feature: GYAE6OF02HG2HE.13.50.E06.1.454.CMB.1.raw
  modified_base (327)..(327): a, c, t, g, unknown or other
  misc_feature (327)..(327): n is a, c, g, or t
tcagtcacgtactacacgaccggtgctcgatttagatctactgacaacacacaagggggctggggtctcaggaggcagcactctcgggacgtctccaccatggcctgggctctgctcctcctcagcctcctcactcagggcacaggatcctgggctcagtctgccctgactcagcctcgctcagtcgtaccgggtctcctggacagtcagtcaccatcctctgcactggacgcaacagtgatagttggtggttatacctatcgtctcgtgtaaccaacagccacccgaggacctaaacgcccccaaaagtccaattacgtatttacngtatgtactagtaacgcggtaccctcggaccggggttccctacgtaactccggtacttcgttaccgtcgtacccttaccgaacgttccgtacggacccgtaaccgtaccccgggtaccccgttccccgtacggtaaccccgttacgttccgttaccgggttcgggtaccccttaccccgggtaacgggttaccgttacgggaaacggggtaccgttacgggaaaccgtttccgggttaagtttaaccggtttaacctttaccggttgttccgtttaccgggaccttccgtaaagttacgtacggtaacgtacgggtactacggtaccttaaccgtaaccggttcggtttaaccttaccgggtttacggggaccggttacgggaacccgtaaggtccccgtacggtaacccgg

SEQ ID NO: 249525 - DNA, 539 bp, Homo sapiens
  misc_feature: GYAE6OF02IBX9X.13.50.E06.1.454.CMB.1.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaattgtgttgacgcagtctccaggcaccctgtctttgtctccaggggaaangccaccctctcctgcagggccagtcagagtgttagcagcagctattagcctggtaccagcagaaacctggaccaggctccgaggcctctcatcctatggcncactccagcgagggccacgtggacagtcccaagctaggttcagtgactaggtgggtcgtggactcgtacttcactctacaccatacagcagactggacgccgtagaagttacttttgacgtagttgtatacgtgtacagtctagtatggtatctcgaccgtcgacgttccgaacgaacggacgtaaggtacggaactaacgaacggtacgtcggtacggtctcgacctactacg

SEQ ID NO: 249526 - DNA, 620 bp, Homo sapiens
  misc_feature: GYAE6OF02G62U4.13.50.E06.1.454.CMB.1.raw
tcagtcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctctcctgcagggccagtcagagtgttagcagcagtcttagcctggtaccagacagaagcctggccaggcctccccgacggtcctcctctattttacgtgggtgactactccctaacgtacgggcctacgtggtctccgagtcaggttcacggcggcgaggtcgggtctgggacaggtacttcgactctccacctatcagccacgtaccctgactacgtcgtagtaacgttagttttcgactacggttcctttaattccgtacgttcgaacgtctaagttaaggtttacgttacggttacggaacgttaacccgtacgggaaccgtagggaccgtaacggtacggttagggaaacgtaaggttaaacggtagttcggtacggtaccgtcggaccctacgtactttaccgg

SEQ ID NO: 249527 - DNA, 754 bp, Homo sapiens
  misc_feature: GYAE6OF02I3MEB.13.50.E06.1.454.CMB.1.raw
  modified_base (232)..(232): a, c, t, g, unknown or other
  misc_feature (232)..(232): n is a, c, g, or t
tcagtcacgtactacacgaccggtgctcgatttagatctactgacaacacacaagggggctggggtctcaggaggcagcactctcgggacgtctccaccatggcctgggctctgctcctcctcagcctctcactcagggcacaggatcctgggctcagtctgccctgactcagcctcgctcagtgtccgggtctcctggacagtcagtcaccatcctcctgccactggaacnctaactagtgatagttggtagttactaccgtatcgtctccgtggtaaccacgacgccaacccgaggtaccaaaccggtaccccctaaacgtccgtaagtttaactttgtacgtacttttacaaccttaacgtcccgacctacgtacggttagtactacgtaactccgttctactacgttcgccttaccgaaggttcctacggtaccctaaacgtcccgggtacccttaccccgtaggtaaccctaagttacccgttccggaccggtccttacccgaggtaccgacggacggtaaccggtaggtccgttaaggtaaccgtttactaccggttaggtaccccggtcttccgggtacggtaaccgtttaacgttaacccgtaccctttaacccgttttacgtaccggtttaccgggttaaccgggttaacttccggttaaaccgtaacccgggttaaccggttcccgtaacccggtttaccgtaagggtaccccgtacgtacccggtaaccccggttaacccccc

SEQ ID NO: 249528 - DNA, 203 bp, Homo sapiens
  misc_feature: GYAE6OF02H0R4P.13.50.E06.1.454.CMB.1.raw
  modified_base (182)..(203): a, c, t, g, unknown or other
  misc_feature (182)..(203): n is a, c, g, or t
tcagtcacgtactacacgaccggtgctcgatttagatctactgacaacacacaagggcccatcggtcttccccctggccgccctgctccaggagcacctcgagagcacagccggcctgggctgcctggtacaaggcttacttcctagtacgtgactgagcgggctgggcaaggcgtcatagnnnnnnnnnnnnnnnnnnnnnn

SEQ ID NO: 249529 - DNA, 217 bp, Homo sapiens
  misc_feature: GYAE6OF02GBLIL.13.50.E06.1.454.CMB.1.raw
  modified_base (184)..(217): a, c, t, g, unknown or other
  misc_feature (184)..(217): n is a, c, g, or t
tcagtcacgtactacacgaccggtgctcgattttagatctactgacaacacacaagggcccatcggtcttccccctggcgccctgctccaggagcacctctgggggcacagcggccctgggctgcctggtcaagggctacttcctagtacgtgactggagcgggctggacgaaggcgcagtagnnnnnnnnnnnnnnnnnnnnnnnnnnnnnnnnnn

SEQ ID NO: 249530 - DNA, 171 bp, Homo sapiens
  misc_feature: GYAE6OF01C7C3I.52.87.H10.1.454.CMB.1.raw
  modified_base (170)..(171): a, c, t, g, unknown or other
  misc_feature (170)..(171): n is a, c, g, or t
tcagcgcagtacgacacgaccggtgctcgatttagcagtactgcgttgggtttgggtgggtttggggaggtgtgtcacaagatttgggctctgggcacagcggccctgggctgcctggtcaaggacctacttcctatacgatcgctgagcgggctggcaaggcgcatagnn

SEQ ID NO: 249531 - DNA, 170 bp, Homo sapiens
  misc_feature: GYAE6OF01EGGG1.52.87.H10.1.454.CMB.1.raw
  modified_base (169)..(170): a, c, t, g, unknown or other
  misc_feature (169)..(170): n is a, c, g, or t
tcagcgcagtacgacacgaccggtgctcgatttagcagtactgcgttgggtttgggtgggtttggggaggtgtgtcacaagatttgggctctgggcacagcggccctgggctgcctggtcaaggactacttcctatacgatcgctgagcgggctggcaaggcgcatagnn

SEQ ID NO: 249532 - DNA, 187 bp, Homo sapiens
  misc_feature: GYAE6OF01EZEXY.52.87.H10.1.454.CMB.1.raw
  modified_base (168)..(187): a, c, t, g, unknown or other
  misc_feature (168)..(187): n is a, c, g, or t
tcagcgcagtacgacacgaccggtgctcgatttagcagtactgcggttgggttgggtgggtttggggaggtgtgtcacaagatttgggctactgggcacagcggccctgggctgcctggtcaaggctacttccatacgatcgctgagcgggctggcaaggcgcatagnnnnnnnnnnnnnnnnnnnn

SEQ ID NO: 249533 - DNA, 169 bp, Homo sapiens
  misc_feature: GYAE6OF01B3H7C.52.87.H10.1.454.CMB.1.raw
  modified_base (169)..(169): a, c, t, g, unknown or other
  misc_feature (169)..(169): n is a, c, g, or t
tcagcgcagtacgacacgaccggtgctcgatttagcagtactgcgttgggtttgggtgggtttggggaggtgtgtcacaagatttgggctctgggcacagcggccctgggctgcctggtcaaggactacttcctatacgatcgctgagcgggctggcaaggcgcatagn

SEQ ID NO: 249534 - DNA, 170 bp, Homo sapiens
  misc_feature: GYAE6OF01COMIE.52.87.H10.1.454.CMB.1.raw
  modified_base (168)..(170): a, c, t, g, unknown or other
  misc_feature (168)..(170): n is a, c, g, or t
tcagcgcagtacgacacgaccggtgctcgatttagcagtactgcgttgggtttgggtgggtttggggaggtgtgtcacaagattgggctctgggcacagcggccctgggctgcctggtcaaggactacttcctatacgatcgctgagcgggctggcaaggcgcatagnnn

SEQ ID NO: 249535 - DNA, 170 bp, Homo sapiens; identical to SEQ ID NO: 249531
  misc_feature: GYAE6OF01DFYJ5.52.87.H10.1.454.CMB.1.raw
  modified_base (169)..(170): a, c, t, g, unknown or other
  misc_feature (169)..(170): n is a, c, g, or t

SEQ ID NO: 249536 - DNA, 197 bp, Homo sapiens
  misc_feature: GYAE6OF01DQHA0.52.87.H10.1.454.CMB.1.raw
  modified_base (172)..(197): a, c, t, g, unknown or other
  misc_feature (172)..(197): n is a, c, g, or t
tcagcgcagtacgacacgaccggtgctcgatttagcagtactgcgttgggtttgggtgggtttggggaggtagtgtcacaagatttgggactctcgggcacagcggccctgggctgcctggtcaaggactacttcctatacgatcgctgagcgggctggcaaggcgcatagnnnnnnnnnnnnnnnnnnnnnnnnnn

SEQ ID NO: 249537 - DNA, 177 bp, Homo sapiens
  misc_feature: GYAE6OF01BM5LB.52.87.H10.1.454.CMB.1.raw
  modified_base (168)..(177): a, c, t, g, unknown or other
  misc_feature (168)..(177): n is a, c, g, or t
tcagcgcagtacgacacgaccggtgctcgatttagcagtactgcgttggtttgggtgggtttggggaggtgtgtcacaagatttgggctctgggcacagcggccctgggctgcctggtcaaggactacttcctatacgatcgctgagcgggctggcaaggcgcatagnnnnnnnnnn

SEQ ID NO: 249538 - DNA, 169 bp, Homo sapiens
  misc_feature: GYAE6OF01D15GR.52.87.H10.1.454.CMB.1.raw
tcagcgcagtacgacacgaccggtgctcgatttagcagtactgcgttgggtttgggtgggtttgggggaggtgtgtcacaagatttgggctctgggcacagcggccctgggctgcctggtcaaggactacttcctatacgatcgctgagcgggctggcaaggcgcatag

SEQ ID NO: 249539 - DNA, 171 bp, Homo sapiens
  misc_feature: GYAE6OF01BNHIX.52.87.H10.1.454.CMB.1.raw
  modified_base (170)..(171): a, c, t, g, unknown or other
  misc_feature (170)..(171): n is a, c, g, or t
tcagcgcagtacgacacgaccggtgctcgatttagcagtactgcgttgggtttgggtgggtttgggggaggtgtgtcacaagatttgggctctgggcacagcggccctgggctgcctggtcaaggactacttcctatacgatcgctgagcgggctggcaaggcgcatagnn

SEQ ID NO: 249540 - DNA, 171 bp, Homo sapiens
  misc_feature: GYAE6OF02G7WZM.52.87.H10.1.454.CMB.1.raw
  modified_base (170)..(171): a, c, t, g, unknown or other
  misc_feature (170)..(171): n is a, c, g, or t
tcagcgcagtacgacacgaccggtgctcgatttagcagtactgcgttgggtttgggtgggtttggggaggtgtgtctacaagatttgggctctgggcacagcggccctgggctgcctggtcaaggactacttcctatacgatcgctgagcgggctggcaaggcgcatagnn

SEQ ID NO: 249541 - DNA, 169 bp, Homo sapiens; identical to SEQ ID NO: 249533
  misc_feature: GYAE6OF02IJYIL.52.87.H10.1.454.CMB.1.raw
  modified_base (169)..(169): a, c, t, g, unknown or other
  misc_feature (169)..(169): n is a, c, g, or t

SEQ ID NO: 249542 - DNA, 169 bp, Homo sapiens; identical to SEQ ID NO: 249533
  misc_feature: GYAE6OF02HLSZS.52.87.H10.1.454.CMB.1.raw
  modified_base (169)..(169): a, c, t, g, unknown or other
  misc_feature (169)..(169): n is a, c, g, or t

SEQ ID NO: 249543 - DNA, 184 bp, Homo sapiens
  misc_feature: GYAE6OF02G39G8.52.87.H10.1.454.CMB.1.raw
  modified_base (170)..(184): a, c, t, g, unknown or other
  misc_feature (170)..(184): n is a, c, g, or t
tcagcgcagtacgacacgaccggtgctcgatttagcagtactgcgttgggtttggggtgggtttggggaggtgtgtcacaagatttgggctctgggcacagcggccctgggctgcctggtcaaggactacttcctcgtactgcgctgagcgggctggcaaggcgcatagnnnnnnnnnnnnnnn

SEQ ID NO: 249544 - DNA, 168 bp, Homo sapiens
  misc_feature: GYAE6OF02FF3LN.52.87.H10.1.454.CMB.1.raw
tcagcgcagtacgacacgaccggtgctcgatttagcagtactgcgttgggtttgggtgggtttggggaggtgtgtcacaagatttgggctctgggcacagcggccctgggctgcctggtcaaggactacttcctatacgatcgctgagcgggctggcaaggcgcatag

SEQ ID NO: 249545 - DNA, 171 bp, Homo sapiens; identical to SEQ ID NO: 249539
  misc_feature: GYAE6OF02ILFQU.52.87.H10.1.454.CMB.1.raw
  modified_base (170)..(171): a, c, t, g, unknown or other
  misc_feature (170)..(171): n is a, c, g, or t

SEQ ID NO: 249546 - DNA, 563 bp, Homo sapiens
  misc_feature: GYAE6OF01C7NS2.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacagttatttagtctggtatcagacaaaaaccagggaaagtccctaagctcctgatctatgttgcatccactttgcaaagtgggtcccatcaaggtcagcgcagtgatcgtggacagaattcactctacacaatcagcagcctgcagcctagaacgtatttttcgactaactttaattactagttacaaactagtacttaaattacgttaaccccgcttaccgtaggtttccgggacgggtaaggggtacccgtaaagggttcgggaaacgtaacgttaaccgaaaaaccggtaaacgttacggtagggtaccgtaggtacctaaacccg

SEQ ID NO: 249547 - DNA, 540 bp, Homo sapiens
  misc_feature: GYAE6OF01CBUV2.13.4.A04.1.454.CMB.1.raw
  modified_base (228)..(228): a, c, t, g, unknown or other
  misc_feature (228)..(228): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
  modified_base (490)..(490): a, c, t, g, unknown or other
  misc_feature (490)..(490): n is a, c, g, or t
  modified_base (522)..(522): a, c, t, g, unknown or other
  misc_feature (522)..(522): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggganccatgctgcaagtcgggccagaggtgcccctgaacctgaaaggccaaatgagacccaagacaggccaagtgggttgtgagaccctgaggagctgggccctggtcccaggcagcgctggccctgctgctggctgggtctggcagtcggtcncccatggcctgctgcgcccaagtggtcncgaccgacaaaggccggggaacccagaccccgtggacgcctcaggttggaacgcgagccgatccgagccctgcggagccgtggngggcaggtcacggcccaaggcccaaccctacncgtaccactctcgtcccc

SEQ ID NO: 249548 - DNA, 479 bp, Homo sapiens
  misc_feature: GYAE6OF01BBALA.13.4.A04.1.454.CMB.1.raw
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatcgtgggacagtattttaacttcaccatcagcagcctgcagcctgaagatattgacaacattattactgtcagcagtatgataatctccatcaccttcggacaagggacacgangganattaaagactgaggctgcacta

SEQ ID NO: 249549 - DNA, 541 bp, Homo sapiens
  misc_feature: GYAE6OF01DBV0X.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagctgggccctggtcccaggcagcgctggccctgctgctgctgggtctggccatcggtcgcccatcggcctgctgcgcccaatggttgcaccgcaaacgcggggacccaggacccgtggacgcctgacgttggaagcagccgatccagcctgcggagccgtggtggggcagggtcaggccccgaacggcccaaaccccgactcgccaaccgtctcggttaccccc

SEQ ID NO: 249550 - DNA, 600 bp, Homo sapiens
  misc_feature: GYAE6OF01D0VG6.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtcggtcgcccagtcggcctgctcgccgcccaagtcggttcgccaccggcgaaacggccggggaacccaggaccccgtggacgcccgtcgagttcggaacgcacggcccgactcccgaagcccgtggccggaggcccgtgggtcggggaccgagggtccaacggcccccgaaacgggacccccaaaccccgtaccgtacgtacctacccgttcctcccggtttacccccc

SEQ ID NO: 249551 - DNA, 565 bp, Homo sapiens
  misc_feature: GYAE6OF01BDNJO.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggagcccatgctgcaaggtcgggccagaggtcgcccctgaacctgaaggccaatgagacccaagacaggccaagtgggtgtgagacccctgaggagctgggccctggtcccaggcagcgctggccctgctgctgctgggtctggccagtcggtcgcccagtcggcctgctgccgccaatggttcgcaccgcaaacggccggggacccagacccgtggacgccgtcacggttggaacgcgagccgatcccgagccctgccggagcccgtggtcggggcgacgggtcacggccccgaacgggacccaaccccgacgtcgtaccacctctccgtttacccccg

SEQ ID NO: 249552 - DNA, 546 bp, Homo sapiens
  misc_feature: GYAE6OF01BVYHA.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccatcggttgcacgcaacgcggggacccagaccctggacgcctcagttggaagcagccgatccacgcctgcggagccgtggtggggcgagggtcacggccccgaaacgggccccaaaccccgactcgtaccaccttccgtcggttccccccgg

SEQ ID NO: 249553 - DNA, 490 bp, Homo sapiens
  misc_feature: GYAE6OF01AOTNP.13.4.A04.1.454.CMB.1.raw
tcagtcacgtactacacgaccggtgctcgatttagagtagtgatcagggggcaggagtcagtcccaaccaggacacagcatggacatgagggtccctgctcagcacctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaacagggtccatcaaggttcagtggaagtggatcgtgggacagtatttacttcaccatcagcagcctgcagctagaagtatattgcaacattattactgtcagcagtatgataatctccgatcaccttcggacctaagggacacggacgtaggaataacgttaaacgacttgcggctggacc

SEQ ID NO: 249554 - DNA, 487 bp, Homo sapiens
  misc_feature: GYAE6OF01E23GW.13.4.A04.1.454.CMB.1.raw
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtccatcaaggttcagtggaagtggatcgtgggactagtattttacttcacctatcagcagcctgcagcctagaagatattgactaactattattactgtacagcagtatgatactcctccgatccaccttcggaccgaagggacacgactgganattaacgatgngctgac

SEQ ID NO: 249555 - DNA, 481 bp, Homo sapiens
  misc_feature: GYAE6OF01AMW7W.13.4.A04.1.454.CMB.1.raw
  modified_base (479)..(479): a, c, t, g, unknown or other
  misc_feature (479)..(479): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcacntc

SEQ ID NO: 249556 - DNA, 527 bp, Homo sapiens
  misc_feature: GYAE6OF01BK1YB.13.4.A04.1.454.CMB.1.raw
  modified_base (471)..(471): a, c, t, g, unknown or other
  misc_feature (471)..(471): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatcggtcgcccatcggcctgctgcgcccaatggttgcaccgcaaacgcggggacccaggaccctggacgcctcagttggaagcagccgatccagcctgcgngcctggngggcnggtcaggcccaaggcccaacccnctcgacnctctcgttcccccg

SEQ ID NO: 249557 - DNA, 496 bp, Homo sapiens
  misc_feature: GYAE6OF01BJ3PZ.13.4.A04.1.454.CMB.1.raw
  modified_base (389)..(389): a, c, t, g, unknown or other
  misc_feature (389)..(389): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtgggtccatcaaggttcagcggcagtggatctggcacagacttcattctcaccatcagcagcctgcagcctgaagtnttttgctaacttattactgtctactaagatacactaattactccgtggtacgttcggaccgaagggacaaggtcggaaatcgaaacgtaactgtaggctgctaaccg

SEQ ID NO: 249558 - DNA, 498 bp, Homo sapiens
  misc_feature: GYAE6OF01B5E1P.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaatggtatcagcagaaaccaggtaaagcccctaagctcctgatctacgatgcatccaatttggaaacagggtccatcaagttcagtggaagtggatcgtgggactagtattttacttcacctatcagcagcctgcagcctagaagtatattgacaactatattactgtacagcagtatgataactctccgtatcctacctcggaccgaagggacacgtacgtaggaataacgttaaacgactagtcgcgtgacc

SEQ ID NO: 249559 - DNA, 510 bp, Homo sapiens
  misc_feature: GYAE6OF01CSJFD.13.4.A04.1.454.CMB.1.raw
  modified_base (253)..(253): a, c, t, g, unknown or other
  misc_feature (253)..(253): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaatgtatcagnagaaccagtaaacgcccctaagctctgatctacgatgacatacctaatttaggaaacagggtcccaagtcaaaggttcaggtaggaagtggtatcgtagggactaggtattttacttacacatcagcagctgcagcctagaagatatagacaactatattactgtacagcagtatagattaactcctaccctatccacccgttacgacccgtaagggaccacgacgtaggaataagtaaacgactaggcgtctgacc

SEQ ID NO: 249560 - DNA, 474 bp, Homo sapiens
  misc_feature: GYAE6OF01CJMWE.13.4.A04.1.454.CMB.1.raw
  modified_base (451)..(451): a, c, t, g, unknown or other
  misc_feature (451)..(451): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcagtcaggacattaacaactatttaaattggtatcagcagaaaccaggtaaagcccctaagctcctgatctacgatgcatccaatttggaaacaggggtcccatcaaggttcagtggaagtggatctggacagatttacttcaccatcagcagcctgcagcctagaagatattgacaacatattactgtcagcagtatgataatctccgatcaccttcgccaagggacacgatgganattaaacgactgtgctgcactac

SEQ ID NO: 249561 - DNA, 481 bp, Homo sapiens
  misc_feature: GYAE6OF01BSL5F.13.4.A04.1.454.CMB.1.raw
  modified_base (268)..(268): a, c, t, g, unknown or other
  misc_feature (268)..(268): n is a, c, g, or t
  modified_base (477)..(477): a, c, t, g, unknown or other
  misc_feature (477)..(477): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaancccctaagctcctgatctacgatgcatcctaatttaggaaacaggggtccatcgaaggttcaggtggaagtggatcgtaggactagtattttacgttcacatcagcagcctgcagcctagaagatagttgacaatatattactgcagcagtatgatatctccatcacttcgacaggacacgataggataataaacgacgtgacgatgcnctac

SEQ ID NO: 249562 - DNA, 484 bp, Homo sapiens
  misc_feature: GYAE6OF01CL0L4.13.4.A04.1.454.CMB.1.raw
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaattggaaacagggtcccatcaaggttcagtggaagtggatcgtgggacaggtattttactttcaccatcagcagcctgcagcctgaagatattgcaacatattactgtcagcagtatgataactctaccgatcaccttcgccgaaagggcacgactggaanattaaacgactagtggntgac

SEQ ID NO: 249563 - DNA, 695 bp, Homo sapiens
  misc_feature: GYAE6OF01CZ6IK.13.4.A04.1.454.CMB.1.raw
  modified_base (273)..(273): a, c, t, g, unknown or other
  misc_feature (273)..(273): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccatcacttgccaggcgagtcaggacattaacaactatttaaatggtatcagcagaaaccaggtaaacncccctaagcctcctagactctacgatcgacactacctaaagtttacgggaaaacctacggggtaccccaagttaccgaaagggtttcaagggttagggaaaggttgggaacgttcggttaggggaaccttaaggttaacttttttaaccgttccaacctagttccgaaggtccgaacgtcccgttaggacctacggtacccttaaggaaacgttattaagtttacggaacctaaacgttaatttaactttaaccgtagttaccgaagtctaaaggttacttaaggaaacttaaccgtcccgttaccccgtaattaccccgtaacccggtttaccgggaacccgtaaacggggaccaaaccggtccggtaagggtaaacgtaacgtttaaaaccggacgttaggtacggtcctacggtacccg

SEQ ID NO: 249564 - DNA, 517 bp, Homo sapiens
  misc_feature: GYAE6OF01BF4BN.13.4.A04.1.454.CMB.1.raw
  modified_base (439)..(439): a, c, t, g, unknown or other
  misc_feature (439)..(439): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattggtatcagcagaaaccaggtaaagcccctaagctcctgatctatgttgcatccactttgcaaagtcggggtcccatcaaggttcagcggcagtggatctggacagattcactctcacaatcagcagcctgcagcctagaagtattttgactaactttattactagtacaactagtacttaatacgttacccncgttactacgtttcggacggacgggtacctaagggtggaacgtatacgaaacgtaacgtggtaggctcggctaacccg

SEQ ID NO: 249565 - DNA, 596 bp, Homo sapiens
  misc_feature: GYAE6OF01BUE54.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggagcccatgctgcaagtcgggccaggaggtgcccctgaacctgaaggccaatgagacccaagacaggccaagtgggttgtgagacccctgaggagctgggccctggtcccaggcagcgctggccctgctgctgctgggtctggccagtcggtcgcccatcggcctgctgccgacccgaatcgggttgccgtaccgacgtaaacggccggggtaacccgacggacccgtggacgtccgtcgacggttcggaacgcgacggccgtactccgacgccgtagtcggacgtccgtgggtcgggcgacgggtcacggtcccgaacgggccccaaaccccgtccgtacgtaccaccgttccgttccgttaccccccg

SEQ ID NO: 249566 - DNA, 502 bp, Homo sapiens
  misc_feature: GYAE6OF01A8BI3.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaacgcccctaagctcctgatctacgatgcatccaatttggaaacagggtcccatcaaggttcagtggaagtggatctgggactagtattttacttcaccatcagcagcctgcagcctagaagtatagttgacaaacattattactgtcagcagtatgaattaatcacccgatccaccgttcggaccaaacgggcacgtactaggaactaagtaaacgaacgtgtacggatgccacta

SEQ ID NO: 249567 - DNA, 646 bp, Homo sapiens
  misc_feature: GYAE6OF01DFS2B.13.4.A04.1.454.CMB.1.raw
  modified_base (229)..(229): a, c, t, g, unknown or other
  misc_feature (229)..(229): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacnccatgctgcaagtcgggcagaggtcgcccctgaacctgaaggccaatgagacccaagacaggccaagtgggttgtgacgaccctggacggacgctcgggccctcggtcccaggcgagcgctcggccctgctgctgctggtctcggcagtcggtcgccgatcggcctgctcgcgcccgaagtcggttcgcgaaccggcgaaacgggccggggtacccacggaccccgtacggaccgcccgtacgacggttagggaacgccgacggacccgtaacgtcccgaacggcccgtacgggtacccgggacggtcccggttgggtaccgggggccgacgggttcccgaaccggaccccggaaaccgggaccccaaacccccggtctaccggtaccctacccgttcccgttccggttaccccccc

SEQ ID NO: 249568 - DNA, 516 bp, Homo sapiens
  misc_feature: GYAE6OF01BDCAO.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctggcacagacttcattctcaccatcagcagccctgcagcctgaagtatttgactaactttattactgtactaacaagactacaactaattactccgtgggaccgttcggacctaaagggaccgtaagggtacggaaatacgaaacgaactggtaggtctgaccactagtcttacg

SEQ ID NO: 249569 - DNA, 501 bp, Homo sapiens
  misc_feature: GYAE6OF01A7A81.13.4.A04.1.454.CMB.1.raw
  modified_base (474)..(474): a, c, t, g, unknown or other
  misc_feature (474)..(474): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaacgcccctaagctcctgatctacgatgcatccaatttggaaacacgggtccatcaaggttcagtggaagtggatcgtgggactagtattttacttcaccatcagcagctgcagcctagaacgatattgacaacattattactgtacagtcagtatagataatcctaccgatcaccttacggaccaagggacacggactaggaanaacttaaacgacttaggtcgcgtgacc

SEQ ID NO: 249570 - DNA, 519 bp, Homo sapiens
  misc_feature: GYAE6OF01BVPC8.13.4.A04.1.454.CMB.1.raw
  modified_base (409)..(409): a, c, t, g, unknown or other
  misc_feature (409)..(409): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacaattaacaactatttaatgtatcagcagaacaggtaaacgcccctaagctctgatctacgatgcatccaatttaggaaacgagggttccaagttacaaggtttcaggttaggaagtggatcgtagggactagtactttacttcactatcagcagcctagcagcctagaacgatattcganaactattatacgtgtacagctaagtatagaataactctaccgatcctacgttccgaccgaaggacacgtacgtaggaataagttaaaacgacgtagtcgcgtggtaaccc

SEQ ID NO: 249571 - DNA, 508 bp, Homo sapiens
  misc_feature: GYAE6OF01B14N2.13.4.A04.1.454.CMB.1.raw
  modified_base (267)..(267): a, c, t, g, unknown or other
  misc_feature (267)..(267): n is a, c, g, or t
  modified_base (308)..(308): a, c, t, g, unknown or other
  misc_feature (308)..(308): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaatggtatcagcagaaaccaggtaaancccctaagctcctgatctacgatgcatccaatttggaaacngggtcccatcaaggttcagtggaagtgatctggacagtattttacttcacctatcagcagcctgcagcctagaatatattgacaactatagttactgtcagctagtatgtataactctaccgatccaccgttcggacccaaagggcaacgtactagggaagaaacgttaaacgaagtcggttagacctcggaccactacg

SEQ ID NO: 249572 - DNA, 586 bp, Homo sapiens
  misc_feature: GYAE6OF01D1QFR.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggccgagtcaggaccattaacactattaaattggatcagcagaaaccaggtaaacgcccctaagctcctgactctatgttgcatcactttgacaaagtcgggtaccatcgaaggttcagcgacagtgatcgtggacaggtaacttcgactcgtacactaactcgagacagtcctgacacggtcctagaacgttacgttttcgaaccttaacgtttacttaccgtacgttaaccgaacgtaagttacctttaaacgtaccggtttacccgacgttacgtacggttttaccgggacgggttacgggaacccgtaagggtacgaagttacgtaacggaaacgtactcgggttcgacttaggcctaaccgtgttacccg

SEQ ID NO: 249573 - DNA, 615 bp, Homo sapiens
  misc_feature: GYAE6OF01DCGJ6.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggagcccatgctgcaagtcgggccagaggtgcccctgaacctgaaggccaatgacgacccaagacaggccaaggtgggtgtgacgacccgtggaggagcgtcgggccctggtcccaggcagcgctggccctgctgctgcgtgggtctggccagtcggtccgcccagtcggcctggcgtcgccgtaccagttcgggttcgcaccggacgaaacggccgggacccacggacccgtggaccgcgtacgaggttggaacgcgaacgccgagtcccgagccgtcggcgggaccgtccggtggtacgggggcgtacgggtaccgacggaccccgaaacggaccccaaacccccgtcgtaccgtacctaaccgttcccgttccggttacccccccgg

SEQ ID NO: 249574 - DNA, 524 bp, Homo sapiens
  misc_feature: GYAE6OF01CBW6C.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagacagaaaccaggtaaacgcccctaagctcctgatctacgatgcatccaatttaggaacagggtccatcagttcagtggaagtgatcgtgggactagtattttacttcaccatcagcagctgcagcctgaatatttgactaacttattactgtactacaagtactacaactaatttactccgttagggtacgttccggaccgaaagggaccgaaaggtcggaaaatacgaaacgtacgtggtacggctacggacacctattcgtgttac

SEQ ID NO: 249575 - DNA, 533 bp, Homo sapiens
  misc_feature: GYAE6OF01BESVN.13.4.A04.1.454.CMB.1.raw
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcagtcaggacattaacaactatttaaattggtatcagcagaaaccaggtaaacgcccctaagctcctgatctacgatgcatccaatttaggaaacagggtacccatcaaggttcagtggaagtggatcgtgggactagtattttacttcacatcagcagcctgcagcctagaacgatattgactaanattattactntacagcaagtatgaattaactcctaccgtataccaccgttccggaccaaacgggaccaccggtaatagggaaacgtaacgttaaaaccggaacgttcggtacggactacgacctacgtaacg

SEQ ID NO: 249576 - DNA, 577 bp, Homo sapiens
  misc_feature: GYAE6OF01BN6U8.13.4.A04.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggancccatgctgcaagtcggcagngtgcccctgacctgaaggccaatgagacccaagacaggccaaggtgggttgtgacgacccctgaggagcgtgggccctggtcccaggcagcgctcggccctgctgctgctgggtctggccagtcggtcgccgagtcggcctgctcgcgccagtcggtgccgaccgacgaacggccgggacccacggaccccgtggacgccgtcgacgttaggaacgcgacgccgactccgagcccgtggccggagccgtggtgggccgacgggtccacggccccgaacggaccccaacccgtctaccgtacctacccttcgtcccggttaccccccg

SEQ ID NO: 249577 - DNA, 487 bp, Homo sapiens
  misc_feature: GYAE6OF01CALIQ.13.4.A04.1.454.CMB.1.raw
  modified_base (480)..(480): a, c, t, g, unknown or other
  misc_feature (480)..(480): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtccatcaaggttcagtggaagtggatcgtgggacagtattttacttcaccatcagcagcctgcagcctagaagatattgacaacatattactgtcagcagtatgataatctccgatccaccttcggaccaagggacacggactaggaatattaaacgacttggngctgacc

SEQ ID NO: 249578 - DNA, 566 bp, Homo sapiens
  misc_feature: GYAE6OF01CR3YT.13.4.A04.1.454.CMB.1.raw
  modified_base (265)..(265): a, c, t, g, unknown or other
  misc_feature (265)..(265): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcattcgccaggcagtcaggacattaacaactatttaatgtatcagacagaaacaggtaaacnccctaagctcctgactctacgatgacatacctaagtttaggaaacgtacggggtaccctaagtaccgtaaaggtttcgaaggtagggaagtggaatcgtaggactagttacttttactttacaacctatacagacacgtcctgactacgcctaagaagtatattcgaacaactattacttaactgtaccagactagtactataagttaactcgttacccgatacctacgttaccggacgtaaaacggcgacgtacgtagggtaaacaacgttaaaacgacgttgacggctagcctacgtac

SEQ ID NO: 249579 - DNA, 614 bp, Homo sapiens
  misc_feature: GYAE6OF01A3DMM.13.4.A04.1.454.CMB.1.raw
  modified_base (446)..(446): a, c, t, g, unknown or other
  misc_feature (446)..(446): n is a, c, g, or t
tcagtcacgtactacacgaccggtgctcgatttagagtagtgatcagggggcagttggtagatgcccctctgggagagatccccgaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccagaggtcgcccctgaacctgaacggccaatgagacccaagacaggaccaaggtggtgtgagacccctggaggagcgtcgggccctggtccccagggcaggcgctcggccctgctgctgctgggtctggcagtcgtcgccagtcggcctgctcgccgccagtcggtcgcgaaccgccgaaacggcccgggaacccncggacccgtcggacgcctcgacggttacggaacgccgacggccgtacgtccgacgcccgtggccggacgtccgtgggtcggggcgtaccgggtccgacggcccccgaaacggtacccccaaaccccgtaccgtacgtacccgaccttcccgttacccgttaccccccg

SEQ ID NO: 249580 - DNA, 663 bp, Homo sapiens
  misc_feature: GYAE6OF01DCNUJ.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggccaccgtcctccgagggacgcccatcgctgcaaggtcgggccaggaggtcgcccctgaacctgaacggccaatgacgacccaagacaggaccaaggtggttgtgacgaccctggaggagcgtcgggccctggtcccaggcagcgctcggccctgctgctgcgtggtctcggccagtcggtccgccgagtcggcctgccgtcgccgacctaagtcggttcgaccgtaccggacgaaacgggcccggggaacccgacggaccccgtgggacctacccggtacgtacggttacggaacggtccgacggacccggtactaccgtacgcccgtaggacccgggtacgtccggtacgggtcggggccgtaacgggtccgaaccgggtccccggaaaccgggtaccccaaaccccggtacgtaccggtacctacccgttccgttcccggttccccccg

SEQ ID NO: 249581 - DNA, 566 bp, Homo sapiens
  misc_feature: GYAE6OF01DV0WK.13.4.A04.1.454.CMB.1.raw
tcagtcacgtactacacgaccggtgctcgatttagagtagtgatcagggggagtcagtcccaaccaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccaagtttaaaaagtggggtcccaatcaaggttcagcggcagtggatctggcacagacttcattctcaccatcagcagcctgcagcctgaagtattttgctaactttattacttgtactaacaagtactacaactaatttactccgttaggggtaccgtttcggacccgtaaaggggaacccgaaagggttagggtaaaactacgaaaaccggtaacgttacgggttaggaccgttacggacctaaccctaacgttccgttcggtttaccc

SEQ ID NO: 249582 - DNA, 495 bp, Homo sapiens
  misc_feature: GYAE6OF01A560Z.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtcccatcaaggtcagtggaagtgatcgtggactagtattttacttcaccatcagcagcctgcagcctgaagtatattgcaactatattactgtcagcagtatgaataatctaccgatccaccttcggacccaagggacacggagtggaacgtaattaaacggaactgtaggctgcctactacg

SEQ ID NO: 249583 - DNA, 715 bp, Homo sapiens
  misc_feature: GYAE6OF01BCZBB.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcagacattaacaactattaaattggtatcagcagaaaccaggtaaacgcccctaagcctcctgatctacgatcgactatacctaatttacgggaaaactacggggttaccccaagttaccgtaaaggggtttccgaaggttaggggaaacggttagggtaacttcgttacgggggaacttaaggttaacttttttaacctttaccgaaccctacttaccaaggtaccaacggtccccgttagacccgtaggtaccccgttaaggtaaacggtaacgttttaattacggtaacctaaaccgttaactttaacgttttaacccttaggttacctaacggtacccttaaagggttaacttaaggtaaacttaacgttccctaaccccggtattacccgtacccgtttacccgggaacccgaacgggtaaccaccggtaacgtacgggtaaagtaaacggttaaaaccggaaccgttaggtacggcgttacgaacc

SEQ ID NO: 249584 - DNA, 506 bp, Homo sapiens
  misc_feature: GYAE6OF01ECEFF.13.4.A04.1.454.CMB.1.raw
  modified_base (274)..(274): a, c, t, g, unknown or other
  misc_feature (274)..(274): n is a, c, g, or t
  modified_base (499)..(499): a, c, t, g, unknown or other
  misc_feature (499)..(499): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaacttatttaaattggtatcagcaagaaaccaggtaacncccctaagctcctgatctacgatgacatcctaatttaggaaacgtacggggtccatcgaaggttcagtggaagtggatcgtgggactagtattttacttcactatcagcagcctgcagcctagaagtatattcgacaactattattactgtacagctagtatgatactctccgatcaccgtcgaccgaacggtacacggtacgtaggataacgtaacgacgtagngctgacc

SEQ ID NO: 249585 - DNA, 539 bp, Homo sapiens
  misc_feature: GYAE6OF01BKLL7.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaatggtatcagcagaaaccaggtaagcccctaagctctgatctacgatgcatccaatttggaaacagggtccatcaagtcagtaggagtggatcgtgggactagtatttacttcacatcagcagcctgcagctagaagtatattgactaactattattactgtacaactagtacttaaacttacgttacccgcttactacggtttaccggacgggtaacgggaaccgtaagggtggtaagaagttaccgaaaacggtaacgttacgggtacggacttaggacctacccgtgttaccg

SEQ ID NO: 249586 - DNA, 531 bp, Homo sapiens
  misc_feature: GYAE6OF01B4R7H.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaatgtatcagcagaaaccaggtaaagcccctaagctcctgatctacgatgcatcctaatttggaaacagggtacccatcaaggttcagtaggaagtggatcgtgggactagtatttacttcactatcagcagcctgcagcctagagtatattgacaactaattattactgtacagtcgtagttatgtaataactcctcccgaacttccaaccgttcggaccgtaaagggacccaacggtactagggaaactaacgttaaacgaacgttaggacggtcgtgtaacccg

SEQ ID NO: 249587 - DNA, 522 bp, Homo sapiens
  misc_feature: GYAE6OF01A9DS9.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattggtatcagacagaaaccaggtaaacgcccctaagctcctgatctacgatgcatccaatttaggaaacacgggtccatcaaggttcagtggaagtggatcgtgggactagtattttacttcacctatcagcagccctgcagcctagaagtattattgactaactatatttactgtcagcaagtatagaattaatcctaccgatccaccgttacggaccgaagggaccacggacgttaggaagtaacgttaaacggaacttggtacggcgtcgaccg

SEQ ID NO: 249588 - DNA, 624 bp, Homo sapiens
  misc_feature: GYAE6OF01A8ZT2.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtgggtgtgagaccctgaggagctgggccctggtcccaggcagcgctggcccctgctgctgcgtgggtctggccagtcgggtccgcccgagtcgggcccttggccgtcggccgtacccgtaagttcgggttacgccgtaacccggacgaaacggccggggaccccacggaccccgtgggaccgccgtcgaggttcggaacgcgacgccgactccgacgccgtggccggagtccgtgggtcggggcgtacgggtaccgacggccccgaaacgggacccccaaaccccgtaccgtaccggtacccaccgttcccgtcccgttaccccccg

SEQ ID NO: 249589 - DNA, 551 bp, Homo sapiens
  misc_feature: GYAE6OF01CJ9CD.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccagggaaagcccctaagctcttgatctatggtgcatccaagtttaaaaagtgggtacccatcaaggttcagcggcagtggatctggcacagacttcattctcaccatcagcagcctgcagtcctgtaagtattttgactaactttattactgtacctacaagtatacaactaatttactccgttgggtaccgtttccgggaccgtaaacggggtaccctaaagggttacggaaaacttaccgaaaaaccggtaaacgttacggtacggaccttacgaccaccgtaacg

SEQ ID NO: 249590 - DNA, 797 bp, Homo sapiens
  misc_feature: GYAE6OF01DPN7K.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacattcagatgacccagtctccatcctcctgtctgcatctgtaggagacagagtcaccatcacttgccaggcagtcagacattaacaactatttaatgtatcagacagaaaccaggtaacgcccctaagctcctgatctacgatcgactataccgtaaagttacgggaaaaccgtacggggtaccctaagttaccgtaaaggggtttcgaagggttagggtaaacggttgggaagttccggtaggggtaacctaaggtttaactttttttacctttaccgtaacctaattaccgaacggtaccgtaacggtccccgtttagggaaccctaacgggtaccccgttaagggtaaaacgttagtttaaacgtttacggaacccttaaaccgttaaattttaaccgttttaccgttaacggttaccgaaacggtaccttaaagggttaattacggttaaactttaaacccttcccgttaaccccggtaaacctttaccccggtaacccccggttttaaccggggaacccccgtaaaacggggggaaacccttaaacccggggaaccggtttaacgggggtaaaacgtttaaaaccggtttaaaaccgggttaaaccgttggggtttaaaccgggttccttaacccgggtaaacccc

SEQ ID NO: 249591 - DNA, 493 bp, Homo sapiens
  misc_feature: GYAE6OF01A0QA4.13.4.A04.1.454.CMB.1.raw
  modified_base (219)..(219): a, c, t, g, unknown or other
  misc_feature (219)..(219): n is a, c, g, or t
  modified_base (409)..(409): a, c, t, g, unknown or other
  misc_feature (409)..(409): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgccatccagatgacccagtctccatcctccctgtctgcatctgtaggagacagagtcaccatcacttgccgggnaagtcaggcattagaatgattaggctggtatcagcagaaaccagggaaagccctaagctcttgatctatggtgcatccagtttaaaagtgggtccatcaaggttcagcgcagtggatctggcacagacttcattctcaccatcagcagcctgcagcctgaagtattttgactaacttattactgtactanaagatacactattactcctagggacgttcggacgaacgggaccaaggtggaaactacgaaacgtactgtaggctcgtctaaccg

SEQ ID NO: 249592 - DNA, 624 bp, Homo sapiens
  misc_feature: GYAE6OF01CBUB9.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccagaggtcgcccctgaacctgaaggccaatgagacccaagacaggccaaggtggttgtgacgaccccgtggaggagcgtcgggccctggtcccaggcgagcgctcggccctgctgctgcgtggtctgccagtcggtccgccagtcggcctgcgtcgccgcctagtcggtcgccgacgacgaacggccgggaacccacggacccgtggaccgcctcgaggttcggaagccgacgccgactccgacggcccgtggaccgggtcggccggtacgggtcggggaccgtacgggtacccgaaccggtaccccgaacccgggaccccaaaccccgtaccgtcgtaccccgtacccgttccgttaccccgttacccccccg

SEQ ID NO: 249593 - DNA, 635 bp, Homo sapiens
  misc_feature: GYAE6OF01DUAZS.13.4.A04.1.454.CMB.1.raw
  modified_base (228)..(228): a, c, t, g, unknown or other
  misc_feature (228)..(228): n is a, c, g, or t
  modified_base (526)..(526): a, c, t, g, unknown or other
  misc_feature (526)..(526): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggngcccatgctgcaaggtcggccagaggtcgcccctgaacctggaacggccaagtcgacgacccaagacgaggccaaggtgggtgtgacgacccgtggaggacgcgtcgggccctcgggtcccaggcacgcgcgtcggccctgcgtcgctggcgtcgggtctacggccgagtcggtccgccgtacgtcggccgtcgcgtcggccgtaccgtaagtcgggttcgccgtaccggacggaaaccggcccggggaaccacggacccgtggaccgccgtgtacggtggaacgcgtacgccgtacnccgacgccgtcggcgacgtccggtggcgggaccgacggtccgacggtacccgaccggtaccccaaccccgtacgtccggtacctaccgttcccgtcccgttaccccccg

SEQ ID NO: 249594 - DNA, 602 bp, Homo sapiens
  misc_feature: GYAE6OF01B0JVK.13.4.A04.1.454.CMB.1.raw
  modified_base (483)..(483): a, c, t, g, unknown or other
  misc_feature (483)..(483): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcagactaattaactaacttatttaaattgtatacagacaagaaacctaaggtaaacgacccctaagcctcctagactactacgatcgactatacctaagttacggaaaccgtacgggtaccagtacgtaacggttacgtaaggtacggtaaggtggtacgtcggtagggtaactagtttaacttttacttacaacctatcgacgctacgcctagccgtagtaccgtagtaagtattagttcgaacaattattaacttacngtacagtactaagtatacgtaatacgtcctaccgacttacgtacccggtacggaaccgaacgggtacacggtacgtaaggtaacgtaacgttaaaccgagttaggcgtcgtccgtaacg

SEQ ID NO: 249595 - DNA, 557 bp, Homo sapiens
  misc_feature: GYAE6OF01BY52Y.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaatgtatcagacagaaaccaggtaaacgcccctaagcctcctgactctacgatcgacatacctaatttaggaaacgaggggtcccaataccgaaggttcaaggtggaagtggatcgtggactagtattttacttacactatcagcacgcctagcagacctaggaagtattattagactaactattatttactgtacagactaagttagtagtaattacgtcctacccgtataccgtaccgttaccggaccgtaaagggacctaacggtacgtaggaagtaacgttaaacgacgtacggtacggactcgaccgctacg

SEQ ID NO: 249596 - DNA, 638 bp, Homo sapiens
  misc_feature: GYAE6OF01E06SX.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccaggaggtcgcccctgaacctgaaggccaatgagacccaagacaggccaagtgggttgtgagacccgtgaggagcgtgggccctggtcccaggcgagcgctcggcccctgctgctgcgtgggtctcggccagtcggtcgcccgagtcggcctcgctcgccgtcccgaagttcgggttacgccgtaaccggacgaaaccggcccgggggaaccccacggtaccccgtacgggaccgcccgttacgacggttcggaacgcgaacgcccgactccgacgtcccgtggccggacgccgtgggtcggggcgtacgggtccaacggtccccgaaaccgggaccccaaaccccgtacgttaccggtaccctaccgttccgtcccggttccccccgg

SEQ ID NO: 249597 - DNA, 532 bp, Homo sapiens
  misc_feature: GYAE6OF01EAD94.13.4.A04.1.454.CMB.1.raw
  modified_base (267)..(267): a, c, t, g, unknown or other
  misc_feature (267)..(267): n is a, c, g, or t
  modified_base (388)..(388): a, c, t, g, unknown or other
  misc_feature (388)..(388): n is a, c, g, or t
  modified_base (497)..(497): a, c, t, g, unknown or other
  misc_feature (497)..(497): n is a, c, g, or t
  modified_base (523)..(523): a, c, t, g, unknown or other
  misc_feature (523)..(523): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggccagtcaggacattaacagtttatttagtctggtatcagacaaaaaccnggaaacgtccctaagcctctgatctatgttgcatccctatttgacgtaaaggtcgggtacccagtcaaggttcaggcgcagtggatcgtgggacagtattcactctacacatcagcagctncacgctagaattatttcgactaacttattactactactaacacgtacttaacttacgtaccgttcgtacttacggttcggtacgggacgggaacggtaggtaggagtanacgtaaacgaacgtgtacggagtacncgtactacg

SEQ ID NO: 249598 - DNA, 754 bp, Homo sapiens
  misc_feature: GYAE6OF01C3ZFN.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctcccaggtgccagatgtgccatccagatgacccagtctccatcctccctgtctgcatctgtaggagacagagtcaccatcacttgccgggcaagtcagggcattaagaatgtatttaggctggtatcagacaagaaaccgagggaaacgcccctaagctcttgactctagtggtgactataccgtaaggtttaaaaacggtcggggtacccaagttacgtaaaggttcgaaggcggtacgaaggttggatcgtagggacaacgtagtaccttactagtttcctacctaacctagttaccaacggacctaacggtcccttacggacctaacggtacccgttaaggtaaacgtttacgttttttacggtaaccttaaacgtttttaactttaaccgtttacggtttaacccttaaacgtaaacggttaaccttaaccttaaacctttaaacgttttacccggttaacccgggtttaccgggggttaaaccccggtttacccggggaaacccggttaaaaccggggggtaaaacccgtaaagggggttaaacggtaaaaacgttaaccggtaaaaaccggtaacgttacgggttacggtaccgttaaccggaccgtaacccgttaaccg

SEQ ID NO: 249599 - DNA, 526 bp, Homo sapiens
  misc_feature: GYAE6OF01CKB3V.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctcccagataccagatgtgacatccagatgacccagtctccatcctccctgtctgcatctcttggagacagagtcaccgtcacgttgccgggcgagtcacgacattaacacttattagcctggtatcagcagaagccagggagagtccctaaattattgatctctgctgcgtccgccttgcgaagtccggggtccatcgtcggttcaggtggcggtggatcgtaggacagtaattcactctcaaccataccaccaacctcgccacctagaagatgttaggtaagtttattactgtcagtactagtaggtggtcggtcccgtctcttacgtttcggacgggagggaccgaaggtgcgagatacgaaacgacgtggtcggtctcgacacctagtcgttacg

SEQ ID NO: 249600 - DNA, 480 bp, Homo sapiens
  misc_feature: GYAE6OF01BCALM.13.4.A04.1.454.CMB.1.raw
  modified_base (425)..(425): a, c, t, g, unknown or other
  misc_feature (425)..(425): n is a, c, g, or t
  modified_base (460)..(460): a, c, t, g, unknown or other
  misc_feature (460)..(460): n is a, c, g, or t
  modified_base (473)..(473): a, c, t, g, unknown or other
  misc_feature (473)..(473): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtccatcaaggttcagtgaagtggatcgtgggacagtattttacttcacctatcagcagcctgcagcctgaagatattgcaacatattactgtcagcagtatgataatcnccgatccaccttcggccaagggacacggctagganagttaaacgatgngctgacc

SEQ ID NO: 249601 - DNA, 496 bp, Homo sapiens
  misc_feature: GYAE6OF01AZ9AL.13.4.A04.1.454.CMB.1.raw
  modified_base (394)..(394): a, c, t, g, unknown or other
  misc_feature (394)..(394): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcataccaaatttaggaaacaggggtccatcaaggttcagtggaagtggatctgggactagtattttactttcacctatcagcagcctgcagctagaanatatgacaactatattactgtaccagcagtatgaatatcaccgatcaccttcggacgaacggacacgacgtaggagtaactaaacgactggtcgtcgtgacc

SEQ ID NO: 249602 - DNA, 532 bp, Homo sapiens
  misc_feature: GYAE6OF01AF451.13.4.A04.1.454.CMB.1.raw
tcagtcacgtactacacgaccggtgctcgatttagagtagtgatcagggggcaggagtcagtcccaatcaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcgagtcaggacattaacaactatttaaattggtatcagcagaaaccaggtaaacgcccctaagctcctgatctacgatgcatccaatttaggaaacacggggtcccatcaaggttcagtggaagtggatcgtgggactagtattttacttcacctatcagcagcctgcagcctgaagtatattgactaacattattactgtacagtactagtatagaacttacgtcctacccgtattcccgtaacccgttccggacccgaagggtaccacggacgtacggaagtaacgttaaacggaacttgggtaggcgtacgg

SEQ ID NO: 249603 - DNA, 543 bp, Homo sapiens
  misc_feature: GYAE6OF01AOKSP.13.4.A04.1.454.CMB.1.raw
  modified_base (315)..(315): a, c, t, g, unknown or other
  misc_feature (315)..(315): n is a, c, g, or t
  modified_base (370)..(370): a, c, t, g, unknown or other
  misc_feature (370)..(370): n is a, c, g, or t
tcagtcacgtactacacgaccggtgctcgatttagagtagtgatcagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattaacaactatttaaattggtatcagcagaaaccaggtaaacgcccctaagctcctgatctacgatgcatccaatttaggaaacncggggtcccagtcaaggttcaggtgagtgatctgggacagtattttacttcaccntcagcagcctgctagccttagaagtattattcgactaactattattactgtacagtcaagttatgtaattaactcctacccgattacccaccgttcggaacccgtaagggacctacgtacgttcgggaacgtaacttaaaacggacgttggtacggactcggactacccgtag

SEQ ID NO: 249604 - DNA, 576 bp, Homo sapiens
  misc_feature: GYAE6OF01EF7HH.13.4.A04.1.454.CMB.1.raw
  modified_base (228)..(228): a, c, t, g, unknown or other
  misc_feature (228)..(228): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaaggtcgggccagaggtcgcccctgaacctgaaggccaatgagacccaagacaggccaagtgggttgtgagacccctgaggagcgtcgggccctggtcccaggcagcgctggcccctgctgctgctgggtctggccatcggtcgcccgagtcggcctgctgccgccaagtggttcgcaccgcaaacggccggggacccacgacccgtggaccgcctacgaggttggaacgccgagcccgatccgacgccgtgccggagtccgtggtcggggcgacgggtcacggtccccgaacggccccaaaccccgtcgtacgtaccaccttccgtcgttacccccc

SEQ ID NO: 249605 - DNA, 617 bp, Homo sapiens
  misc_feature: GYAE6OF01EY5PZ.13.4.A04.1.454.CMB.1.raw
  modified_base (382)..(382): a, c, t, g, unknown or other
  misc_feature (382)..(382): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatcgagacccaagacaggaccaagtggttgtgacgacccgtgaggagcgtgggccctggtcccaggcagcgcgtggccctgctgctgctgggtctggccagtcggtcnccgagtcggccgtcgctcggccgcccgtaagttcgggttacgccgtaccgaccgaaacggcccggggaacccacggacccgtaggaccgtccgtacgaggttaggaacgacgtacggccgaacgtcccgaagcccgtggaccgggcgaccggtgggcggggaccgtaggtccgaacggcccgaaaccggccccaaaccccgtacgttacgaccctccgtccgttccgttcccccg

SEQ ID NO: 249606 - DNA, 553 bp, Homo sapiens
  misc_feature: GYAE6OF01DIT5X.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccaggaggtgcccctgaacctgaaggccaatgagacccaagacaggccaagtgggtgtgagacccctgaggagctgggccctggtcccaggcagcgctggccctgctgctgctgggtctggccatcggtcgcccagtcggccttgcgtcgccgccccaagtcgggttgcctaccggacgaaacggccggggacccaggaccccgtggacgcctcgagttcggaagcagccgatccagcctgcgacgcgtgtggggcgaggtcacggcccaagggccccaacccgctacgtccactcgtcgttacccc

SEQ ID NO: 249607 - DNA, 753 bp, Homo sapiens
  misc_feature: GYAE6OF01BJEQY.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccatcacttgccaggcgagtcaggacattaacaactatttaaattggtatcagcaagaaaccaggtaaacgaccctaagcctactgactctacgatgactatacctaatttagggaaacgtacggggtacccagttacgaaggtttcgaaggttagggaacggttagggacttacggtaggggaactaaggtttaacttttttaaccgtttacctaacccgtactaccgaacgaccgtacggtaccccgttaggaccctacggtacccgttaggaaaacggttaacttaacgtttaacggtaaacctaaacctaactttaacttttaaccgttacggtacaacggtacctaaaggttaacgttaggttaaacttaaaccgttacccgttaccccggtaacgttaccccgtaacccggtttacccgggaacccggtaaaaccgggggtaaccctaaaccgggtaaccggttaaggggtaaaccgttaaaacgtttaaaacccggtaacggttacgggtacgggttaccgtaacggtacccctaaccgttaaccg

SEQ ID NO: 249608 - DNA, 647 bp, Homo sapiens
  misc_feature: GYAE6OF01EK4U2.13.4.A04.1.454.CMB.1.raw
  modified_base (320)..(320): a, c, t, g, unknown or other
  misc_feature (320)..(320): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccagaggtcgcccctgaacctgaaggccaatgacgacccaagacaggccaaggtggtgtgagaccctgaggngcgtgggccctggtcccaggcaggcgctcggccctgctgctgcgtggtctggcctagtcgtcgccagtcgctgctcgccgccgagtggtacgcgaaccgcgaaacggccggggaacccacgtacccgtggaccggtccgtacgtacgggttaggaacgcgtaacgcccgagttcccacggtaccgtcggtccgggacggtcccggttgggtccggggggtactaacggggtaccaaccgggtacccccgaaaccgggtacccccaaaccccccggtaccgttacggtacccttacccggttcccgtttcccgggttaaccccccccc

SEQ ID NO: 249609 - DNA, 536 bp, Homo sapiens
  misc_feature: GYAE6OF01CB6PS.13.4.A04.1.454.CMB.1.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacaattaacaacttatttaaattggtatcagcagaaaccaggtaaagcccctaagctcctgatctacgatgcatacctaatttggaaacaggggtcccagtcaaggttcagtggaagtggatntggganagtattttactttcactatcagcagcctgcagcctagaagtatattgctaaacattattactgtacagcaagttatagtataactcctcccgtatcctacccgttcggacccgtaaagggacaaccggacgtacggaaagttaacgttaaaaccggaacttagggtcggtccgtggaccc

SEQ ID NO: 249610 - DNA, 577 bp, Homo sapiens
  misc_feature: GYAE6OF01BI0LB.13.4.A04.1.454.CMB.1.raw
  modified_base (318)..(318): a, c, t, g, unknown or other
  misc_feature (318)..(318): n is a, c, g, or t
  modified_base (495)..(495): a, c, t, g, unknown or other
  misc_feature (495)..(495): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggngcgtgggccctggtcccaggcagcgctggccctgctgctgctgggtctggccagtcggtcgcccagtcggcctgctgccgcccaagtcggttgcaccgcgaaacggccggggacccacggacccgtggacgcctcgaggttacggaagccgagcccgactccgacgccgtggccggnggccgtgggtcggggcgagggtccaggccccgaacggccccaaaccccgtcgtcgtacccaccgttccgtccgttccccccg

SEQ ID NO: 249611 - DNA, 679 bp, Homo sapiens
  misc_feature: GYAE6OF01ECFYB.13.4.A04.1.454.CMB.1.raw
  modified_base (229)..(229): a, c, t, g, unknown or other
  misc_feature (229)..(229): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcaggccagaggtcgccctgaacctgaacggccaatgacgacccaagacaggccaagtgggttgtgacgacccctaggaggagcgtcggccctggtcccaggcagcgcgtcgccctgctgctgctcgggtctggcctagtcggtccgcccgagtcggcctggccttcggaccgtcccgtaaagttcggttcgaccgtaaccggaccgaaacgggcccggggaacccacggaccccggtggaaccgtcccgtacgaggttacggaacgtaccgaacggtcccggtaacttcccgaaccggtcccgtacggtcccggggtaacgtcccgggtaggggtcgggggaccctaagggggttcccgaacccgggaccccgaaaccgggacccccgtaaaccccgtacccgttacgttacccgaccctttccggttaacccccg

SEQ ID NO: 249612 - DNA, 782 bp, Homo sapiens
  misc_feature: GYAE6OF01C3KEA.13.4.A04.1.454.CMB.1.raw
  modified_base (275)..(275): a, c, t, g, unknown or other
  misc_feature (275)..(275): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaacttatttaaatggtatcagacaagaaaccaggtaaacncccctaagctcctagactactacgatgaccactacctaagtttacgggaaacgacggggtacccaagttaccgtaaaggtttcgaaggttacgggaaaggttgggtagtacggtaggggtaactaaggtttaacttttttaacccgtttaccaaccctagtttaccgaacgtaccgtaaggtccccttaggacccgtaacggtacccgttaagggtaaacgttaactttaacgtttacgaacccttaaaaccttaacgttttaaacttttaacccgtttagttaacccaagggttaacccgtaaaggttttaacgttaaggttaaactttaaacccgttacccgtttaaccccggttaaactttaccccgaaaccccgggttttacccgggaaacccgtaaaaccggggggtaccctaaacccgggtaaacgttacgggggtaaaacgttaaaccgtttaaaaacccgggaacgtttacgggttaccgggtaccgttcggaaacccc

SEQ ID NO: 249613 - DNA, 596 bp, Homo sapiens
  misc_feature: GYAE6OF01C52JR.13.4.A04.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
tcagtcacgtactacacgaccggtgctcgatttagagtagtgatcagggggcaggagtcagtcccaaccaggacacagcatggacatgagggtccctgctcagctccgtggggctcctgctgctctggctctcaggtgccagatgtgacatccagatgacccagtctccatccctcctgtctgcatctgtagganacagatcacatcacttgccaggcagtcaganattaacaactattaatggtatcagacagaaacaggtaaacgaccctaagctctgtanctacganttttacatacctaatttacggaaacgacgggttccaagtacgaaaggttnaagttaggaagtggagtcgttagggaactagttattttacttaccactataccagacacggtctggacacgaccgttagaagtattagttcaacaactattaatactggtacatccgtaaagtatagaactttaaacgtcccgtacccgtaacgtccttaaccccgttacgggaaccgtaaacggggaaccaccggtaacgtaagggtaacgtaaaacgtaaaccggtaaattcgggtacgtacgtcgtaaacccg

SEQ ID NO: 249614 - DNA, 477 bp, Homo sapiens
  misc_feature: GYAE6OF01EO8T2.13.4.A04.1.454.CMB.1.raw
  modified_base (399)..(399): a, c, t, g, unknown or other
  misc_feature (399)..(399): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccagtaaagcccctaagctcctgatctacgatgcatccaatttggaaacagggtcccatcaagtcagtggaagtggatctggacagattttacttcaccatcagcagcctgcagcctagaagatatgacaacatattactntcagcagtatgtaatatctccgatcaccttcggaccaaggacacgactgganataaacgactgnggactggctactac

SEQ ID NO: 249615 - DNA, 606 bp, Homo sapiens
  misc_feature: GYAE6OF01B5UEN.13.4.A04.1.454.CMB.1.raw
  modified_base (229)..(229): a, c, t, g, unknown or other
  misc_feature (229)..(229): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatcgctgcaagtcgggccagaggtgcccctgaacctgaaggccaatgagaccaagacaggccaagtggttgtgagacccctgaggagcgtgggccctggtcccaggcagcgctcggcctgctgctgctggtctggccagtcggtcgccagtcggcctgctcgccgcccgaagttcgggttagccgtaacccggcgtaaaacgggcccggggtaacccacggaccccgtagggacgcccgtcgtaacgttgggaacgcgaacggcccgtaatcccgaagtcccgtaggccggacggccgtgggtacggggcgacgggtccgacggccccgaacggccccaaacccgctacgtacccaccgtctccggttaccccc

SEQ ID NO: 249616 - DNA, 511 bp, Homo sapiens
  misc_feature: GYAE6OF01BG4H2.13.4.A04.1.454.CMB.1.raw
  modified_base (367)..(367): a, c, t, g, unknown or other
  misc_feature (367)..(367): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattgtatcagcagaaaccaggtaaacgcccctaagctcctgatctacgatgcatcctaagtttggaaacagggtcccatcaaggttcagtggaagtgatcgtggacagtatttacttcactntcagcagcctgcagcctagaatatattcacaacattattacctgtacagctagtatgataactcctaccatcctaccgttccggaccgaacgggaccaacggtctaggaagtaacttaaacgacgtagttcggccttggacccg

SEQ ID NO: 249617 - DNA, 595 bp, Homo sapiens
  misc_feature: GYAE6OF01DU8IG.13.4.A04.1.454.CMB.1.raw
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (414)..(414): a, c, t, g, unknown or other
  misc_feature (414)..(414): n is a, c, g, or t
tcagtcacgtactacacgaccggtgctcgatttagagtagtgatcagggggcagggagtcagtcccaaccaggacacagcatggacatgagggtccccgctcagctcctggggctcctgctgctctggctcccaggtgccagatgtgccatccagatgacccagtctccatccctccctgtctgcatctgtaggagacagagtcaccatcacttgccgggcaagtcagggcataagaaatgatttaggctggtatcagacaagaaacagggaacnccctaagctcttgatctatggtncataccgtaaagttaaaacggtcgggtacctatacgtaagttcagcggacaggtggatcgtggacacgagtacttcattctacaaccatcagcacgcctgcacgtctagtaagttnttttacgacttaactttacttacctagtaacctaactacgttactttaaacgttaccgttaccccgtagttaccgttacgggtttaccgggaccgggtaagggtaacccgtaaggggtacggtaacgtacgtaaaccgaaaacggtacgttggtaccggactaggaacctagttattaccg

SEQ ID NO: 249618 - DNA, 627 bp, Homo sapiens
  misc_feature: GYAE6OF01BCEN1.13.4.A04.1.454.CMB.1.raw
  modified_base (272)..(272): a, c, t, g, unknown or other
  misc_feature (272)..(272): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcagtcaggacattaacaacttattaaatggtatcagacaagaaaccaggtaaacncccctaagctctgatctacgatgcaatacctaattaggaaacgtgggtaccaatacgaaggttcaaggtggaagtgatcgtagggactagtacttttacttacactatcagcagcctgacagcctagaagtatacttagacctaatagtttaacttacgtagtaccaaggtacctaagttaactagtaaacttaagtacccgtacccgtaattaccccgtaaaccggtttacccgggaaaccgtaaacggggtaacctaaccgggtaaaccgttaaggggtaaaaccgttaaaaacgttttaaaaaccggggaccgtttagggttaacggggtacccctttaggggtaaaccccc

SEQ ID NO: 249619 - DNA, 648 bp, Homo sapiens
  misc_feature: GYAE6OF01AU8RJ.13.4.A04.1.454.CMB.1.raw
  modified_base (177)..(177): a, c, t, g, unknown or other
  misc_feature (177)..(177): n is a, c, g, or t
  modified_base (229)..(229): a, c, t, g, unknown or other
  misc_feature (229)..(229): n is a, c, g, or t
  modified_base (382)..(382): a, c, t, g, unknown or other
  misc_feature (382)..(382): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactgggggtntactgtaacagccctgctggcgagagggaccagggcaccgtcctccagggancccatgctgcaaggtcgggccaggaggtcgcccctgaacctgaaggccaatgagaccaagacaggccaagtgggttgtgagacccctgaggagcgtgggccctggtcccaggcagcgctggcccctgctgctgctgggtctggccagtcggcnccgagtcggtcctgctcgccgacccctaagtcgggttcgaccgtacccggacgaaaaccgggccggggaaccccgacggaccccgtagggaccgcccgtacgacgggttacgggaacgtccacggtcccgactcccgaacgtcccgtacggccgggacgccggtgggtcggggcgtacgggtaccaccgggtaccccgaaaccgggtacccccaacccccgtaccgtaccggttacccaacccgttcccgtacccgttccccccgg

SEQ ID NO: 249620 - DNA, 597 bp, Homo sapiens
  misc_feature: GYAE6OF01AC5LL.13.4.A04.1.454.CMB.1.raw
  modified_base (192)..(192): a, c, t, g, unknown or other
  misc_feature (192)..(192): n is a, c, g, or t
  modified_base (279)..(279): a, c, t, g, unknown or other
  misc_feature (279)..(279): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgacccagtctccatccctccctgtctgcatctgtagganacagagtcaccatcacttgccgaggcgagtcaggactaattaaacaacttaatttaaattggtatcagcaagaaccgaggtaaaccncccctaagcctccgtagtactactacgatcgactatacctaagttacggaaaccgtcgggtaccagtacgtaaggtcgaggtggaacgtggactcggaggactagtttacttttactacacctatacgacgtcacgtcctagaccgtacgtaccgtaagaaagttacttagtaccgaactaaacttagttacttacgtgtacgagtactaagtctaagtacttacgtcctaccgtactaccgtaccgtacggaaccgaaggacctaggacgttaggaactaaaccgttaacgagttcggacgcctacgtcctaactcg

SEQ ID NO: 249621 - DNA, 595 bp, Homo sapiens
  misc_feature: GYAE6OF01AVRAF.13.4.A04.1.454.CMB.1.raw
  modified_base (462)..(462): a, c, t, g, unknown or other
  misc_feature (462)..(462): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaacttaatttaaattggtatcagcaagaaaccaggtaaacgcccctaagcctcctgatctacgatcgacatacctaagtttaggaaacgacgggtacccatacgtaaggttcgaggtaggaagtggatcgtggactaggttaacttttacttactacctattcacgcagcctgaccagtacctagaagtattagtacgaacaatatttaacttacttagacaaggtntaaggttatacgttaattaaccttccgtacccgtacttaccctaccggttacccggaccgtaaacggggactacggtacgtagggtaacgtaaacgttaaaaccggacgttaggtaccggtcgtcggtaaccc

SEQ ID NO: 249622 - DNA, 697 bp, Homo sapiens
  misc_feature: GYAE6OF01B5IW4.13.4.A04.1.454.CMB.1.raw
  modified_base (278)..(278): a, c, t, g, unknown or other
  misc_feature (278)..(278): n is a, c, g, or t
  modified_base (300)..(300): a, c, t, g, unknown or other
  misc_feature (300)..(300): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtcctccatccctccctgtctgcatctgtaggagacagacgtcaccatcacttcgccgaggcgagtcaggactaattaacaactattttaaattggtatcagcaagaaaccaggtaaacncccctaagctcctgatctacgntgctatcctaaagtttagggaaaccgtacggggtacccaagtaccgtaaggttcgaagggtacgggaaggtgggaagttcgtagggggaactaggttactttttaaccttcaccgtattaccacgtcaacgtcccttaggaccgtaacgcccgttaggaaagttaacgttatttcggaacctaaaccttaaacgtttaattttaaccgttggtaaccgtaaggtacctaagggtttaatacggttaacttaaacgttcccttaaccccggtacttacccgtaacccggtttacccgggacccgtaaacgggggtaaccaacccgggtagttacgggtaaacgaaacgtttaaaaccggtaacgttggttacgggccttacggaccctaaccgtaccg

SEQ ID NO: 249623 - DNA, 696 bp, Homo sapiens
  misc_feature: GYAE6OF01BNJN6.13.4.A04.1.454.CMB.1.raw
  modified_base (271)..(271): a, c, t, g, unknown or other
  misc_feature (271)..(271): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatcgtgtaggagacagagtcaccatcacgttgccaggctagtcaggacattaacaacttatttaaatggtatcagacagtaaacaggtaacnccctaagctactgatctagatcgctatacctaagtttacggaaacgcggggttacccaagtaccggtaaaggtttcgaaggtgggtaaagtgggtaacttcggtacggggaactaggtttactttttacggttccaacctattacgaacgtcacggcccttggaccagacccgttagaaagtattacgttacggactaaactattaatttaccgtaggttaccaaggtacctaaggtttatacggtaaaccgtttaaacgttcccttaaccccggtatttaccccgtaaccggttttacggggaccccgttaaaaaggggggtaccccgaacgggttaacgtaaccggggtaaagtaaaacccgttttaaaaccggaaacgttttcggggacggttaccttaccgggaaccgtaacccttaacgg

SEQ ID NO: 249624 - DNA, 666 bp, Homo sapiens
  misc_feature: GYAE6OF01DO44O.13.4.A04.1.454.CMB.1.raw
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
tcagtcacgtactacacgaccggtgctcgatttagagtagtgatcagggggcgagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaagtcggccagnggtcgcccctgaacctgaaggccaatgacgaccaagacaggccaagtggttgtgacgaccccgtggacggacgcgtcgggcccgtcgggtcccaggcacgcgcgtcggccctgctgcgtgcgtgggtctcggctagtcggtcgccgtagtcggccgtgctcgccgtaccctaagtcggttcgcgaaccgacgaaacgggccgggaacccacggaccccgtagggacgtcccgtcgtacgggttacgggaacgtccgacggcccgtacgtacccggacggtcccggtacggaccgggtacgtcccggtgggtcggggaccgtacgggtccgaacccggaccccgaaacccgggacccctaaaccccggtaccgtacccgtaccctacccgttcccgttacccgttacccccccg

SEQ ID NO: 249625 - DNA, 548 bp, Homo sapiens
  misc_feature: GYAE6OF01D2BYZ.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtagagacagagtcacatcacttgccaggcgagtcagacataacaactattaatgtatcagcagaaccaggtaacgccctaagctcctgatctacgatgacatccaagtttaggaactcgggtcccatcgaaggttcaggtggaagtggatcgtagggactagtattttacttacactatacacgcacgctagcaacgtcctagaagtattacgtagctaaacgtattaagtttacctgtacaagtctaagttatagtaattactacctacccggtattacccgacccgttacggacccgtaaagggaccacggaacttagggaactaaacgttaaacgacgttggtacggcctggaaccc

SEQ ID NO: 249626 - DNA, 695 bp, Homo sapiens
  misc_feature: GYAE6OF01BUC5Y.13.4.A04.1.454.CMB.1.raw
  modified_base (389)..(389): a, c, t, g, unknown or other
  misc_feature (389)..(389): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccaggaggtcgcccctgaacctgaaggccaatgagacccaagacaggccaagtgggttgtgagacccgtggaggagcgtcgggcctcggtcccaggcagcgcgtcggccctgctgctggcgtgggtctcggccagtcggtccnccgagtcggcctcgcgtcgccggaccctaagttcgggttcgaccgtacccggaaccggaaacgggacccggggaacccgaccggaccccgtacgggaccgccgttacgaacggttcgggaacgccggaacggtcccgtaacgttcccgaacggtcccggtacggacccgggtacggtccccggtagggtccgggggaccgtacggggtacccgaaccgggtacccccgaaaccgggtaccccccaaacccccggtaccgttaccggttacccctaaccgttccccgttccggtttacccccccccg

SEQ ID NO: 249627 - DNA, 625 bp, Homo sapiens
  misc_feature: GYAE6OF01DZM3O.13.4.A04.1.454.CMB.1.raw
  modified_base (197)..(197): a, c, t, g, unknown or other
  misc_feature (197)..(197): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtcctccatccctccctgtctgcatctggtagganacaggatcaccatcacttgccgaggcgagtcaaggactattaaacaacttaatttaaattggtatcagacagaaacaggtaaacgccctaagctctgatctacgatgacactacctaaagtttaggaaaccgacggggttaccagtaccgtaaaggttccgaaggtaggaaggtggtagtcgtagggactaggtattttacttacacctatccgagacacgctagacaggtacctaggaacattaagttcgaactaactaagtttaacttaccgtgttaccgagtaccgtagtaatacgtaacttaactccgtaacccgtatacccgttaacccgttaccgggacccgtaaacgggtaccaaccggtacgtaacgggtaaataaccgttaaaaaccggtacgttagggtacgtcgttaccggaaaccc

SEQ ID NO: 249628 - DNA, 681 bp, Homo sapiens
  misc_feature: GYAE6OF01C02HG.13.4.A04.1.454.CMB.1.raw
  modified_base (133)..(133): a, c, t, g, unknown or other
  misc_feature (133)..(133): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtnccagatgtgacatccagatcgacccagtcctccactccctccctgtctgctatcgtaggaggagacagactccaccatcacttcgaccgaggcgagtacaggaactaattaaactaaactttaatttaaagtggttatacgaacgacaaacggaaaaccgtaacggtaaacccgacccctaaagtccctaccgtagtactaccgtaacgactacgactaacttaaccgtaaagtttacgggaaaacggtaccggggtacccagtaccggtaaggttcgaagggtagggaagtggacgtcgtaggtaactatttactttactacactatcagcagcctgactagtacctagaactagtactacgaactaatagttacttacgtacgtacgagtactaaggttataacggttaactaaccttcccgtacccggtacttacccgtaaccggttaccgaaaccggtaaacggaccgtaacggaacggttaagggaaacttaaacggttaaaccggacgtttcgggaccgtaccttaacggccctaacgttcg

SEQ ID NO: 249629 - DNA, 545 bp, Homo sapiens
  misc_feature: GYAE6OF01C2O16.13.4.A04.1.454.CMB.1.raw
  modified_base (404)..(404): a, c, t, g, unknown or other
  misc_feature (404)..(404): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaaatgagacccaaagacaggccaaagtgggttgtgagacccctgacggagctgggcctggtcccaaggcagcgcgtggccctgctgctgctgggtctggcatggtcgccatggcctgctgcgccaatgttncgaccgcgaaacgcgggacccagacccgtgacgcctcagttggaaagcgagtccgatccgaagcctgcggacgcgtggtggggcagggtcacggcccaaacggcccaaaccccactacgtccaactccgttgtaccccccg

SEQ ID NO: 249630 - DNA, 709 bp, Homo sapiens
  misc_feature: GYAE6OF01C4JM1.13.4.A04.1.454.CMB.1.raw
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggagacagagtcaccatcacttgccaggcagtcagactataacaactattaaatgtatcancaagaacaggtaaacncccctaagtctcctagactactacgatgactataccgtaagtttacgggaaaacgtacggggtaccctaagttacgaaacgggtttcgaaggtagggtaaacgtgggaattccggtaggggtaactaaggttaacttttttaaccgttacctaacctaacttacgaacggtaccaacggtcccgttaggacctaacggacccgttaaggaaaggtaacttacgtttacgaacttaaaccgtaattaactttaaaccgtggttaccgaacgtacgttaagttagttagtaaacttaacctccgtaacccgtaacttacccgtaacccgttaccggggaacccgaaaaccggggtaacctaacgggtaaacccgttaggggtaaaaaccgttaaacggtttaaaaaccggaacgtttggggtaccggtaccgttacggaaacccg

SEQ ID NO: 249631 - DNA, 727 bp, Homo sapiens
  misc_feature: GYAE6OF01D5GE5.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagtactcaccatcacttgccgaggcgagtcaaggactaattaactaacttaatttaattggtatcagtacaacgaaaccgaaggtaaaccgccccgtaagtcctacctagtactacgtaacgtatacgtctaacttaccgtaagtttaacggaaaccggtacgggtaccctaagtcgttaaggttacgtaaggtacgggtaagtaggtacgttacggtacgggtaacttaaggtttaactttttaccttacgaaccttatacgacgtaccgaacggtccgtacgaccgtacgtacccgttaaggtaacgtaatttaacgtacgtaacctaaacttactttaacgtttaccgtagttaacctaggtaccgtaagtttaacgtacgttaaacttacccgttacccgtaacccgtaccttaacccgttacccggtaaccgggtaacccggaaacgggtaaccgaaccggtaaggttaaccgggtaagttaaaaccttaaacggtacggtaaggtcgggtaccgtcggtaacccg

SEQ ID NO: 249632 - DNA, 573 bp, Homo sapiens
  misc_feature: GYAE6OF01CCDDR.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccatcacttgccaggcgagtcaggactaattaacaacttatttaaattggtatcagacaagaaaccaggtaaacgcccctaagcctcctgactctacgatgcatcctaaagtttacgggaaacgtcggggtacccagtaccgtaaggttcgaggtacgggaagtggatcgtagggaactagttacttttacttcacctatcagcacgtcctgacgtacgccgtagaacgtattacttcgaactaactattacttacgtgtacagtactagtatagtattactcctaccgtactcctaccgttccggacgaacgggaccacggtagtacggacgtaacgtaaacgtacgttcggacgtctacgccgtacgtacg

SEQ ID NO: 249633 - DNA, 530 bp, Homo sapiens
  misc_feature: GYAE6OF01EL7OO.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggactattaacaacttaatttaaattggtatcagacaagaaaccaaggtaaacgaccctaagctacctgatctacatgcatacaatttaggaaacgtagggtaccatactaaggtcagtggaagtggatcgtaggactagtactttactacactatacagacagcctgacacgtcctagagtaatagtacgacaactattattactacgtcacgactaagtatagtaatactcctaccgactcaccgttcgacgaacggacacgtacgtaggaacgaacgttaaacgacgtgacgactcgactactacg

SEQ ID NO: 249634 - DNA, 834 bp, Homo sapiens
  misc_feature: GYAE6OF01BXLSX.13.4.A04.1.454.CMB.1.raw
  modified_base (138)..(138): a, c, t, g, unknown or other
  misc_feature (138)..(138): n is a, c, g, or t
  modified_base (142)..(142): a, c, t, g, unknown or other
  misc_feature (142)..(142): n is a, c, g, or t
  modified_base (156)..(156): a, c, t, g, unknown or other
  misc_feature (156)..(156): n is a, c, g, or t
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (180)..(180): a, c, t, g, unknown or other
  misc_feature (180)..(180): n is a, c, g, or t
  modified_base (185)..(185): a, c, t, g, unknown or other
  misc_feature (185)..(185): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcgagtcncatntgtacgacactcantccgacnctctacnctcctccgtntctcnctactcgtaggtagacgacgaggtactaccactactaccttacgtcgacggacggacgtacgtacgaacgaacttaaacttaaacctaaacttttaaattttaaggttacggttactacgaacgaacgaaaaccgtaaaccggtaaaggtaacccctacccgtaacgtcccttccgtaagtacgttaccgtaacgtacgtaccgaccttaaccttaacgtttaacggttaaaccggtaaaaccggggtacccggtaaccttacgtaaaccggttaacgggttaacgtaggggtaacgggttaagggtacggtaacgttcggggtaaacggtaacgttaacgtttttaactttttacccgtaaccaaccgttacgttacggacgtaccgacccggttccgtacgaacccgaccggttacgtaaaggtaacgttattttacgacccgtaactaaacgttactttaacttacggttacgacgtacgtacgttaagttagtaacgttaacttacccgttaccccggtacttaccgtacccgttacccgggtacccgggaaacgggaaaccggtaccgtaacccggtagggttacggaaaaccgtttaaaccggttaaaccggcggtttagggtcccgtagtacccgtaacccg

SEQ ID NO: 249635 - DNA, 856 bp, Homo sapiens
  misc_feature: GYAE6OF01DNALS.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcacatcacttgccaggcgagtcaggacaattaacaacttatttaaatggtatcagacaagaaaccaggtaaacgcccctaagcctcctgactctacgatcgactactacctaaagtttacgggaaaacgtacggggtacccaagttacgtaaacgggtttcgtaagggttagggtaaacggttgggtaacgttccggtagggggtaaccttaaggttttaaactttttttaaccgttttaccaaacccgttaacgttacctaaacgggtccctaaacgggtcccccgtttaggacccgtaacgggtacccgttaaggtaaacgggttaactttaacgttttacgggaaacccttaaaacttaaacgtttttaaaccgtttttaacccgttaacgggttaccgtaaacgggttaaccgtttaaaacggtttaaggtttaaacggtttaaactttaaaccgtttacccccggtttaacccccggttaactttaacccccggtaaaccccgggttttaacccggggaaaccccggtaaaaacggggggtaaccctaaaccgggttaacccggttaaggggtaaaacggttaaacggtttaaaaaacccggaacggtttacgggtaacgggtacctaccgggtacccgtaaccgtttaacccg

SEQ ID NO: 249636 - DNA, 655 bp, Homo sapiens
  misc_feature: GYAE6OF01BIUD9.13.4.A04.1.454.CMB.1.raw
  modified_base (365)..(365): a, c, t, g, unknown or other
  misc_feature (365)..(365): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagaggtgcccctgaacctgaaggccaatcgagacccaagacaggacaaggtgggttgtgacgaccccgtggaggagcgtcgggccctgggtcccaggccagcgcgtcggcccctgccngctggctgggtctcggccagtcggcgccagtcggcctgctcgccgtccgaagtcggtacgcgaccgacgaaacggccgggacccacggaccccgtaggaccgtccgtacgtacggttacggaacggtccgacgtcccgtaacgtcccgaacggcccgtaggacccgggacggtcccggttagggtccgggggacgtacgggtaccgaacccgggtacccggaaacccggtaccccccgaaaccccgtaccgtaccgtacccgaaccgttcccgtacccgttacccccccg

SEQ ID NO: 249637 - DNA, 657 bp, Homo sapiens
  misc_feature: GYAE6OF01DVEGK.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactaatttaaattggtatcagcagaaaccagtaaacgcccctaagctcctagatctacgatgcatacctaaagtttacggaaacgtaacggggtccctaagtacgtaaggttcaaggtagggtaaagtgggaattcgtaggggactaggtactttttacttacaacctatcaagtccacgtacctggacacggtcctaaggaaacgtattagttagaccaaactattaacgtttacgtacggttacaacgtaactaaggttaacttagggtaatttaaaccttcccgttaaccccggtactaccgttaaacccccggtttcgggaaaccccgtaaagggggtaacccaaaccgggtaacgttaggggaaactaaaacgtttaaaaaccggacgttgggtacggcctttacggaccctacctaacg

SEQ ID NO: 249638 - DNA, 697 bp, Homo sapiens
  misc_feature: GYAE6OF01BXS6R.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaagtggacgtggggtgtactgtaacagccctgctggcgagagggaccagggcaccgtcctccgagggacgcccatcgctgcaaggtcgggccaggacggtcgcccctagaacctggaacggccaagtcgaacgaacccgaaagaccgaagggaccgtaaaggtggggttaggtacggaaccggaaccccgtaggacgggacgccgtcggggcccgtcggtccccgagggccaggccgcgttccggccctgcgtggcctggcgttgggtctcggacctgtcggtccgcccgtagcggtccctgccgtcgccgccgtaacgtcgggttacgaccgtaccggacgaaacggccggggaaccccacggacccgtggaccgtcctacgaggttacgggaacgcggacgcccgtaactccgacggccgtcggacggacggccggtcggtcgggggcgtacgggaccgacggaccccgacgggacccccaaaccccggtacctacggttacccttacccgttccgttacccccgtaaccccg

SEQ ID NO: 249639 - DNA, 671 bp, Homo sapiens
  misc_feature: GYAE6OF01DNNXX.13.4.A04.1.454.CMB.1.raw
  modified_base (176)..(176): a, c, t, g, unknown or other
  misc_feature (176)..(176): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggagcccatgctgcaagtcgggccaggaggtcgcccctgaactgaacggccaatgagacccaagacaggccaagtgggttgtgagacccctggaggagcgtgggccctggtcccaggcaggcgcgtcggccctgctgctgctgggtctggccagtcggtccgcccagtcggccttcgcgtcgccgcccgaagttcgggttcgccgaaccggacgaaacgggcccggggaacccgaccggacccgtacgggaccgtcccgtcgtacggtttacgggaacgtccgaacggtacccgagtcccgaacgacccgtcggaccgggtaccgccgtcggggtacgggggccgtaacgggtacccgaccgggaacccccgaaaccgggtacccccgaaacccccgtaccgttaccgtaccctaacccgttcccgttccccgtttaacccccccg

SEQ ID NO: 249640 - DNA, 608 bp, Homo sapiens
  misc_feature: GYAE6OF01BNOBG.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagacaacgaaacgaggtaaacgcccctaagcctcctagtatctacgatcgctaactactaatttacgggaaacgacggggtacccaagtaccgaaaggtttcaagggtaggaagttggtagtcgtagggtaacctaagttactttttaacgtcacctattcagtcacgtcctagaccgtagaccgttagaagtacttatacgtacaaacgtacttatttaactagttacaaggtactagtataggtaacttaactcccgtacccgtatcccgtaccggttaccggaccgtaaccgggactacggtaacgtacggaaacgtaacgttaacggaacgtgtacggtactacgccacgtacg

SEQ ID NO: 249641 - DNA, 625 bp, Homo sapiens
  misc_feature: GYAE6OF01EJF2E.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcggccagaggtcgcccctgaacctgaaggccaatgagacccaagacaggccaagtgggttgtgacgacccgtgaggagcgtcgggccctgggtcccaggcagcgcgtcgcccctgctgctgctgggtctggccagtcggtccgccgacgtcggcctgccgtcgccgtccgtaagtcgggttacgccgaacccggacgaaacgggccggggaaccccacggaccccgtgggacgcccgtcgtacggttcggaacgtccgacggtccgaacgtcccgacggccgtcgccggacgtcccgtggacggggccgacgggtccgacggtccccgaacggacccccaaccccgtacgtacgtacccaccgttcccgtccgttacccccc

SEQ ID NO: 249642 - DNA, 709 bp, Homo sapiens
  misc_feature: GYAE6OF01DM44L.13.4.A04.1.454.CMB.1.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (304)..(304): a, c, t, g, unknown or other
  misc_feature (304)..(304): n is a, c, g, or t
  modified_base (464)..(464): a, c, t, g, unknown or other
  misc_feature (464)..(464): n is a, c, g, or t
tcagtcacgtactacacgaccggtgctcgatttagagtagtgatcagggggcgagttggtagatgcccctctgggagagatccccagggtgacagccatggaccctggaaggcctgggctagggacagggaccagagcagtccagggagaggacagagccaagtggactggggtntactgtaacngccctgctggcgagagggaccagggcaccggtcctccgagggagcccatgcctgcaagtcgggccagaggtgccctgaactgaggccaatgacgaccaagacaggaccaagtgggttgngacgacccgtgaggagcgtcgggcctcgggtccaggcaggccgcgtcgccctgctgcgtgcgtggtctaggccagtcgtccgccgagtcggcctgctcggccgaccgtaagtggttcgccaaccgacgaaacgggcccggggaacccgacggtaccccgngggtaccgtccgtaccgtaaggttcgggaaagccgaaccggttccgacgttcccggaacggtcccggtacgggtacccggggtaacgtcccggttcggggttaccggggggaccgtaacgggggttacccggaacgggaaccccccggttaaaacggggacccccccgaaacccccgttaaacccggtaccggtttaaccccgtaaccccgttcccgggtttacccccgtttcccccccccgggg

SEQ ID NO: 249643 - DNA, 597 bp, Homo sapiens
  misc_feature: GYAE6OF01A4LEF.13.4.A04.1.454.CMB.1.raw
  modified_base (378)..(378): a, c, t, g, unknown or other
  misc_feature (378)..(378): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaacttattaaattggtatcagcagaaccaggtaaacgcccctaagctcctgactctacgatgcatacaattaggaaacgagggtcccaatcgaaggttacagtaggaaggtggatcgtagggactagtatttacttcactatnagcagcctgacacgtacctagaacgtatagttacgacaacgtattaattactcggtacaaggtactagttatacgtaattaacgtccgtacccgtaacttccgacccgtttaccgggaacccgtaaagggtaacccgtaaccggtaaacggttcgggaaaacgttaaaccgtttaaaaccggaaaccgtttagggtaaccgggtaccgttcggaacccc

SEQ ID NO: 249644 - DNA, 563 bp, Homo sapiens
  misc_feature: GYAE6OF01CS431.13.4.A04.1.454.CMB.1.raw
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgacccagtcctccatcctccctgtctgcatctgtaggagacagacgtcaccatcacttgccaggcgagtcaggactattaacaactatttaatgtancancagaacagtaacnccctaagctcanactctacgatgacatacctaattaggaaaccgacgggtacccatacgtaaggtttcgaaggttggagtgatcgnggtaacngtttactttacttcaactatcagtcagtcctgcacgctagaatattatanacaaactgttaactactgtacagacagttagtagtataacttcccaaccgtattaccccgacggtttccggaccgaaacgggacctaaccggtagtagggaaacttaaacgtttaaaaccggacttacggtacggactacgacctaacccgttg

SEQ ID NO: 249645 - DNA, 640 bp, Homo sapiens
  misc_feature: GYAE6OF01EHB2Z.13.4.A04.1.454.CMB.1.raw
  modified_base (176)..(176): a, c, t, g, unknown or other
  misc_feature (176)..(176): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggagcccatgctgcaagtcgggccaggaggtcgcccctgaacctgaacggccaatgacgacccaagacaggccaagtgggtgtgacgacccgtgaggagcgtgggccctggtcccaggcagcgcgtcggccctgctgctgcgtgggtctcggctgtcggtcgccgagtcggcctcgctcgccgcctagtcggttcgccgaccgacgaaccggccggggaacccaccgacccgtggaccgtccgtcgtacggttacggaacgtcgacgccgtacgtccgacggcccgtcggcggtaccggccggttggggtcggggtaccgtacgggtaccgaacccgggtccccgaaacgggaccccccaaacccccggtaccgttaccgtacccgtaccctttcccgtccccgtttacccccccg

SEQ ID NO: 249646 - DNA, 557 bp, Homo sapiens
  misc_feature: GYAE6OF01ENHW5.13.4.A04.1.454.CMB.1.raw
  modified_base (190)..(190): a, c, t, g, unknown or other
  misc_feature (190)..(190): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcagtcagacattaacaactattaattgtatcagacaagaaaccaggtaacgcccctaagctcctgactactacgatagactacttacctaaagtttacggaaacgtacggggtacccagtacgtaaggttcaggtacggtaagtggatcgtggactagttacttttacttcacatcgagcagcctgcacgctagaatatattgactaacatacttatgtacagactagtatgtaacttactccgtaccgtactaccgtacccttcggacccgaagggtaccaacggtactagggaacgttaaaccgttaaacggacttaggtacggtacacgccaaccgtacg

SEQ ID NO: 249647 - DNA, 745 bp, Homo sapiens
  misc_feature: GYAE6OF01D4YU7.13.4.A04.1.454.CMB.1.raw
  modified_base (190)..(190): a, c, t, g, unknown or other
  misc_feature (190)..(190): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctcctgtctgcatctgtagganacagacgtcaccatcacttgccaggcgagtcaggactaattaaacaacttaatttaaattggtatcagacaagaaaccaaggtaaaccgacccctaagccttacctagtactacctacgatcgactacttacctaaagtttacggaaaccgtacggggtacccctagtaccgtaaggttcgaaggttaggaaggtggacgttacggtacgggtaactaaggtttactttttaccgttaccaaccgttaactcgacgtaccgacgtacccttggaaccctacggtaccgttaaggaaacgttacgtttaacgttacggtaaccttaaacgttaactttaaccgtttacgttacggtaccgtaggtaaccttaaggttaagttaacgtaactttaaccgttcccgttacccgtacttaccccgtaacccgtttaccgggaaacccgtaaaccgggtaccgtaaaccggtaaggttacgggttaaaaccgttaaaaccggttaaaaccggtaacggttacgggtaccggtaacgttcccggaaccttacccgttaacg

SEQ ID NO: 249648 - DNA, 650 bp, Homo sapiens
  misc_feature: GYAE6OF01EUKNY.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatcgtgtaggagacagacgtcaccatctacttcgccaggcgagtcgaggactaattaaacctaacttaattttaaaattggtaatacgagactaaacgaaaccgtaaggtaaaccgaccccgtaagcctcctagacttactaacgatacgactattacctaagttacggaaacgtcgggtaccctatacgtaaggttcgaaggtaggtaagtggattcgtagggtactaagttatttttacctactacctagtacgacgcgtaacgcctggacagtaccgtagaagtactagttacgaactaaccgtattaacttacgtcgtacgtaagactaagttacgtaagtaacttaactcccgttaccctaatcccgtaacccggttcggaacccgggtaaacgggtaacaacccggtaggtaaggtaacgtaaaccgttaaaacggtacgtgggtacgtccgtagaaccccg

SEQ ID NO: 249649 - DNA, 728 bp, Homo sapiens
  misc_feature: GYAE6OF01DK71V.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccaggggagaggacagagccaatggactggggtgtactgtaacagccctgctggcgagagggaccagggcaccgtcctccagggagcccatgctgcaagtcgggccagaggtcgcccctgaacctgaggccaatgacgacccaagacaggccaaggtggtgtgacgaccccgtgaggagcgtcgggcccgtgggtcccgaggcacggccgcgtcggccctgctgctgcgtgggtcgtggcctcgtcgggtccgcccgtagtcgggtccgtggccgtcggcccgtacccgtaaggttcgggttcgccgtaaccggaccgaaacgggcccgggggaacccacgggtaccccgtacgggaccgtcccgtacggtacggttacggaacggaccgtaacggacccggtacgtcccgacggtcccggttcggaccgggtaccggtaccgggtcggggttcggggggaccggtaacggggttacccggaaccgggtacccccggaaaccgggtaaccccccgtaaacccccgtacccgttaacccggttacccgtaacccgttcccggtttaccccggtttaaccccccccg

SEQ ID NO: 249650 - DNA, 770 bp, Homo sapiens
  misc_feature: GYAE6OF01DIIJ5.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctcctgtctgcatcgtgtaggacgacagagtccaccatcacttgaccaggcgagtcgaaggacaattaacaacttaatttaaagttggtatcaagacaaagaaaccgaaggtaaaccgacccctaaaggcctacctagacttacgtacgatcgtactataccgtaagttacggaaacgtacgggtcccaagtacgtaaggttacgaacgggttaggaacgtggacgttacggtacgggtaacgtaacggtttaactttttaccgtttaacctaaccctaacgtacgtacgacgtacgtaccgtacgtaccgaacgtaccgtaaggtaagtaacgttaacgttacgtaacctaaacgttaactttaacgtttaaccgttacgtacgtaacgtaaccgttaaggttaaacgttaacgttaaacgttaaaccgttacccgttaacccgtacgttaacccgttaacccggttacccggtaaacccgggtaaaccgggtaacccggtaacccgggtaacggtaacggtaaaacggttaaacgttaaaaccggttaacggttaacgggttacggtaccgtaccgtcccgtaaaaaaaaccgttacccg

SEQ ID NO: 249651 - DNA, 665 bp, Homo sapiens
  misc_feature: GYAE6OF01BLQFV.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggcgccatgctgcaagtcgggccagaggtcgacccctgaacctgaaggccaatgagacccaagacaggccaagtgggttgtgagacccctggaggagcgtgggccctggtcccgagcagcgcgtcggccctgctgctgcgtgggtctcggccagtcggtcgcccgagtcggcctgctcggccgtcccgtaagtcggttcgccgtacccgacgaaaccgggccggggaacccacggaccccggtagggaccgtaccgtaccggtacggttacgggaacgaccgacgaccgacgtacccgaacggtcccgtacgggaccggtacggtcccggttgggacggggtccgtacggggtacccacggggacccccgtaaccgggaaccccccaaccccggtacctcccggttaacccgtacccgttccggtcccggttacccccccg

SEQ ID NO: 249652 - DNA, 815 bp, Homo sapiens
  misc_feature: GYAE6OF01CH7OF.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaagtggacgtggggtgtactgtaacagccctgctggcgaggagggaccagggcaccgtccgtccgagggacgcccatcgctgcgaacggtccgggccaggaggtcgcccctaggaaccgtcggaacggaccaaagtcgaacgaacccgaaagaacgaacggaccgtaaggttggggttcgtacggacggaccccgtggaacggacggccgtacggggccccgttcgggtacccgacggacgacggccggtccgtccgggccctcggctcggcgtcggtcgtggggtcgtcgggtccgtagtccggtccgtaccgcgtcggccgttcggccgtcggaccgtccgtaacgttcgggtaccgtaccgaccggaacggtaaaccggggcccgggtaacccgacggtaccccggtacgggaaccgtccgtacggtaagggttacgggaaccgtacggacggaccccgtacgtaaccggtaccggccggtacgggtacccgggaaccggtcccgggttaacgggggtccggggtaccgtaccgggggtacccgaacccggggtaaacccccggaaaccccgggtaacccccgaaaccccgttacccggttaacccggttacccgtaacccgttccccgtttaccccgttaacccccccg

SEQ ID NO: 249653 - DNA, 623 bp, Homo sapiens
  misc_feature: GYAE6OF01DBPVR.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttcgccaggcgagtcgaggacaattaacaacttaatttaaattgtatcagacaacgaaaccaggtaaacgcccctaagcctacctagactactacgatcgacatacctaagttaggaaaccgaggggtcccatacgaagttacgagtaggaagtggatcgagggactagttacttttacttcacctatcagcacgtcctcgacgacgaccgtagtaagtatattacgtactaacgtaattaacgtttacttagtactacgtacgtaagttagtaacgtaattaaacgttaccgttacccgtacctacctaacccgttaccggtaccggcgggaaaaaaaaaaccgtcggtaacgtacgggtaacgtaaacgttaaaacgtaacgtacggtacggtaccgtacgaccgaccgttaccg

SEQ ID NO: 249654 - DNA, 644 bp, Homo sapiens
  misc_feature: GYAE6OF01DK36C.13.4.A04.1.454.CMB.1.raw
  modified_base (487)..(487): a, c, t, g, unknown or other
  misc_feature (487)..(487): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatcgtgtaggagacagagtcactatcacttgccaggcgagtcaggacattaacaacttaatttaatggtatcagacaagaaaccgaggtaaaccgcccctaagcctacctagactacgacgatcgactataccaagtttacggaaacgtacgggtacccaagtcgtaaacggtttcgaaggttacgggaaagttggaacgttcggtaacgggtaactaggttttaacttttaccgtttacaaccgtatacgagtaccacgtcctgaccgagtctaagaatgttacgtagactaaatgttaactttcgngtacagactagtatagtaacttaacgtcccttaaccgactttaccgtacccggttacgggaacccgtaaaggggacctaaaccggtaacggttacgggaaagttaaaaccgttaaaccgacgttcgggtaacgcgttaaccgacccgtaacttaccg

SEQ ID NO: 249655 - DNA, 643 bp, Homo sapiens
  misc_feature: GYAE6OF01AEG9U.13.4.A04.1.454.CMB.1.raw
  modified_base (176)..(176): a, c, t, g, unknown or other
  misc_feature (176)..(176): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (468)..(468): a, c, t, g, unknown or other
  misc_feature (468)..(468): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggcgcccatgctgcaaggtccgggccagacggtcgcccctgaacctgaacggccaatgagaacccaagacaggccaaggtcggttgtgagaccccgtgaggacgcgtcgggccctcggtcccaggcagcgctggcccctgctgctgcgtggtcnggcagtcgtcgccgngtcgcctgccgtgccgcctagtcggtcgaccgaccgacgaaacggccgggacccgaccgacccgtcgggaccncccgtacgacgggttacggaacgtaccgacggcccgtaacgtcccgaagtccccgtgacccgggtacggtcccgttgggtacggggccgtacgggtaccgaccggtacccccgaaaccggccccgtaaacccccgccgttaccgacccgtaccttcccgttcccgtttacccccg

SEQ ID NO: 249656 - DNA, 672 bp, Homo sapiens
  misc_feature: GYAE6OF01EKCOD.13.4.A04.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtagganacagacgtcaccntcacttgccaggcgagtcaggacaattaacaactatttaaattggtatcagacagaaaaccgacggtaaaacgcccctaacgctactcgatctacgatgcatcctaaagcctagaaacacgggtaccgatacgaacggttacgagtaggtacgtaggatacgtgggttaacgacgtaatttttacttactaccacttacacgtacgacgtaccgtacgtacacggtaccctagtaagtaactatttacggaactaaactaacgttaacttaacttacgtactacgtaccgtaagttaagttagtaaccttaacgtaccctacccggtacgttaccgtaaacccggttacccgggtaaccggtaaacccggggtaaaccgtaaacccggtaaccggttaaacgggtaccggtaaaacgtttaaaccggtaaaaccgttacggttccgggaacccgtttaacccggg

SEQ ID NO: 249657 - DNA, 711 bp, Homo sapiens
  misc_feature: GYAE6OF01DE424.13.4.A04.1.454.CMB.1.raw
  modified_base (228)..(228): a, c, t, g, unknown or other
  misc_feature (228)..(228): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtcgcccctgaacctgaaggaccaatgaacgacccaagacaggaccaaggtgggtgtgacgaccctgacggagcgtgggccctggtccgacggcacgccgcgtcggcccgtgctgctggctgggtctggccagtcggtcgccacgtcggctgctcgccgaccagtcgttacgcgaaccgacgaaacggtcccgggaacccgaccgacccgtcgggacgcccgtacgtacgggtttacgggaaacgaccgtaaccggacccggtacgtacccgacgggtacccgttccgggaccggggtaaccggttcccggtacggggtccggggggtaccggtaaccggggttacccgaccgggaaacccccgaaacccggggaaccccccgaaaacccccggttacccggttaaccgggttaccccttaaaccctcccggttttcccccgggtttaaccccccccgg

SEQ ID NO: 249658 - DNA, 638 bp, Homo sapiens
  misc_feature: GYAE6OF01CCOVJ.13.4.A04.1.454.CMB.1.raw
  modified_base (232)..(232): a, c, t, g, unknown or other
  misc_feature (232)..(232): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagacgggaccagggcaccgtccgtccgagggacncccatgcgtgcgaagtcgggaccagaggtcgcccctagaaccgtgaacggccaagtcgacgaacccgaacgacaacggaccaaggtgggttagtggaacgaccccgtggacggagccgtcgggcccgtcggtcccaggcgacgcgcgtcggccctgctgcgtgcgtggtcgnggccagtcggtcgccgagtcggctgctcggcccncctagtcggtcgcgaccgacgaaccggccgggaaccacggacccgtggaccgtccgtcgtaagtcggaacgcgacgccgtacaccgacgccgtaggccggacgtcggtcgggtcgggtcgacggtccgaaccggcccgtaaaccggaccccgaaccccgtacgtccgttacctaccgttccggtccccgttaccccccgg

SEQ ID NO: 249659 - DNA, 658 bp, Homo sapiens
  misc_feature: GYAE6OF01A6KLH.13.4.A04.1.454.CMB.1.raw
  modified_base (228)..(228): a, c, t, g, unknown or other
  misc_feature (228)..(228): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagacggtgcccctgaacctgaaggccaatgagacccaagacaggccaagtcgggttgtgagacccctgaggagctgggccctggtcccaggcagcgctcggccctgctgctgcgtgggtctggccagtcggtacgccgatcggcctagctacggccgccgaagttcggttcgaccgtaccggacgaaacggccggggtaacccctaggaccccgtgggaccgtcccgttacgacgggtttacggaacggtaccgaacggacccgtacgttacccgaacggtcccgtacggaccgggaacgtcccggtaggggtcggggtccgaacggggttacccgacggaccccgtaaacggggcccctaaaccccgaccgtacggttacccgaccgttcccgttccggttccccccgg

SEQ ID NO: 249660 - DNA, 933 bp, Homo sapiens
  misc_feature: GYAE6OF01AILN5.13.4.A04.1.454.CMB.1.raw
  modified_base (176)..(176): a, c, t, g, unknown or other
  misc_feature (176)..(176): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacgcccatgcctgcaacggtcgggaccaggacggtcgccccgtagaaccgtggaacggccaagtgaacgaccgaagacgaggaccgaaggttgggttgtacggacggtaccccgtggaacgggacgccggtcggggcccgttcgggtacccgagggcctacggccgtcggtccggccccgtggccgtcggccgttggtccggttcggggtccgttacgggtcctacggttcgggtccccgtcccggtacggttcggtcccgtcgggtaccgtccggtacccgtccccgtaacggtttccggggttacgtaccccggtaacccgggacccggtaaaacccggggaccccgggggtaaacccccgtaaccgggtaaccccccggtacgggtaacccggttaccccggttaacgggtaacccggggttttaacgggaacccgggtaacccgggtaaccggggtaacccccgggttaaacccggttaccccgggaaccggggtttaccccggaccggggtacccccggggggttaaaccgggtccccgggttacggggggttaccgggggaacccgggttaaccgggggtaccccggaacccggggtaccccccggaaacccggggtaacccccccgaaccccgggttaaccccgttaccggttaccccgttaccccgtttacccggttacccccggtttaacccccccg

SEQ ID NO: 249661 - DNA, 647 bp, Homo sapiens
  misc_feature: GYAE6OF01B8FB3.13.4.A04.1.454.CMB.1.raw
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
tcagtcacgtactacacgaccggtgctcgatttagagtagtgatcaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgaggggacncccatgctgcaaggtcgggccagaggtcncccctgaacctgaaggccaatgagaccaagacaggccaagtgggttgtgagaccccgtgaggagctgggccctggtcccaggcagcgcctggccctgctgctgctgggtctgaccgagtcggtcgcccgtaagtcggacctgaccttcggccgaccctaagttcgggttacgccgtaacccggacgaaacggccggggacccgacggaccccgtcgggacgtcccgttaccgaacgggtttacggaacgccgtacggcccgtaactcccgaagcccgttggaccggacgtccgtcggtcggggacgtacgggtcgaacggtccccgaaaggaccccccgaaacccgtaccgtacgtacccgaccgttccgtccgtttacccccccgg

SEQ ID NO: 249662 - DNA, 636 bp, Homo sapiens
  misc_feature: GYAE6OF01AGBO7.13.4.A04.1.454.CMB.1.raw
  modified_base (231)..(231): a, c, t, g, unknown or other
  misc_feature (231)..(231): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccaggggacncccatgctgcaaggtcgggccaggaggtcgcccctgaacctgaacggccaagtgaacgacccaagacaggaccaaggtgggttgtgacgacccgtggaggacgcgtgggccctcggtcccaggcagccgcgtcggccctgctcgctgcgtcggtctcggctagtcggtccgccgagtcggcctgctcgccgccgtagttcggtcgcgaccgtacggaacggccgggaccacgacccgtggaccgtccgtcgacggttagacgccgacggccgtactccgacggcctacggccggacggtccggtcgggtcggggaccgtacgggtacccgaaccggaccccgaaacccggaccccgaaaccccgtcgtaccgtaccctaccgttcccgttcccgttacccccccg

SEQ ID NO: 249663 - DNA, 886 bp, Homo sapiens
  misc_feature: GYAE6OF01EJFUA.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcgaggtgccagatgtgacatccaagatcgacccagtcctccacttccctccctgtctgctatcgtaggtaggagacagacgtcaccatctacgttcgccaggcgagtacgaacggactaacttaaactaaactttaagttttaaaagtttggttaattcgaagtaccaaacggaaaaccgtaacggttaaaaccgtacccccgttaaagtacccttaccgttacggtaacttaccgtaacggtaactacggtaacctaacgttaaccgttaaaacggttttaacgggaaaaccggtaaccggggttaccctaaacgttaaccgtaaacgggtttacgaagggttaagggtaaagggtagggtaacgttacggtacggggtaacttaaacggttttaacttttttaaccgtttaacctaacctaacgttaccgtacgaccgaacggtcccgttaggaccgtaaccgtccggtaagtaacgtattaagttacgtaacctaacttaagtttaactttaccggttacgtacgtaaacggttacgtaaggtttaaactcggtttaaaacctaacccgtttaacccgttccccgtaaaccgttacccccggttaacccgggttaaaccccgggtaaaccggggtaaaccggggtaaacccttaaccgggaaaccgggtttaaacgggtaaacgtttaaaaacccggttaaaaacgggtttaccggttacggggtaccgttaaccggtcccgtaaaccccgg

SEQ ID NO: 249664 - DNA, 714 bp, Homo sapiens
  misc_feature: GYAE6OF01EI5NC.13.4.A04.1.454.CMB.1.raw
  modified_base (176)..(176): a, c, t, g, unknown or other
  misc_feature (176)..(176): n is a, c, g, or t
  modified_base (232)..(232): a, c, t, g, unknown or other
  misc_feature (232)..(232): n is a, c, g, or t
  modified_base (617)..(617): a, c, t, g, unknown or other
  misc_feature (617)..(617): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgaggagggaccagggccaccgtcctccgagggacncccagtcgctgacaaggtccgggaccaggaggtcgcccctagaaccgtgaacggccaaagtcgaacgaacccaaggaccagggaccaaggtcgggttgtacgacggtacccgtggaggagccggtacgggcccgttcgggtaccccgaggccgacggccgccgtccgggtccccgtgtcccgtggtaccgtcggccgggttgggtcccgttgggtcccgtaaggttcccgggtccgtccccgaggttccggcccgttcgccggttcggcccgtaccgtaagttcgggttccgacgacccggtacggaaaccgggcccggggaacccacggacccgtggaccgtccgtacgtacggtcgaacgtcgaccgccggtacacgacgccncggcggtaccgtcggtcggtcgggccgtacggtccgaccggacccgaccggtaccccaacccgtacgtccctaccgaccttccgtcccgtacccccg

SEQ ID NO: 249665 - DNA, 825 bp, Homo sapiens
  misc_feature: GYAE6OF01CAQQ1.13.4.A04.1.454.CMB.1.raw
tcagtcacgtactacacgaccggtgctcgatttagagtagtgatcagggggagagaggagcccagccctgggattttcaggtgttttcatttggtgatcaggactgaacagagagaactcaccatggaatttgggctgagctggtctttttctgtggcttaattttaaaggtgtccagtgtgaagtgcagctggtggagtcgtgggggagcttggtacagccgtgggacgtccctgagactctcctgtgcagcctctggattcactttagctaactatcgaccagtgacgtcgtcgggtcccgcgacggcctaccggaggggacgggtctggggacggttgggtcctacgtaaccgttagtttaggcgtacgttaggtcgggtacacccgtaaccgaactaacttaccgtaccggacaacgtaccgttaccgggtaaggaaacggggtccctaaacgtttcccaaccgttacttacccgtacccgtaaagggtaaccgtaaaccttaaaccgttaaacccggaaaacgggtaaaccctaaccgggttcccttaagggtttaaaccttacccggttaagaaaccgtaaaacgttcggaaaaaccctcggacccgtttaaggaaaccggtaacccggtacccgggaacgggtacccctaaacggggtcctttaaaacgttcgttaaaccggttcggtaaacggaaacccggttaaaaggtttaaaccccttttttaaccccggattttttaacccgttaggaaacccgtttaacggggttacccggggacccgttaaaccggggtaaacccgttggttaacccccgg

SEQ ID NO: 249666 - DNA, 604 bp, Homo sapiens
  misc_feature: GYAE6OF01ELDEY.13.4.A04.1.454.CMB.1.raw
  modified_base (395)..(395): a, c, t, g, unknown or other
  misc_feature (395)..(395): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccgagggacgcccatgctgcaagtccgggccaggaggtcgccccctgaacccgtgaacggccaaatgaacgacccaagacaggccaaggtggttgtgagaccccgtgagggagcgtgggccctggtcccaggcagcgctcggccctgctgctgcgtgggtctggccagtcggtccncccgatcggccctggcccgttgccgtcccgtaagtgggttacgccgaccgacgaaaccggccggggaacccacggacccgtggcgcctcgagtgaacgcacgccgtagccgacgcgtcgcggactccggtggcggggcgacggtacgacccgaccggaacccgacccctaacccgtcgtaccctacctccttcccgttcccgtaccccc

SEQ ID NO: 249667 - DNA, 735 bp, Homo sapiens
  misc_feature: GYAE6OF01EMNF8.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagcctgctggcgagagggaccagggcaccgtcctccgagggacgccatgctgcaaggtccgggccaggaggtcgcccctgaaccgtgaacggccaatgacgacccaagacaggaccaaggtcgggttgtggacgaccctggaggacgcgtcgggccctcggtcccgaggcacgtcgccgtcggccctgcgtcgctggcgtgggtctcgggctagtcggtcgccgtagtcggtcctggccgtcggccgtacccgtaaggttcggttcggaccgaaccggtacggaaaccgggccggggaaccctaccggacccggtcgggaaccggtccgtaccggtaggttacgggaaccggtaccggtacgggacccggtaccgtaccctacgggtcccggtaacgggccgggtaacggtcccgggtaggggtacccgggggtaccggttacggggacccgaacccgggacccccggaaacccgggtacccccctaaaaccccgtcccgggttaccgtacccgtacccgttccccggttacccggtttaccccccccgg

SEQ ID NO: 249668 - DNA, 638 bp, Homo sapiens
  misc_feature: GYAE6OF01AYX5J.13.4.A04.1.454.CMB.1.raw
  modified_base (369)..(369): a, c, t, g, unknown or other
  misc_feature (369)..(369): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaaggccaatgagacccaagacaggccaagtgggttgtgagaccccgtgaggagctgggccctggtcccaggcagcgctggcccctgctgctgctgggtcnggcatggtcgcccgatcggcctgctcgccgcccaagtcggttcgccacccggacgaaaccggccgggggaacccccacggtacccccgtacgggaccgccccgtacgtacggttcgggaacgaccgacggcccgtacgtcccgaacggcccgtacggccgggtacgcccggttgggcgggggacgtacgggtccgaaccggccccgaaaccgggaccccaaacccccgtacgtaccgtacccaccgttcccgttccgttaacccccccg

SEQ ID NO: 249669 - DNA, 829 bp, Homo sapiens
  misc_feature: GYAE6OF01ET7IS.13.4.A04.1.454.CMB.1.raw
tcagtcacgtactacacgaccggtgctcgatttagagtagtgatcagggggagagaggagcccagccctgggattttcaggtgttttcatttggtgatcaggactgaacagagagaactcaccatggaatttgggctgagctggtctttttcttgtggcttaattttaaaaggtgtccagtgtgaagtgcagcgtggtggagtcggtgggggagtcttggtacagccgtgggacggtccctgacgtactctccgtgtcgctacgccttcgtggtacttcctacctttagactaaactatcgacctagtgacggtccgtcggggtccccgccgtaaggggccgttaccgggaagggggggtaacggggccgttaggggacggtttcggggttaccttaacctaaaccgtttagtttacggttaggtacgtttaagggtcggttaccgaccccaaaccgtaactaacgttacccgtaacgccgaacgtaaccgtccggtacgggaaacgggtccctaatttcccgaaccgttacgtcccgttacccgaaaggtaaccgtaaactaaacgtttaaacccgaaaaggtaaacccgtacggtaccttaggtaaccttaccgtacgtaaacaaacgttacgaaacacggtcgtaggaacggaccggaccggtaagaccgtaccggtacgttaagtaagttaccgtagggaactaaacgggttaaaacggtttaaaccctttaccccgtaaagtttttaccgtttaaaccgtaaccgtttacccggggacggggtaaccccggtaaacggggttaaaccccttggggtaaaccccc

SEQ ID NO: 249670 - DNA, 722 bp, Homo sapiens
  misc_feature: GYAE6OF01AM3SE.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggagggaccagggcacccggtcctccgagggacgcccagtcgctgcgaaggtccgggccaaggaggttcgcccccgtagaacccgtgaacggaccaagtcgaacgaacccgaagacacggccaaggtcgggttgtcgacgaccccgtgaggagcgtgggcccgtggtcccgaggcgagccgcgtcggcccgtcgcgtcgctcggtcgtcgggtctcggccgtacggtcgtaccgcccgtgtccggccgtcgcgtcgccgccgtaacgtcggttcgccgtaccggaccgtaaacggccggggaaccccgtaccggacccgtcgggtaacccgccgtacgtaggttacgggaacgaccgacgggaccgtaaccgtcccgaacggtcccgtacggacgggtccggtacggtccggggtacggggtaccggtaccgggtccgaaccggtaccccggaacccggaaccccaaacccccggtacccgtacgtaaccccgccttacccggttccccggttacccccccg

SEQ ID NO: 249671 - DNA, 616 bp, Homo sapiens
  misc_feature: GYAE6OF01CQC2A.13.4.A04.1.454.CMB.1.raw
  modified_base (599)..(599): a, c, t, g, unknown or other
  misc_feature (599)..(599): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggagacagagtcaccatcacttgccaggcgagtcagacattaacaatatttaatgtatcagacagaacaggtaaacgccctaagctcctgtactctacgtatgacacttacctaagtttcggaaaaccggtgggtacccagttacgtaaaggtttcgaagtacgggaagtggacttcgtaggacgtagttagttttactacgactatcagcactccgtgtacagtcctagaacgtattagtacgactaacgaattaacgttacgtatcgaacgctaagtagttacgaacgttataccctaacccggtattaccccgtaaccgtttaccgggaacccggtaaacgggaacccgaacggtaccgtaaaggtaaaccgtttaaaccgtaaaaccgttacggttagggtacccngggttaccctaacccgg

SEQ ID NO: 249672 - DNA, 647 bp, Homo sapiens
  misc_feature: GYAE6OF01ACZDL.13.4.A04.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (368)..(368): a, c, t, g, unknown or other
  misc_feature (368)..(368): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatcgacccagtctccatcctccctgtctgcatctgtagganacagagtcacatcacttgccaggcgagtcaggacattaacaactattaaattggtatcancagaaaccaggtaaacgcccctaagcncctgatctagatcgcatccaatttggaacncgggtccatcgaagttcgagtggacagtagatcgtaggaactagtacttttacccncacctatcgacggggtactacgagtaccgtagtaacgtacgttttgaccggtacttacgttattcgtactaacaacgttacgtttaacccgttacccgttacccccgggtaacggtttacccggacccggtaaacggggtaacccgtaaacgggtaacggtaaaacgttaccaaaacgggtaccggtaaacgttcgggttacggtaccgttcgacccgtaaccctaccgttaccgttacgtttaccccgttccgttaacgttccccggtttaacccccg

SEQ ID NO: 249673 - DNA, 659 bp, Homo sapiens
  misc_feature: GYAE6OF01C4CV2.13.4.A04.1.454.CMB.1.raw
  modified_base (267)..(267): a, c, t, g, unknown or other
  misc_feature (267)..(267): n is a, c, g, or t
  modified_base (297)..(297): a, c, t, g, unknown or other
  misc_feature (297)..(297): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccatcacttgccaggcagtcagacattaacagttatttagtctggtatcaagacaaaaaccgnggaaactcctaagctcctgatctagtgttnctatcctactttgacaaaggtcgggtacccaagtcgtaaggttcagcggacagtggatcgtggactagtacttcgactctacaactaatcgaagaccaacggtccctagaccgacgtacccgttaagaaacggtttactttttacggaaccctttaaagtttttaccttaacgttacgtaacccttaaacgtacggtttaacctttaaaacgttacccgttaccccgtactttacccggttaagggttcccgggacgggtaaaccggggtaaccgtaagggttacccgggtaaaggtaaccttaaacccggaaaaacggttacccgttagggtaccgggtaccttacgggccctaaacccgg

SEQ ID NO: 249674 - DNA, 742 bp, Homo sapiens
  misc_feature: GYAE6OF01BRNS2.13.4.A04.1.454.CMB.1.raw
  modified_base (194)..(194): a, c, t, g, unknown or other
  misc_feature (194)..(194): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatccacttgccaggcgagtcaggacacttaacaacttatttaaatgtatcagacaagaaaccaggtaacgccctaagctacctgactctaacgatcgactataccaagtttggaaaaccgtgggtccccaattacgtaaacggtttcaggttaggaaacgtgggaacttcgtaggggacttaacggtttaacttttttaccgttaccaacctattaccgaacggtaccgaacggttcccgtaggacccgtaacggtaccccgtttaagggaaaacgtttaactttacgtttaaccggtaacccttaaaacgtacgtttttaaacgtttacccggttagtttaaacccgacgggtaacctttaaaggttaaccggtttaacgttaaacttaacccgtaccccttaacccgggtacctttaaccgttaaacccccggttacccgggtaaaccggtaaacccggggaacctaacgggttacccgtaagggtaaacttaaacggttaaaccggaagttcggaaccggtccaccgttacccg

SEQ ID NO: 249675 - DNA, 622 bp, Homo sapiens
  misc_feature: GYAE6OF01EGFTO.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtccacatcacttgccaggcgagtcaggacaattaacaactaatttaaattggtatcagacaagaaaccaaggtaaacgcccctaagcctcctgatctacgatcgctaatcctaaattttacggaaaaccgtacggggtacccaagtaccgaaagggtttcaaggtgggaaaggttggattcgtagggaactaggtaacttttactttacacctatcagcagcctgacagctagaattattttacgaccttaattacttacgttattactaactaagtatacctaaacttaatttacgtccgttaggggtaccgttaccgggtaccgaaacgggtaacctaaagggtaacggaaaaccttaccgaaaaacggtaacgttcgggtacgaccgttcggacctaaccctagttccgttgttaccc

SEQ ID NO: 249676 - DNA, 725 bp, Homo sapiens
  misc_feature: GYAE6OF01AFME7.13.4.A04.1.454.CMB.1.raw
  modified_base (192)..(192): a, c, t, g, unknown or other
  misc_feature (192)..(192): n is a, c, g, or t
  modified_base (237)..(237): a, c, t, g, unknown or other
  misc_feature (237)..(237): n is a, c, g, or t
  modified_base (326)..(326): a, c, t, g, unknown or other
  misc_feature (326)..(326): n is a, c, g, or t
tcagtcacgtactacacgaccggtgctcgatttagagtagtgatcagggggcagttgggtagatgccctctgggagagatccccaggggtgacagccatggacctggaagggcctgggctagggacagggaccaggagcccaggtccaggggagaggacaggaggccaagtggactggggtgtactgtaacngccctggctggcgagagggaccagggcaccgtcctcgacggggancccatggctagccaaggtcgggaccaggagggtcgccctgaaccgtgaacggccaagtcgacgaccaagcgtaggccgaagtcgggttntacggacgtacccgtaggacggagtcgtggggcctcgggtaccaggcgacgcgtccgtggccccgtgccgtacgcgttcggcgttcgggtcgtcgggccgacgtcgggtaccgtacccaggtcggcccttaggccgtacgaccgtaccgtaacgttgggtaccgaccgtaccggacggtaaacggccgggtaacccgacggtacccgtaacggccgtacgttacgacgggttacggaacgcgtaacggtcggtcgtaaccgtacgggtcccggtagaaccgggtcgtcccgggttgggaaccgggtccgttcggggtaaccgtcggtacccccggtaagtacccggggtacccctaacccggtacggaaccgttcccgtaacggttcgttaacccccgg

SEQ ID NO: 249677 - DNA, 620 bp, Homo sapiens
  misc_feature: GYAE6OF01AU85Y.13.4.A04.1.454.CMB.1.raw
  modified_base (228)..(228): a, c, t, g, unknown or other
  misc_feature (228)..(228): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagtcacgtactacacgaccggtgctcgatttagagtagtgatcagggggagtcagtcccaaccaggacacagcatggacatgagggtccccgctcagctcctggggctcctgctgctctggcctcccaggtgccagatgtgccatccagatgacccagtcctccactcccgtccctgtctagcgatccgtggtaggagacagacgtcaccatcacgttgccggganaagtcgagggctaagttagaaatgatttaggctggtatcagcacgaaaccagggaaacncccctaagctcttgatctanggtgcactaccgtagtttaaaagtggggtacccataccgaagttcacgcggacagtggatcgtggacacagtacgttctagttcctacacctatcagtacgaacgtccttgactacgactaggtaatacgttttacaccttaactttacttacgtagttacctaaacgacgtaactaccaacgttaacttacgttcccgtagggttaccgttaccgggacgtaaacgggaacctaacggggtaagtaactaccggtaaaacgtacgttacggtacggtacgtccggtacctaactcttacgttcgttaacccg

SEQ ID NO: 249678 - DNA, 627 bp, Homo sapiens
  misc_feature: GYAE6OF01DO2Q8.13.4.A04.1.454.CMB.1.raw
  modified_base (176)..(176): a, c, t, g, unknown or other
  misc_feature (176)..(176): n is a, c, g, or t
  modified_base (232)..(232): a, c, t, g, unknown or other
  misc_feature (232)..(232): n is a, c, g, or t
  modified_base (520)..(520): a, c, t, g, unknown or other
  misc_feature (520)..(520): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccaggggccaccgtcctccgagggacncccatgcctgcaagtcgggcaggaggtcgcccctgaacctgaaggaccaagtgagacccaagacaggccaagtgggtgtgagacccctgaggagcgtgggccctggtcccaggcagcgctcggccctgctgctgcgtgggtctggcctagtggtccgccgtagtcggtccgtgtccgtcgccgtacccctaaggttcggtacgtccgaaccggtcgaaaccgggtccgggaacccacggtaccccgtaggaccgtcctacgaggttacggaacgtccgaagcccgtanccgacgccgtgcgacgccggtggtacgggtcgacggtaccgtacggaccccgtaacgggccccaacccccgtacgttacgaccctactcccgttccggttacccccc

SEQ ID NO: 249679 - DNA, 806 bp, Homo sapiens
  misc_feature: GYAE6OF01APLRS.13.4.A04.1.454.CMB.1.raw
  modified_base (578)..(578): a, c, t, g, unknown or other
  misc_feature (578)..(578): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtcctccatcctccctgtctgcatctgtaggagacagacgtccaccatcacgttgccgaggcgagtcgaggactaattaaactaactttaattttaaacgttggttaactacacgtacgaaacggaaaccgtaacggtaaaccgaccccgtaaggccttaccgtagtacgttaccgtaacggtatacgtactaccgttaccgtaaagtttaacgggaaaaccggtacggggtacccctaagttaccggtaaacgggttacgaaggttaagggaaggttacggtacgttacgggttaacgggtaaccgttaacggtttaacttttttaacccgttttaccgaacctttacgtacgtaaccggccgtaacggttccccttaggaacccgtacggttaacccctaaaggtaaaccgttnttaaacctttacggaaacccttaagtaactttttaagtaccgttacggtaactacgtacgttaaacgtttggtaaattaaccgttaaccggtttcccctaaccgtaccgttaacccgttacccccggttaacggggaacccgtaaacggggtaccctaaaccggtaggtaaccgggtaaacgtaaacggtttaaaaccggtcttaccgggtacgtcccgtgtaacccg

SEQ ID NO: 249680 - DNA, 728 bp, Homo sapiens
  misc_feature: GYAE6OF01B5XDS.13.4.A04.1.454.CMB.1.raw
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcnccctgaacctgaagccaatganaccaagacaggaccaagtgggttgtgacgaccccgtgaggagcgtgggccctggtcccaggcagcgcgtcggcccctgcgtgcgtgcgtgggtctcggcagtcggtccgcccgtagtcgggtcctcggtccgtcggcccgtacccgtaagttcggggtttccgacccgtaacccggtaaccggaaaccggggtaccccgggggaaccccgtacccgggtaaaccccggtcggggaacccggtacccttaccgggtaacggttcgggaaacggtccgaacgggacccgtaacgtacccgacgtcccggtacgggcccggtaccggccggttcggggtaccggggtccgtacggggttacccgaacccgggtacccccgaacccgggtaacccccgaacccccgtaccggtaccgttacccgtacccgttcccgttccccgttacccccccg

SEQ ID NO: 249681 - DNA, 790 bp, Homo sapiens
  misc_feature: GYAE6OF01BBVN2.13.4.A04.1.454.CMB.1.raw
tcagtcacgtactacacgaccggtgctcgatttagagtagtgatcaggggggagtcagtcccaaccaggacacagcatggacatgagggtccctgctcagcctccgtggggctcctgcgtgctctggctctcaggtgccagatgtgacatccagatgacccagtctccactccctccctgtctgctatcgtgtaggagacagagtccaccatccacgttcggaccgggacacgtcgaggactaagttaagaaatgtaagtttaggctggtatcgagacgaaaggaaaccggaaggaaaccgacccgtaagtccttcgttagactacgtagtggtctactattaacgtaaaaggtttaaaacggtcgggtacctaacgtacgtaacggttcgaacgggtacggacgtaagggtcggtaacgttcggtacggtacgaaacgtacgttaccctttactaactttccgtaaccctaaccgtacgttaccgaacggtccgaaccgtcccgtaggacccgtaagttacccgtaaagggttaacgttttactttaacgtaccttaaacgttttacgtttaaccgtttacggttaacctaacggtaaacgtaacctaaccgttaactttaaacgttacccgggttaccgttaccgggggttaaacccgggttacgggaaaccccggtaaaacggggtaacccggtaaaggggttaaacccgaaacggttaaaccgtaaaaccggtacggttacggtaaccgggttaccgtacgaacccttaaccggttacgttacccg

SEQ ID NO: 249682 - DNA, 738 bp, Homo sapiens
  misc_feature: GYAE6OF01C1CA5.13.4.A04.1.454.CMB.1.raw
tcagtcacgtactacacgaccggtgctcgatttagagtagtgatcagggggcagttggtagatgcccctctgggagagactcccgaggggtgacagccatcggaccctggagggcctgggctagggacagggaccagagccagtccagggagaggacagacgccaagtggacgtggggtatactgtaacacgccctgcgtggcgagagggaccagggtcacccgtccaccgagggacgccctagtcgctgacgaacggtcggaccaggtacggtcaccccgtagaaccgtaggacgaccaagacgacgaaaccaacgacgaacggacctaaggtgggttacgagaccggacccgaggacggacgcggtacggcccgtacggcccgaggcacggtcgaccgtccggccctgcgtacgtcgtgtccgtgggtctcgggctacggtcggtaccgaccgtcggttcgccgttacggtccgtaccggaccgtaccggttaacggttcgggtacgtacccgaaccggaacggaaccggggaccgggaaaccccgaccgggtaacccgtacggtaccggtacccgttagggtaacgttaccgggaacgaccggtaaaccggtcccttaaccggaccgaacgttcccggacggtaccgaacggttccgcgggtacggacggttaccgacccgcgaacccgacccgtaccaaaccccgtgacctccgtacctccgtacccgtacccc

SEQ ID NO: 249683 - DNA, 833 bp, Homo sapiens
  misc_feature: GYAE6OF01B74SA.13.4.A04.1.454.CMB.1.raw
  modified_base (231)..(231): a, c, t, g, unknown or other
  misc_feature (231)..(231): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacncccatgctgcaaggtcgggaccaggaggtcgcccctagaaccgtggaacggccaaagtcgaacgaacccaaagaccgaaggacccgtaaggttggggttgtacggaacggtacccccgtaggaacggggaacgccggtcggggtccccgttcgggtaccccgacgggccgacggccggtccgtccgggccccgtcggtccgtcggcccgttgggtccgttcggggttccgtccgggtcccgtaacggttccggggtacccgtccccgtacggttccgggcccttcgggccgttcccggacccggtacccgtaaacggtttccggggttaccgacccgtaaccccgggtaaccggtaaacccggggacccgggggtaacccccaacgggtaacccccgttgggaaccgtacccgttacggtaacgggttacgggaacgccgtaacggacccgtaacgtcccgacggtccggtacggaccgggtaccggtccggttggggtaccggggttacggacgggttacccggaccggaccccggaaacccggtaccccaaccccgttacggtccgtacccgttacctcccgttcccgttacccccccgg

SEQ ID NO: 249684 - DNA, 633 bp, Homo sapiens
  misc_feature: GYAE6OF01AHML6.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcgagtcaggacattaacaacttattaaattgtatcagcagaaccaggtaacgcccctaagctcctgatctacgatgactactacctaagtttagggaaacgtacggggtacccagtaccgtaaggttcgaaggttagggaagtggtatcggtagggtactaggtactttttaccgttacacctattcagccagcctgctacgctagaatattatgacaacgtattacttactgttacacgtacgtaagttataggtaaacttaccgttcccgtacccgttactaccgttaaaccccggtttacccgggaacccgtaaacggggtacccctaacgggtaaccgtttacggggaaaacggttaaaccgtttaaaaacccgggtacgttaccgggttacgggtcccgttacggtaaccc

SEQ ID NO: 249685 - DNA, 612 bp, Homo sapiens
  misc_feature: GYAE6OF01CEC6E.13.4.A04.1.454.CMB.1.raw
  modified_base (176)..(176): a, c, t, g, unknown or other
  misc_feature (176)..(176): n is a, c, g, or t
  modified_base (456)..(456): a, c, t, g, unknown or other
  misc_feature (456)..(456): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacgccccatgctgcaaggtcgggccagaggtcgcccctgaacctgaaggccaatgagacccaagacaggccaagtgggttgtgagacccctgaggagcgtgggccctggtcccaggcagcgctggccctgctgctgctggtctggccagtcggtcgcccgagtcggcctgccgtcgccgccgtagtcggtcgaccgaccgacgaacggccgggaaccgaccggacccgnggaccgccgtacgtaggtacggaacgcgtacggaccgtacgtaccgacgccgtcggacggacgtccggtcgggtcgggacgtacggccgtaccggacccgaaccggaccccaacccgtaccgtactacccgtaccttcccgtcccgttaccccccg

SEQ ID NO: 249686 - DNA, 659 bp, Homo sapiens
  misc_feature: GYAE6OF01CTYMA.13.4.A04.1.454.CMB.1.raw
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (549)..(549): a, c, t, g, unknown or other
  misc_feature (549)..(549): n is a, c, g, or t
tcagtcacgtactacacgaccggtgctcgatttagagtagtgatcagggggcagttggtagatgcccctctgggagagatccccgaggggtgacagccatggaccctggaagggcctgggctagggacagggaccagacgccagtccagggagaggacagagccaatggacgtggggtntactagtaacagccctgctggcgagaggaccagggcaccgtccnccgagggacncctatgctgcgaaggtcggcaaggcgtcgacctgaaccgtacggaacggaccaagtagaacgaaccgaacgaacgacggaccgtaaggttgggttgacgaacggtaccccgaggaaggcgacgtcgggtcccgttggcccgaaggcgacgtccgcgtcgcccgtgctcgcgtcggcgttggtcgtcgtacctaggttccgcgaccgagttcggccttgcgtacgcccgacgtacgtcggtcgacccgaacgacggtaacggcccgggaccgacgccgacgacgcgtacgtagtaggaacgacgaccggactaaccnccggactaccggcgacgaccgtacggtggacggcgacggtacgaccgaccggaacccgaaccccgaacgtaccggtacttacccaaccgtcccgtcccgttaaccccccg

SEQ ID NO: 249687 - DNA, 639 bp, Homo sapiens
  misc_feature: GYAE6OF01ESUCQ.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctcctgtctgcatctgtaggagacagagtcaccatcacttgccaggcgagtcaggactattaacaactatttaattggtatcgagcagaaaccaaggtaaacgacccctaagcctcctgatctacgatgcactaccgtaatttaggaaaacgtacggggtacccagttaccgtaaaggttcgaaggtagggtaaggtggaagttccgtgggactagtagttttaccttctaccatacagctacgcctgcacgcctagaaacgtatagttcgactaaactatttacttactcgtacaacgtcgtaagtatagtaacttaacgttaccttaccccgtaacgttaccctacccgttaccgggtacccggaaacggtaccgtaacccggtaaggtacgggtaaagtaaacggtttaaaacccgtaaacggtttagggtacgggtaacccgttaccggaactaccccgttaaacgg

SEQ ID NO: 249688 - DNA, 684 bp, Homo sapiens
  misc_feature: GYAE6OF01C659I.13.4.A04.1.454.CMB.1.raw
  modified_base (599)..(599): a, c, t, g, unknown or other
  misc_feature (599)..(599): n is a, c, g, or t
tcagtcacgtactacacgaccggtgctcgatttagagtagtgatcagggggcagttggtagatgcccctctgggagagatccccgaggggtgacagccatggaccctggaagggcctgggctagggacagggaccagagccagtccagggagaggacagagccaatggacgtggggtgtactgtaacacgccctgctggcgagagggaccagggccaccgtcctccgagggacgcccatgctgcgaaggtcgggccaggaggtcgcccctgaacctggaacggccaagtgacgacccaagacaggccaaggtgggtgtgagacccctggaggagcgtcgggcccgtggtcccaggcagccggcgtcggccctgcgtcgtctggcgttgggtcgttcggccgtagtcggtaccgcccgtagtcggccgtgcctacggcccgtacctaaggtcgggttacgaccgtccggaacgaacgggcccggggaacccaccgggacccgtggaccgcgtcgtacgggttacggaacgtccgacggccgtaccgtccgtacgcccgtggaccgggtaccgtccggtgggtccgggggactaccggggntaacccgggaccccgaaacccgggacccccgaaccccgtaccgttaccgtaccctaacccgtcccgttcccgtttaacccccccg

SEQ ID NO: 249689 - DNA, 942 bp, Homo sapiens
  misc_feature: GYAE6OF01EXX6R.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgaggagggaccaggggccaccgtcctccgagggacgcccatcgctgcaacggtccgggaccagacggtcgccccctgaacccgtggaaggcccaaagtcggaacggaaccccaaacggaaccgacgggacccgaaaacggttgggggtttacgttagggaacggaaccccccgttggaacggggtaacgggtccggttcgggggtcccccgttcggggttacccccgagggtacccggacgggcccggtccgtccgggccccccgttcggccgttcggccgttcgggcccggttcggggtccgttcgggcccgtaagttccggggtcccgtccccgtacgtcgggtcccttcgggcccgttcggcccggtccccgtaacggttcggggtttaccggacccgtaaccccgggaccggaaaaccgggcccccgggggaacccctaaccgggacccccgtacgggaacccggtcccgttaaccggtaacgggttacgggaaacggtaccgaccggtaccccgtaacgtccccggtaacggtcccgtacgggtacccgggtaaccggtccccgggtttacggggtcgggggggtaaccccggtacggggtttacccggaaacccggggtaccccccggaaaacccggggacccccccgtaaaacccccccgggtaaccccgttacccgggttaacccccggtttaacccgttccccccgggttaccccgggtttttaccccccccccgg

SEQ ID NO: 249690 - DNA, 816 bp, Homo sapiens
  misc_feature: GYAE6OF01C47DK.13.4.A04.1.454.CMB.1.raw
  modified_base (182)..(182): a, c, t, g, unknown or other
  misc_feature (182)..(182): n is a, c, g, or t
tcagtcacgtactacacgaccggtgctcgatttagagtagtgatcagggggcagttggtagatgcccctctgggagagactccccgaggggtgacagccatggacccgtggaagggcctgggctagggacagggaccagacgccagtccgagggagaggacagagccaatggacgtggggtntactgtaacacgccctgctggcgaggagggaccgagggcaccgtcctccgagggacgccatcgctgacgaacggtccgggccaggacggtccgcccctagaacccgtaggaacgccaaaggtcgaaacgaacccaaaggaccgacgggtaaccgtaagggttcgggtttcggacggaaccggtacccctaggggaaccgggagtccggtaccggggtccccgtttacgggaccccgaaggccgaacggccggtccgttcccgggaccctcggccgttacggccgtttacggccggttaggggtcctaccgggacctcgggttcccggttcccgccgtaggttcccggcctcgtccggtccggacccgtaccgtaaggttccggttaccggacccaaccggtaccggaaaccgggcccggggaacccctcgggtaaccccggcggaaccgttacccgttaggaacgggttcgaaacggtccgaacccggtacgtaccgacccgagtcccggagggaccggtacgtcccgggtagggccgggacgtacgggtacccaacgggtccccaacccgggtaaccccgtaccctaccggttaccgtacccttacccggttcccgtcccccggtttaccccg

SEQ ID NO: 249691 - DNA, 750 bp, Homo sapiens
  misc_feature: GYAE6OF01ALH6N.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatcgacccagttctccatccctccctgtctgcatcgtgtaggagaccagactccgaccataccacttgccgacggcgagtcaggacaagttaaccaacttaatttaaagttggtacttcagtacaagaaaccgaaggtaaaccgtccccgtaagcctacctacgtacttaccgtaaggactcgactacgtaccgtaacgtttacggaaacggtacgggtacctaagtacgaacggttataacgggtaggtaacggtcggtagttacgtagggtacgttaaggttaactttttaccgttacctaacctacgtaccgtaaccgtcgtaccgtaccctacggtaccgaaccgttacgaggtaacgtatttacgttacggaacctaacggttaactttacgttaaccgtacgtcgtaaccggtactaacgggtttactaacccggttaatttaaccggacccttaaccccgttagttaacccccgtacccggtttaccccggaccgggtttaaaccgggaacccaccgggttataacgggggtaacccttaaacggtttaaacccgttacgttccggtcgggttacctccggtaaccccg

SEQ ID NO: 249692 - DNA, 729 bp, Homo sapiens
  misc_feature: GYAE6OF01DAV9M.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgacccagtcctccactccctcctgtctgcctatcgtaggtaggagacagacgtccaacctatctacttcgccgtaggtgagtacgaaggactaaattaaactaaactttaatttaaagttggtaactacgaagacaacgaaaccgtaacggtaaccgaccccgtaagcctacctagtactacgtaacgatcgactaacttaccgtaaggttaacggaacgtacgggtacctaagtacgtaacggtgaacggtaggaaggtggtacgtacggaggtaactagtttacttttaactaccgtaactacgtacgaccggacttacggcctagaccgtacggtaacctaagggtaacttacgttaacgtacgaaaccttaaagttattaacgtttacgtagtaaccgtaggtaacttaaggttaacgttacgtaaacgttacccttaccccgtacctacgtaaccccgttaaccggtaccggaacccggtaacggtaacccgaacgtacggttaacggaacgttaaaacgttaaacccgtaggttaccggtaggtaccctaaccggtacctaccgtttacg

SEQ ID NO: 249693 - DNA, 660 bp, Homo sapiens
  misc_feature: GYAE6OF01CE4IH.13.4.A04.1.454.CMB.1.raw
  modified_base (191)..(191): a, c, t, g, unknown or other
  misc_feature (191)..(191): n is a, c, g, or t
  modified_base (448)..(448): a, c, t, g, unknown or other
  misc_feature (448)..(448): n is a, c, g, or t
  modified_base (626)..(626): a, c, t, g, unknown or other
  misc_feature (626)..(626): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtcctccatcctccctgtctgcatctgtagganacagagtcacctatcacttgccaggcgagtcaggacaattaacaacttatttaatgtatcagtacaagaaacaggtaaacgccctaagctacctgtatctaagatcgactactacctaagttacggaaacgtacgggtacccagttaccgtaaggtttcaaggtacggaagttcggatcggtagggaactagtttaacttttacgttaccaacctattacagcctagtccgtagacgtacgtaccgtagaaaacgtnttaacttacggaacctaaattaacgttaacctttacgtaggttaccaagttaccgttaaggttaactagttaaaccttaacgttccccgttaacccggacttacccggtacccgtttccgggaaacccgtaaagggacccgtacggtaacgtagggtaactaaaacgttaaaaccggngttacgggtacggtacgtactaccgtaccttacg

SEQ ID NO: 249694 - DNA, 776 bp, Homo sapiens
  misc_feature: GYAE6OF01ES5E5.13.4.A04.1.454.CMB.1.raw
  modified_base (177)..(177): a, c, t, g, unknown or other
  misc_feature (177)..(177): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtntactgtaacacgccctgcgtggcgagagggaccagggccaccgtcctccgagggacgcccatcgctcggacctaacgggtccgggccaagggtacggtccgcccccgtaggaacccgtggaacggacctaagtcggaaccaaccccgaaaggaccgacggaccgtaagggttcggggttacgtacggtaccgaccccggtaggtaacggcggtaccggtccggggtcccgtcgggtaccccgaacgggtcgacggccgtccgtccggcccctggccctgtccgtcggtccggtcggtacgtcggaccgtagtccggtccgccgtacggtccggaccgtcgccggtccgtaccgtaccgtagttccggttaccgaccgtaaccgggaccgtaaaccgggcccgggtaacccgacggtacccgtcgggacttcccgtacggacgttcggaacgtaccgaccggaccgtacgaccggcggtccggtacgccggggtacgtccgggtacggtacgggtcccggaacgttcccggaacgtccccggaaccggaccccttaccccggaccgttacgaccccgtacgtccccgtcccgttccccgg

SEQ ID NO: 249695 - DNA, 655 bp, Homo sapiens
  misc_feature: GYAE6OF01AR85J.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccaggggagcccatgctgcaagtcgggccagaggtgcccctgaacctgaaggccaatgagacccaagacaggccaagtgggttgtgagacccctgaggagcgtgggccctggtcccaggcagcgctggcccctgctgctgcgtgggtctggccagtcggtcgcccgacgtcggccctgctcgccgccctaagtcgggttcgccgaccggacgaaacgggccggggaaccccgacggaccccgtagggaccgtcccgtacgaggtttacggaacgtccgacggacccgtagtacccgacgtcccgtaggcccgggacggtcccggtgggtacgggggccgtacgggttcccgaaccgggccccgaaaccgggacccccgaaacccccgtacgtacccgtacccgtaacccgttcccgttcccgtttacccccccg

SEQ ID NO: 249696 - DNA, 585 bp, Homo sapiens
  misc_feature: GYAE6OF01B9Q0G.13.4.A04.1.454.CMB.1.raw
  modified_base (188)..(188): a, c, t, g, unknown or other
  misc_feature (188)..(188): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (452)..(452): a, c, t, g, unknown or other
  misc_feature (452)..(452): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (582)..(582): a, c, t, g, unknown or other
  misc_feature (582)..(582): n is a, c, g, or t
tcagtcacgtactacacgaccggtgctcgatttagagtagtgatcagggggcagttggtagatgcccctctgggagagatccccgaggggtgacagccatggaccctggaagggcctgggctagggacagggaccagagccagtccagggagaggacagagccaatggactggggtgtactgtaaacngccctgctgggcgagagggaccagggcaccgtccgtccagggacgcccatgctgcaaggtcggccagaggtcgccctgaacctgaagccaatgagaccagacagcagtggtgngagacctgagngctcggcctcggcccaggcagcgctcggccctgctgctgcgtcgggtctaggcctagtcggtccgcccaggttgccctgccgtcgccgtccgaagttcgggttacgaccgacgaaacggccggggaacccacgtacccgnggacgacctcgagttagagacaggccactaccacgcctggaccgngtccgnggtagggccgaggttcccgagaccccgaacggacccccaaccctaccgtgtacccacggtcctacccgggtttcccccnccc

SEQ ID NO: 249697 - DNA, 823 bp, Homo sapiens
  misc_feature: GYAE6OF01DSF6D.13.4.A04.1.454.CMB.1.raw
tcagtcacgtactacacgaccggtgctcgatttagagtagtgatcaggggcagttggtagatcgcccctcgtgggagagactccccgagggtgacagccagtcggacccgtggaacggccgtgggcgtagggacgacgggaccagacgccgagtccgagggagaggacagacgaccgaagtggacgtgggtatacgtacgtaaacgcgtccctgcgtggacgaggacggaccgacggtccaccgtccgtacgaggacgccgagtcgcgtcgacgtacggccggaccgaggcggtccgaccccgtagaaccgacggaacggacctaagtacggaaaccgaaccgaaacggacgtaacggtaccggtaaggttcgggttagaccgaccggtccgaggacggacgtccggtcggacccgttccggaccgaggtacgccggccgtccgtaccgccgtaggccgtgcgtacggcggttcggtaccgcgtaccgtggttcccggccgtaccgtcggtccggtccgtacgtccgtaccggtacctaccggtaggttccgaccggaaccgaacgggaccggaaccgggtaccccggtaaccgaacccggccgttacgggaccgttccggaacgggtttaggaaccggcgtaacccgaccggtacccggaccgttaccggccgggtaccgacgggaccgttaccggccgggtttacgggcggtaaccgggtaccggtaacccgaacccggtaaacccccgggtaacccccgtaccctaaccggtcgtttaacccccgctttaccccggtacccgttccccccgtaacccccg

SEQ ID NO: 249698 - DNA, 667 bp, Homo sapiens
  misc_feature: GYAE6OF01B2P1A.13.4.A04.1.454.CMB.1.raw
  modified_base (179)..(179): a, c, t, g, unknown or other
  misc_feature (179)..(179): n is a, c, g, or t
  modified_base (233)..(233): a, c, t, g, unknown or other
  misc_feature (233)..(233): n is a, c, g, or t
tcagtcacgtactacacgaccggtgctcgatttagagtagtgatcagggggcagttggtagatgcccctctgggagagatccccgaggggtgacagccatggaccctggaagggcctgggctagggacagggaccaggagccagtccgagggagaggacagagccaatggactggggtntactgtaacagccctgctggcgagagggaccagggcaccgtcctccgagggacncccatgctgcgaaggtccgggccaggaggtcgcccctagaaccctgaacggccaaagtcgaacgacccgaaagaccaggaccgaaaggtggggttgtacggacgaccccgtggaggacgccgtgggccctggtcccaggccgagccgctcggcccctgctgctgcgtcggtactggcctagtcggtccgcccgtagtcgggcctgcgttcggaccgtacccgtaagttcggttacgaccgtaaccggacgaaaccgggccggggaaccccacggtaccccgtagggaccgccttacggtaggttaggaacgccgaacgccgtactcccgagccgtcggccggacgtccgtgggtcgggcgtacgggtccgaacggccccgaaacgggacccccaacccgtctacggtaccctccgttccgtccgttaccccccg

SEQ ID NO: 249699 - DNA, 834 bp, Homo sapiens
  misc_feature: GYAE6OF01D4AT9.13.4.A04.1.454.CMB.1.raw
  modified_base (148)..(148): a, c, t, g, unknown or other
  misc_feature (148)..(148): n is a, c, g, or t
  modified_base (207)..(207): a, c, t, g, unknown or other
  misc_feature (207)..(207): n is a, c, g, or t
  modified_base (820)..(820): a, c, t, g, unknown or other
  misc_feature (820)..(820): n is a, c, g, or t
tcagtcacgtactacacgaccggtgctcgatttagagtagtgatcaggggcaggagtcagtcccaaccaggacacagcatggacatgagggtccctgctcagctccgtgggctcgtgctgctgtggctctcgaggtcgccagtatgtnacactccgaagactacgacccgatccctaccacttccctccgtgtcctagctagttcgnggtagcaacgaggtctacactatcctacgtcgccgaggctacgtagagtactaaacttaactaactttaagttaagttcgtaactcgtaacgtaacgaacggtaaaccgtaagggtaaccctacccgtaacgtcctaccggttacgtaccttacggtaactcgggttactaccgtaacttaaccgttaaggttaaccggaaccggttaccggactaacgtaccggttaagtccggaggttaagtacggttacggtacgtacgggttacgaacgttaagttaccgttacgtaccttaccgggttaacaacttaacgacgtaaccggtacgtacccggtaccggtactaccgggaccgtttacggtaaaggttaacccgggttagttttaacggggtaaggttaactttaaccgttcgttaaccggaactttaacggtaccggttgggttaaaccgggttcccggtacgggtacccgtttacgggttaccgggttttaacgggttaccgggggaaaccgttaaccgggggtaacggttaacgacgggttaaacgtaacccgtacgggttaaacctaaaccgggtttcgaaccggggttacccacggggttaaccncccgtttaaaccgg

SEQ ID NO: 249700 - DNA, 574 bp, Homo sapiens
  misc_feature: GYAE6OF01C3RQM.13.4.A04.1.454.CMB.1.raw
  modified_base (393)..(393): a, c, t, g, unknown or other
  misc_feature (393)..(393): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcgagtcaggacattaacaacttattaattgtatcagtagaaacaggtaaacgcccctaagctctgatctacgatgcatcctaagtttcggaaacgacgggtccatcgaaggttcagtggaagtggatcgtgggactagtacttttacttacactatacgagcagcctagcagcctagaanatattagactaactacttattacgtgtacagactaaggtactagtaacttaatcctacccgtacttaccgtaccgttaccggaaccgtaaacgggaccgtaaccggtacgttagggaacttaaaccggttaaaacggtacgttacggtcgggtacctacggaaccctacgtacgttacccg

SEQ ID NO: 249701 - DNA, 791 bp, Homo sapiens
  misc_feature: GYAE6OF01AFRLL.13.4.A04.1.454.CMB.1.raw
  modified_base (786)..(786): a, c, t, g, unknown or other
  misc_feature (786)..(786): n is a, c, g, or t
tcagtcacgtactacacgaccggtgctcgatttagagtagtgatcaggggggagtcagtcccaaccaggacacagcatggacatgagggtccctgctcagctccgtggggctcctgctgctctggctctcgaggtcgaccgagtagtgtacgactactaccgagtactaccggtacccagttccctacctaccttccccttcccgttcgttctcgctacgtcgtaggtaacggaacgacgacggtacgaccactacgtacctacgttcggacggtacggacggtacgtacgaacgtaactaaactttaaactaactttaacgtttaaagtcggtaatacgaacgacgtaaaccggtaaaccggtaacgtaaacccgtaccccgttaagtcccgttaactacgtacgtaccgtaacgtacgtaccacgttaaacgttaccgttaaagggtaacggggtaacccggtaccggtaaccgtaaggttaaccggttaagggtacgtaggggtacggtaaggtcgtacgttaggtaacgtaacgtttaacgtttactttaaccgtccgaacttaccgtaccgtacgacctacggccgtacgacgtaacggtacgtaagaacgttacgtactaacgacttaagttacttacgttacgtacgacttacgagttaacgttactacgtaaccgttacctacgtacctaccgtaacccgttaccgacggtaacccggtacgtaaaccggtccgtaggaaacgtaactacgggtaatcgttacgaccgtatctccgtntaccc

SEQ ID NO: 249702 - DNA, 675 bp, Homo sapiens
  misc_feature: GYAE6OF01BHDQ9.13.4.A04.1.454.CMB.1.raw
  modified_base (176)..(176): a, c, t, g, unknown or other
  misc_feature (176)..(176): n is a, c, g, or t
  modified_base (322)..(322): a, c, t, g, unknown or other
  misc_feature (322)..(322): n is a, c, g, or t
  modified_base (601)..(601): a, c, t, g, unknown or other
  misc_feature (601)..(601): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacgcccatgctgacgaacggtccgggccagtacggtcgccccctagaaccctggaacggccaagtcgacgacccaagacacggccaaggtgggttncgacgtaccccgtggagggactcgtcggggcccttcgggtaccccgaggcctagccgtcgtcggccccctgccgtgcctcggcgtcgggtcctcggtccgtagtccggtccgcccgtagtccgggcctcggcctcggacccgtcccgtagttcggttaccgaccgacccgtacgaaaccgggcccgggtaacccgacggtcccgtacgggtaccgtaccgtcgtacggttacggaacgtccgacgaccgacgtccgacgtcgacgcggacggccgtggngggccgtcggtccgacggtcccaccgggacccctaacccgtcgaccgtaccaccgttccgtcccgttacccccg

SEQ ID NO: 249703 - DNA, 667 bp, Homo sapiens
  misc_feature: GYAE6OF01E0KBZ.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgcgtggcgagacgggaccagggccaccggtcctccgaggggacgcccatgctgcgaaggtcgggccagaggtcgccccctgaacctgaacggccaatgacgacccaagacaggccaaggtgggttgtgacgaccccgtgacggagcgtcgggccctggtcccaggcgagcgctcggccctgcgtcgcgtgcgtgggtctcggcctagtcggtccgcccgagtcggccgtgccgtcggcccgccgtaagttcggtcgccgaccggacgaaacggccgggacccacggacccgtggacgtcctacgaggtcggaacgtcgacgccgtacgtcccacggtcccgtacggccggaacggtcccggttagggtccgggggaccgtacgggtaccgaaccgggaccccgaaaccgggacccccgaaacccccgtacgttaccggtacccctacccgtttcccgtacccggtttacccccccg

SEQ ID NO: 249704 - DNA, 828 bp, Homo sapiens
  misc_feature: GYAE6OF01BGD0N.13.4.A04.1.454.CMB.1.raw
  modified_base (133)..(133): a, c, t, g, unknown or other
  misc_feature (133)..(133): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtnccagatgtgacatccagatcgacccagtcctccatccctccctgtctgctatctgtaggagacaggatccaccatcctacttcgaccgaggcgagtacgaggactaacttaaactaacttaattttaaagttcggtaactacgaacgtacgaaacggaaaaccgtaacggtaaaccgcccccgtaagtcccttaccctagtaccttaccgtaacggtactacggactaacgttaacccgttaaaggtttaaccggaaaaccggtaccggggtaccctaacgtaccgttaaacgggttcgtaagggtacgggtaaaggttcggtaacgttaccggtaacgggtacgttaaacgttttacctttttaccgtttaccaacccgtacgttaccgaacgaccgtaaccggtccgtaacggtccgtaaacccgggttccgaaggtaaaacgttcgttaaccgttaaggtaaacccttaaacgtttaactttacgttaacccggttacgtaccggaacgttaacgttaaggtttaaacggacgtttaaaccttaccctacccccgtttaccgggtaaccctttaaccgtacccggtacccgggtaaaccggtaaaggggtacccctaacgggttacgtaacggggtaaacttaaccggtaaacggttacgttgggtacgtacctacggaccctaccggttac

SEQ ID NO: 249705 - DNA, 665 bp, Homo sapiens
  misc_feature: GYAE6OF01CZ9QX.13.4.A04.1.454.CMB.1.raw
  modified_base (148)..(148): a, c, t, g, unknown or other
  misc_feature (148)..(148): n is a, c, g, or t
  modified_base (167)..(167): a, c, t, g, unknown or other
  misc_feature (167)..(167): n is a, c, g, or t
  modified_base (661)..(661): a, c, t, g, unknown or other
  misc_feature (661)..(661): n is a, c, g, or t
tcagtcacgtactacacgaccggtgctcgatttagagtagtgatcgagggggcaggagtcagtcccaaccaggacacagcatggacatgagggtccctgctcagctccgtgggctcctgctgctcgtggctctcaggtcgccagatgngacatccagactcgacccngtcctccactccctcctgtctgctatcgtaggacggagacgagacgtaccactatcctacgttcggaccgagggtacgtaacggtacgaaggtaacctaaagtttaaaacctaacgtttaaatttaaaaggttggtaactacgacgaacgaaacgaaaccgaaacggtaaaccacccctaaagccttaccagactactacgatcactactacgttaagttacggaacgtacggacctaagtacgtaaggttcgaggtaggtaagtcggtattacggtacggattagttactttacgtaccgactagtacacgacgacgtccgtacgtacgtacggactaggaatattagtacgactaagtactttaatacgtagtacagtacaagttagtataacttaacctacgtaccctagttacccgacggtaacgaaccggtaaacggtacgtaacgacgtaacgaacttaaacggtaacgtaacgtggtacgtcggtanaccg

SEQ ID NO: 249706 - DNA, 659 bp, Homo sapiens
  misc_feature: GYAE6OF01ET735.13.4.A04.1.454.CMB.1.raw
  modified_base (490)..(490): a, c, t, g, unknown or other
  misc_feature (490)..(490): n is a, c, g, or t
tcagtcacgtactacacgaccggtgctcgatttagagtagtgatcaggggggcagggagtcagtcccaaccaggacacagcatggacatgagggtccctgctcagctcctggggctcctgctgctctggctctcgaggtgccagatgtgacatccagatcgacccagtctccatccctccctgtcctgccatcgtgtaggagacagagtcacctatcacttgccgaggtcgagtcaggataattaacaacttaatttaactaggtatacagtaccaaagaaaacccgtaggtaaacgcccctaaaggcccttaccgtagaacttacgaaccgtatacgacctaacttaccgtaaagttttacgggaaaaccgtacgggtaaccagttacgtaaacggtttacgaaggtagggtaagtggaacttccggtagggaacttaagttaccgtttttacttaccaaccgtacgttacagggacctacggtacccnggtaccacgtacgttacgaagtattagttacaacgtaactagttacctagtacagtacgactagttagacttaagtacctacccgtaccgtataccgtaccgtacggacgaaaggtccgaacgtatacgggtaactaaaccgttaaacgacttggtccgccgttgaccc

SEQ ID NO: 249707 - DNA, 648 bp, Homo sapiens
  misc_feature: GYAE6OF01CMJ59.13.4.A04.1.454.CMB.1.raw
  modified_base (454)..(454): a, c, t, g, unknown or other
  misc_feature (454)..(454): n is a, c, g, or t
tcagtcacgtactacacgaccggtgctcgatttagagtagtgatcagggggcaggagtcagtcccaaaccaggacacagcatggacatgagggtccctgctcagctcctggggctcctgctgctctggctctcaggtgccagatgtgacatccagatcgacccagtctccatccctccctgtctgctatcgtggtaggagacagtacgtccaacctatcctacgttcgaccgaggaccggagtacaaggaactaacttaaaactaactttaatttaaagttggtactacagacaaacgaaaccgaaggtaaaccgacccctaacgtctacctagtacctcgtaacgtatcgacctactaccgtaaagttacgggaaaccgtacgggtacctagtacgtaacgttcgaggtagagtggactcggtaggtacttagttacttttacctacaacctntcgagccgacgtccgtacgacgtacgtaccgtaagaacgtattagtaccaactaacgttattaacttacgtatacgtaagtctaagtatacgtaactactccctaacgaccttcccgtaccggtaccgaaccggaacggtccgaacggtacgtaaggaacgttaacgtaaacgtacgtaggcgtaccgtgaccc

SEQ ID NO: 249708 - DNA, 577 bp, Homo sapiens
  misc_feature: GYAE6OF01ESRLK.13.4.A04.1.454.CMB.1.raw
  modified_base (403)..(403): a, c, t, g, unknown or other
  misc_feature (403)..(403): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatcgtgtaggagacagagtacaccatcacttcgccaggcgagtcaaggacaattaactaacttaatttaaattggtatcagacaacgaaaccacggtaaacgacccctagctacctgatctacgatgacactactaagttacggaaccgtacgggtccagtacgtaagtcgtaggtaggaagtggagtcgtagggactagtacttttacttaccgtactntacgagcacgtctgacctacgtacgtagaagtattacgtacgactaactattaactactagtacagtctagtatatattactaccgtaccgtactaccgtaccgttaccgaccgtaacggacgtaacgacgtaggtaacgtaaacgttaacgaacgttcggtgtcgtcgtaccg

SEQ ID NO: 249709 - DNA, 834 bp, Homo sapiens
  misc_feature: GYAE6OF01BY5KY.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggccaccgtcctccgagggacgcccatgctgacaaggtcgggccaggacggtcgccccgtagaaccgtaggaacggccaaagtcggaacgaacccaaaggaccgaaggaccgtaaagggttgggttggtacggaaccgtacccccgtagggaaggacggaccgttcggggtaccccgtcgggtaccccgagggaccagggcccggtccgttccgggcccccttggactcggcgttggccgttcggggtccgtcgggacctagtccggttcccgaccctaaggtcggcccgttgtccgtcggacccgtaccgtaagtcggttaccgaccgtaaccggaaccgaaaccgggcccggggaacccgaacggaccccgtacgggaaccgtcccgtacgtaacggttacggaaaccgtaccgaaccggtaccgtaccgttaccgaccgggtaccgtaccgggaccgggtacgtcccgggttagggtccggggggtaaccgtacggggttacccggaacccgggtaacccccggaaaaccccggggaaccccccgtaaaaccccccgtaccggttaacccgtacccgttaaccccgtttccccggtttaccccggttttaccccccccggg

SEQ ID NO: 249710 - DNA, 786 bp, Homo sapiens
  misc_feature: GYAE6OF01B9SV0.13.4.A04.1.454.CMB.1.raw
  modified_base (176)..(176): a, c, t, g, unknown or other
  misc_feature (176)..(176): n is a, c, g, or t
  modified_base (232)..(232): a, c, t, g, unknown or other
  misc_feature (232)..(232): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgaggagggaccagggccaccgtcctccgagggacnccatcgctgcaaggtcgggccaggacggtcgcccctagaaccgtaggaacggaccaagtacgaacggaaccccaagaccgaacggaccgaaggttggggttagtacggaacggtacccccgttaggacgggacggccggttcggggaccccgttcgggtccccgagggtccacggccgccggtccgggtccccgtggccgttcgcgtcgggtcgttcgggtcgtcgggtcctaggtccggtccgcccgtacgtacgggtccgtcggaccgtccggacccgtaccgtaaggttcggggtaccgtaccggaacccggaaccggaaaccggggcccggggtaacccctaccgggacccgtacgggaccgtacccgttacggtacgggttaggaaccggtacgaccgggtccgtaacggaccctacggtcccggtacggccggtacgtcccggtgggtaccgggaccggtacgggttacccgaccggaccccggaccgtaaccccgtacccgtaccgttaccgtacccgtaccgttcccgtccccgtttaaccccccg

SEQ ID NO: 249711 - DNA, 665 bp, Homo sapiens
  misc_feature: GYAE6OF01ED0ZI.13.4.A04.1.454.CMB.1.raw
  modified_base (441)..(441): a, c, t, g, unknown or other
  misc_feature (441)..(441): n is a, c, g, or t
tcagtcacgtactacacgaccggtgctcgatttagagtagtgatcagggggcgaggagtcacgtcccaaccaggacaccagcatggacatgaggtccctgctcagctcctgggcctcctgctgctcgtggctctcgaggtgccagatgtgacatccagatgacccagtctccatcctccctgtctgcatcgtagtaggagactagagtccaccatcctacttcgccgaggcgtatcgaggaactaattaaactactttaatttaaagttggtaatacgagacctaaagaaacccgacggtaaacgcccccgtaagccttacgtgtactactacgatagctactacctaagttacggaaaccgcgggtacccagtacgtaagtcgaggtaggaagtcgtatacggtaggactagttaacttttacgtaccaactcgtaaccngacacgtcctagaccgacgtaccgtagaagtacttacgtacgaacctaactagtttaaccttgtacgtacgaacggtactaagggtaattacggtaaacttaaccgtccccgttaaccgtacgttaacccgttaccggttacccggaaccgggtaaaccggtacctaccggtaagtacggtaactaaaacgttaaacgtaacgtgggttacgccgtcggaaccc

SEQ ID NO: 249712 - DNA, 641 bp, Homo sapiens
  misc_feature: GYAE6OF01BIN1K.13.4.A04.1.454.CMB.1.raw
  modified_base (323)..(323): a, c, t, g, unknown or other
  misc_feature (323)..(323): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatccctcctgtctgcatctggtaggagacagagtcaccatccacttgaccaggcgtagtcgaaggactaattaactaaacttaatttaaattaggtatcaagacaagaaaccaaggtaaaccgtccccgtaaagtctacctagacttctaacggntgacactacctaagtttaggaaacgacgggtacccatacgaaggttacgaggtaggaacggtggtagtcgtagggataaggttattttaccttacacatacgtagactacgcgtagacacgtacctagaataagttctaagtacaacttagttaacttaccgttagtaccctaaggtacctagttaacgtagttaaccttaacgtcccttaacccgacgtacccttaccggtaccggaaccccgtaaggggaacccctacgggtaaggtacggaaaggtaacgttaaaacggtacgtaggttgtcccgtaggtaaccc

SEQ ID NO: 249713 - DNA, 746 bp, Homo sapiens
  misc_feature: GYAE6OF01DJYOK.13.4.A04.1.454.CMB.1.raw
tcagtcacgtactacacgaccggtgctcgatttagagtagtgatcaggggggcaggagtcagtccccaaccaggacacagcatggacatgagggtccctgctcagctccgtggggctcctgctgctctggctctcaggtgccagatgtgacatccgagatcgacccagtcctccactccctcctgtctgcagtcgtaggtaggagacgagtacgtaccaacctactcctacgttcgaccgagggacgtagtaccgaagtaactaacttaaacgtaaactttaagttttaaaacgttaggtaactacgaacgtaacgaaacgaaaaccgtaacggtaaaccgtaccccgtaaacgtcctaccgtagtaccgttacgtaaccgtactacgtacctaacttaaccgttaaagttaaccggaaaccggtaaccgggtacctaagtacgtaaggttacgaaggtagggaaggtgtacgtacggtaggtaactagtttaacgttttacctactaacctataccgagtaccacgtccgtcgacgtacgtaccggtaagtaagtcttaacggtctaaacgtaaactagttaaccttacgtcttaacgaggtaacgtagttaactgttaaacttaacctcccgtaaccgaaccttacccggtacccgtacgggaacccggtaagggaaccctaacgggtaacgtaacggtaacgtaaacgttaaacggacgttaggtacggtactccggtaaccc

SEQ ID NO: 249714 - DNA, 903 bp, Homo sapiens
  misc_feature: GYAE6OF01DK36V.13.4.A04.1.454.CMB.1.raw
tcagtcacgtactacacgaccggtgctcgatttagagtagtgatcagggggcaggagtcagtcccaaccaggacacagcatggacatgagggtccctgctcagctccgtgggctcctgctgctctggctctcaggtgccagatgtgacatccagatgacccagtcctccactccctcctgtctgcatctggtaggagacagacgtaccaccatcctacgttgacccgaggccgagtcgaaggaacctaacttaaacctaactttaattttaaaagtttcggttaacttaccgaagaccgaaacggaaaccgtaacgggtaaaccgaccccccgtaagtccttacccgtagtacttacctaaccggtagtacgacctacgttaacccgttaagtttaacgggaaaccggttacggggtaccctaacgtacggtaaacggttaccgaagggttagggtaaaggtcgggtaacgttacggtacggggtaactacggttttaactttttaaccgtttaccctaacctaacgttaccgacggtaccgtaccggtaccccgttaggaccgtaaccggtaaccgtaaggtaaacgtttaacgtttaacggtttaaccggtaaaccctaaaacggttttaaccgtttaaacctttttaaccggtttcggtaaacccgtaacgttaaaccggttaacgtttaaagtaacggttaaacttttaaacccggttacccccttaacccggtttaaccctttaccccggtaaaccccgggttttaacccgggaaaccccggtaaaaaccggggtaacccgtaacccgggttaaccgggtaaaggtttaaaccggttaaaaacccgtttaacggggtaaaaccttgggggtaaacccgtcgttacccggggaaacccc

SEQ ID NO: 249715 - DNA, 584 bp, Homo sapiens
  misc_feature: GYAE6OF01BYNPY.13.4.A04.1.454.CMB.1.raw
  modified_base (274)..(274): a, c, t, g, unknown or other
  misc_feature (274)..(274): n is a, c, g, or t
tcagtcacgtactacacgaccggtgctcgatttagagtagtgatcagggggagtcagtcccaaccaggacacagcatggacatgggggtccctgctcagctcctggggctcctgctgctctggctctcaggtgccagatgtgacatccagatgacccagtctccatccctccctgtctgcatctgtaggagacagagtcaccatcacttgccaggcgagtcaggactattaacaattaatttaaattggtatcagacaagaaaccaggtaaacncccctaagctcctgatctacgatgacatcctaatttacggaacgtacgggtccatacgaaggttcaggtggaaggtggatcggtagggactagttattttacttcactatcaacgcacgtcctagcacgcctagaagtattagtcgactaaactattacgttactagtacgtagactagtaattcgaattaaccgtcttacccgtataccttacccgtacggacccgtaacgggaccaaccgggtactagggtaactaaagtttaaaacccggattcgggtacggtcctagaccctacctcgtttacccg

SEQ ID NO: 249716 - DNA, 737 bp, Homo sapiens
  misc_feature: GYAE6OF01A2LTH.13.4.A04.1.454.CMB.1.raw
  modified_base (194)..(194): a, c, t, g, unknown or other
  misc_feature (194)..(194): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatcgacccagtctccatcctcctgtctgcatctgtagganacgagagtccaccatcacgttcgaccgaggcgagtcgagactaattaactaacttaatttaaattggtatcgagacaacgaaaccaaggtaaccaccctaacgctaccgtagtactactacgatcgactattaccgtaaagtttacggaaaaccgtcgggtacctaagtaccgtaacgggtttacgaaggtacgggtaaagtcggtaacggttacggtaggggtaaccttaggtttaactttttacccgttaacaacctacttacgacgtaccgacgtccgtacgaaccgtacgtacgtaaggtaaccttaagtttaacttaccggaactaacttacgttttaacgtaaccgtttacggtacaacgtaacggttacgttaaagttacgttaaacctttacccttaccccgtacccgttaaaccttcccggttaaaccccgtccggggtaaaccgtaacgggaacccgtacgggaaacggttaacggtaaacggttaaaaccgtttaaacggacccggttaggtacggtcccgtaaggtacccc

SEQ ID NO: 249717 - DNA, 614 bp, Homo sapiens
  misc_feature: GYAE6OF01EMR0D.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgcccctgaacctgaaggccaatgagacccaagacaggccaagtgggtgtgagaccctgaggagcgtgggccctggtcccaggcagcgcgtcggcccctgcctgctcgcgtgggtcgtggccgagtcggtccgcccgtagtcggccgtcgcctcgccgacccagttcggtcgccgaaccgcgaaacgggcccggggaacccacggacccgtcggacgcccgtacgacggttggaacggtccgacggcccgacgtcccgagtcccgtggacccgggagtcccgtggtcgggcgacggtcgacggaccccgaacggacccccaacccgtaccgtacgaccgtaccctccgtccgtaccccccgg

SEQ ID NO: 249718 - DNA, 750 bp, Homo sapiens
  misc_feature: GYAE6OF01CZTR0.13.4.A04.1.454.CMB.1.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (509)..(509): a, c, t, g, unknown or other
  misc_feature (509)..(509): n is a, c, g, or t
  modified_base (742)..(742): a, c, t, g, unknown or other
  misc_feature (742)..(742): n is a, c, g, or t
tcagtcacgtactacacgaccggtgctcgatttagagtagtgatcgagggggcaggagtcagtccccaaccaggacacagcatggacatgagggtccctgctcagctccgtggggctcctgctgctcgtcggctctcgaggtcgccagagtgtcacataccgagactcgacccagtcctcctactccctcctcgttcncgtctatcgttaggacggganacgagtactaccactactctacctcgccgacggccgtagtacgaagtaactaattaaacctaagtttaatttaaagtagtacacgagacgaaacgtaaaccgaacggtaaacccgaccctaagtccttaccgtagtactacgtaacgtactacgtactacgttaacgttaaacgtaacgggtaaaccggtaccgggttacctaacgttacggtaacggtaacggtagggtaaggtaacggttcggagttacgttaacgggacttaagtttaaccttttacgtactaacgntaacgacgactcggtacctagaaccgtacgtaacgtaagtaacgttacgttacgtaacgtaacctaaattacttaacttacgtacgtgaacttcggtaaactagtaccttaacgtaccttaccgtccgtaacgttccgtaaccccggtaacgaaccgggtaaaccgaactacggtaacgaacgggttaaccgtaaaacggttaaccggtaataccgggtttcgacccggttanaaaccccg

SEQ ID NO: 249719 - DNA, 727 bp, Homo sapiens
  misc_feature: GYAE6OF01AZMR6.13.4.A04.1.454.CMB.1.raw
  modified_base (129)..(129): a, c, t, g, unknown or other
  misc_feature (129)..(129): n is a, c, g, or t
  modified_base (165)..(165): a, c, t, g, unknown or other
  misc_feature (165)..(165): n is a, c, g, or t
tcagtcacgtactacacgaccggtgctcgatttagagtagtgatcagggggcaggagtcagtcccaaccaggacacagcatggacatgagggtccctgctcagctcgtgggctctgctgctctggctcncaggtgtcagatgtgacatccagatgacccagtccnccagtccctccctgtctgctatcgtagtaggacacagtacgtcacctagttcctacgttcgccgaacgggcgtaacgtaccgaagggactaagttaaaccgtaacgtttaactttaaaagttgggtaactaccgagtacgaacggaaaccgtaaggtaaacccgtaccccgtaagccttaccgtatacgttactacggtactgacctagtacctaaagtttacggaacgtcgggtacctataccgtaaggttcgaggtaggaacggtgtataccgggtaggactaagtttactttacgttaccgacctacgtacctagactaccggtcctacgacttaacgcggtaatagtacgttatacggacaacgttattaacttccgttagtaccgtaggtacttagttagaacgttacttaacgtccccgtaccggtacttcccgttacccggtaacccgggtacgggtaaaccgtaccggaaaccggttacgggtaaacggggtaaacttaaaccgggtttaaaacccggtacggttaccggtttaacggccggtttcaaacccgg

SEQ ID NO: 249720 - DNA, 721 bp, Homo sapiens
  misc_feature: GYAE6OF01AHOO4.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgacccagtctccatccctccctgtctgcatcgtggtaggagacagacgtcacctagtctacgtcgccgtagggcgtacgtaccgaagactaaactaaactaacttaagttttaagtaggtactacgacacgtaaacgaaccgtaaggtaacccacccgtaatccgttcgaatactacgtacgattccggaactacgtaccgtaagttaacgggaaacgtccgggtaactacgtacgtaacggttcgaaggttaagcggttatacgtgtacggaactttaacggtttacttttaaccacgtacctacgtacgtacgtaaccgtacgtccgtcggttaccaccggttaagtaggaacgttacttacgtacgtaacctaacgttaacttagtttactacggaactcgtaacgttagttaactagtttaaactaccgttacgtaaccgtacccttaggtaaccgtacccggtaacgaaacgggtaacccgtaacggtaacgtaacgggttaaactaaacgggtaaaccgttcggtacgggtaactcgggtaaactcccggtaactttaccgg

SEQ ID NO: 249721 - DNA, 810 bp, Homo sapiens
  misc_feature: GYAE6OF01B1RIC.13.4.A04.1.454.CMB.1.raw
  modified_base (176)..(176): a, c, t, g, unknown or other
  misc_feature (176)..(176): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagcagtccagggagaggacagagccaagtggactggggtntactgtaacagccctgctggcgagaggaccagggcaccgtcctccgaggggacgccctatggctcgcaaggtccgggccaggacgggtcgcccctagaaccgtggaacggacccaagcgaacgaaccgaaacggaacaagggacccgaaggtggggttagtaggacggaacccctcggaacgggagtaccgtcgggcccgtacggttccccgaggccgagcggccgttcggccccgttggacctcggccgttggccggtacgggtcgttaccgggccgtaacggttccgggtacccggtcccgtaacggtcgggtcccgtcggtccgtaccgggtccgtaccccggtaaagtttcgggttaccggtaccgaaccggaaccgggaaaacgggcccggggaaacccggaccgggtaacccggtacgggaccggtaccgttacggaacggttacgggtaacgacccgtacgggttacccggaaccgtacccgacggtacccgtagggtaccgggacggtacccgggttcgggagggggtacccggtagggacccggtaaccggcccgaaacccggggacccttaaccccgtacccggtagtacccccgtacgttccccgttccggttaacccccccg

SEQ ID NO: 249722 - DNA, 740 bp, Homo sapiens
  misc_feature: GYAE6OF01DIO55.13.4.A04.1.454.CMB.1.raw
  modified_base (363)..(363): a, c, t, g, unknown or other
  misc_feature (363)..(363): n is a, c, g, or t
tcagtcacgtactacacgaccggtgctcgatttagagtagtgatcagggggcagttggtagatgcccctctgggagagactccccgaggggtgacagccatcggaccctggaagggcctgggctagggacagggaccagagccagtcagggagaggacagagccaatggacgtggggtgtactagtaacacgccctgctggcgagagggaccagggcaccgtcctacgagggacgccatcggctgcgaaggtcgggcaggacggtcgcccctagaacctgaacgcaagtagaacgaccgaagacgaggaccaaggtcgggttagtaggaccgaccgtggacgagcgtcggcctcggccgagcncgccgcgccggccctgctgcgtcgtcggtcgggtcgtcggtacctagttccggtccgccgtacgtcggtccgtaggccgtcggcccgtaccgtaagttcgggtacacccgaaccggacggtaaaccgggcccgggtaacccgacccgtaccgtcgggtaaccgtacccgtaacggtaggtaacgggacggaccgaccggaacccgtactaccccggtacgggccgtaccggggaccgggtacggtcccgggttacggggtacggggaccggtaccgggtacccgaacccggaaacccccggaccggtaaaccccccgaaacccggtcccgtaacccgtttacccacccgtttacccggttcccccgttaaccccccg

SEQ ID NO: 249723 - DNA, 769 bp, Homo sapiens
  misc_feature: GYAE6OF01D4BFR.13.4.A04.1.454.CMB.1.raw
  modified_base (179)..(179): a, c, t, g, unknown or other
  misc_feature (179)..(179): n is a, c, g, or t
  modified_base (234)..(234): a, c, t, g, unknown or other
  misc_feature (234)..(234): n is a, c, g, or t
tcagtcacgtactacacgaccggtgctcgatttagagtagtgatcagggggcagttggtagatgcccctctgggagagactccccgaggggtgacagccatggacctggagggcctgggctagggacagggaccagagccagtccgagggagaggacagagacaagtggacgtggggtntactgtaacagcctgctggcgagacgggaccagggccaccgtcctcgaggggacnccatgctgacgaaggtcggccagacggtcacccctagaaccgtgaacggccaagtacgaacgaacccgaaagaccgtaggaccgaaaggttgggttgtacggaacgtaccccgtaggacggacgcggtaccgggccttcgggcccagggcacggcgccgtcggaccctggctcgcgtcggcgttagggtcgcggcacggtcggtaccgcctagtcgaccgtgtcgtccggacgtacccgtaagtcgggttacaccgaaccggaacgaaaccgggtcccggggtaacccaccggtaacccgtcgggaaccgttcccgtacggttaaacgggtcgggaaacggacccgtacgggtaccccgtaacgttacccggacggtacccggtaccggaccggggttaaccggccgggtacggggttcggggacccgggttaaacggacccgtaaacccggacccggggaaacccgaacccccgaaaccccgtacgttaccggttaaccctcccggtttacccgttccccgtttaaccccccgg

SEQ ID NO: 249724 - DNA, 904 bp, Homo sapiens
  misc_feature: GYAE6OF01BK9VY.13.4.A04.1.454.CMB.1.raw
tcagtcacgtactacacgaccggtgctcgatttagagtagtgatcagggggcagttggtagatgcccctctgggagagactccccgaggggtgacagccatcggaccctggaagggcctgggctagggacagggaccagagccagtccgagggagaggacagagccaagtggacgtggggtgtactagtaacagccctgcgtggacgaggacgggaccgaggggtaccaccgtcccgtaccgacggggacacccagtcgcgtggaccgaagggtccgggaccgacggacggtccgaccccgtacggaaccgtaggaaaccggaccaaagtcgaaccgaacccgaaaggacgacggaccgtaagggtcggtacgtacgaccgaccgtggacggaccgtcggtaccggtccgtcggtacccgacggtcgacggcccggtaccgtccggtccccttaggccgttaccggtcgttccggtccggtttaccgggtccggtacgggtacccgttacggggtttcccgggccccggtaccgttacgggtcccgggttccgtccggggttaccgtcccgggggtaaccccgttaaccggtaagggtttcccgggtaacccggaacccgaacccggggtaaacccggggaaacccggggtacccccggggaaacccgtaccggggtaccccgtaaccgggacccggttacccgttacgggtaacgggtaccgaaccgggtacccgtacccggacccgtacggaacccgggtcccgtcccgggaagtcccgggccggttccgggggtagggtacccggggttacgaacccggttaccgaccccggtacccggaaaccccgttacccgaaccccgttgacccgtacccgtaccgttcccgttcccccggtccccg

SEQ ID NO: 249725 - DNA, 685 bp, Homo sapiens
  misc_feature: GYAE6OF01EDUIB.13.4.A04.1.454.CMB.1.raw
  modified_base (196)..(196): a, c, t, g, unknown or other
  misc_feature (196)..(196): n is a, c, g, or t
tcagtcacgtactacacgaccggtgctcgatttagagtagtgatcagggggcaggagtcagtcccaaccaggacacagcatggacatggagggtccctgctcagctcctggggctcctgctgctctggctctcaggtgccagatgtgacatccagatcgacccagtctccatcctccctgtctgcatctgtagganacagagtccaccatcacttgccaggcgagtcaggacattaaacaacttattaattggtatcagacaagaaaccaggtaaacgcccctaaagctacctagactactacgatcgactactacctaagtttacgggaaaaccgtcggggtacccaagtacgtaaacggttacgaaggtacgggtaaagttggtactacgtacggggaacttaggtttaactttttactttaccgaaccttaagttaccgaacgacgacggtacccgtagtaccgtaacgtaccgtaaggtaagtaactttaacgttacgaaccaaactttaagtttaactttaacgtacggtaacaggtactaacgtaattagtaaacttaacgttaccctacccgtaaatcccgttaacccggtcggaacccgaaaggggttacccacgggtaacgttaagggaaacgtaaaacgttaaaccggaaacgtggttaacgccgtggtaacccc

SEQ ID NO: 249726 - DNA, 886 bp, Homo sapiens
  misc_feature: GYAE6OF01EO83E.13.4.A04.1.454.CMB.1.raw
tcagtcacgtactacacgaccggtgctcgatttagagtagtgatcagggggagagaggagcccagccctgggattttcaggttgttttcatttggtgatcaggactgaacagagagaactcaccatggaatttgggctgagctgggtctttttcttgtggtcttaatttttaaaaggtgtccagtgtgaagtgcagctgggtggaggttcgtggggggagtcgttaggtacaggccgttggggacggttccctgacgaccttctcctgtcgacagtcctcgtggtactttcctaccttttaagacctaaactacgttacgcctaagtcggtaacggtccgttacgggggttccccacccggaaggggtcccttacccggggaaaggggggaaaccggggggttcgttacggggtaagggttcggggttacccttaacgtaaaaccgtttaagttttacgggtcggtacgttaacgggttcgggttaccggaacccctaacctaaacgtaaacgttaacccgttaaccggacgtaacggtacccgttaaccgggtacggtaaaccggggccgttaacgttacccaacgtacgttaccctaccgaagtaaccgtaaccctaattaacccgaaacgtaacgaaccgtcgtttaagttactaccgttaacgaactaaaacggttacgaaaccgtacggtaacccgtagggaaccggaaccgggtaacccggaaacgggaccgtaaccggtaaccgtttaacgtaactttaaccgggtacggttaacgggaaaccgttaaaccgggtttaaaaccttttaccccgttaagtttaacgttttacgaaccgttacgggtacgggtacccgaacgggttaccgtcgggtaaccc

SEQ ID NO: 249727 - DNA, 643 bp, Homo sapiens
  misc_feature: GYAE6OF01BR1FE.13.4.A04.1.454.CMB.1.raw
  modified_base (176)..(176): a, c, t, g, unknown or other
  misc_feature (176)..(176): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccggtctccgagggagcccatgctgcaagtcggccagagtgccctgacctgagcaatgagaccaagacaggccaagtggttgtgagaccccgtgaggagcgtgggccctggtcccaggcagcgcgtggccctgctgctgctgggtcgtgtccgagtcggtcgcccagtcgggcctcgcgtcgccgtccgaagttcggttgccgtaaccgacgtaaacggcccggggaacccacggaccccgtgggaccgccgtacgacggttacggaacgtccgacggtacccgacgttaccgacgtccgtcggacggtaccgaccgttcgggtcggggtaccgtacgggttcccaaccgggtaccccgaaccggtacccccgtaacccgtacccgttacggttaccctaacccgttccgttacccggtttacccccccg

SEQ ID NO: 249728 - DNA, 636 bp, Homo sapiens
  misc_feature: GYAE6OF01AQRCV.13.4.A04.1.454.CMB.1.raw
  modified_base (143)..(143): a, c, t, g, unknown or other
  misc_feature (143)..(143): n is a, c, g, or t
  modified_base (268)..(268): a, c, t, g, unknown or other
  misc_feature (268)..(268): n is a, c, g, or t
  modified_base (625)..(625): a, c, t, g, unknown or other
  misc_feature (625)..(625): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccaggatgtnacatccagatcgacccagtctccatccctcctgtctgctatcgtgtaggagacagagtccacctatccacgttcgccgagggcgaagtccaaggacattaaacaacttatttaaattggtatcanactaacgaaacctaggtaaactcccctaaagtcctaccttagactacaagtactacgcactactaagttacggaaacgacgggtaccctaagtacctaaggttcaaggtggtaagtgatcgtaggaactagtacttttactacgacctatcagactacggcctaggtacagactacggaataacttagttacgaactaaactaacttaagttttacctagggtaccagtacaaggttacctagtaacttaactcccgtacccgacttacgtaacccgttaccggaaccggtaacgggacaaaccggttaggtacggaaacgtttaaacgtaaaccgaccggtgggaccctggtaccnccgtaacgttc

SEQ ID NO: 249729 - DNA, 767 bp, Homo sapiens
  misc_feature: GYAE6OF01BVGGV.13.4.A04.1.454.CMB.1.raw
  modified_base (178)..(178): a, c, t, g, unknown or other
  misc_feature (178)..(178): n is a, c, g, or t
  modified_base (260)..(260): a, c, t, g, unknown or other
  misc_feature (260)..(260): n is a, c, g, or t
  modified_base (384)..(384): a, c, t, g, unknown or other
  misc_feature (384)..(384): n is a, c, g, or t
  modified_base (562)..(562): a, c, t, g, unknown or other
  misc_feature (562)..(562): n is a, c, g, or t
tcagtcacgtactacacgaccggtgctcgatttagagtagtgatcaggggtctgagagaggagcccagccctgggtatttttcaggttgttttcatttggtgatcaggactgaacagagagaactcaccatggtagtttgggctgagcgtggtcttttctgtgtcttaatttaaaggntcagtgtgagtgcagcgtgggtggacgttcgggtggggggaggtcgttaggtacacggtccgtggggacggtccgtggtacnccgttcctccgttgcgtacacgtccttctaggtacttacctacgtttagacctaactatcgacctatggtacgcggttaccgggccgcgtacggtccgacgggaagggggacgggtcgtagggnggtacgggttccaactaacgttagttacgtgtaccgttaggtcggcctacccgacgactaacgtaccgacgcgtacgtaccgtacgggtaaggaaccgggtcctacttacctaccacgttacacgaacgtaacgtaactaactaaaccggtaaacgaccgtaactctacggtttaacncgtaacgtaacaacgttacgaactacggtacccgtaggggacgtaacccgggacccggaaggtacccggacgttaccggttaattcggttaacggtcggtaaacgtaaccgggttaaacggtttaaacccttttaccccgtttagttttacggtttaaaccggaccggtttaaggaccccgggggtaacgtcccgggttaacccg

SEQ ID NO: 249730 - DNA, 831 bp, Homo sapiens
  misc_feature: GYAE6OF01DQQOU.13.4.A04.1.454.CMB.1.raw
  modified_base (253)..(253): a, c, t, g, unknown or other
  misc_feature (253)..(253): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctcccagataccagatgtgacatccagatcgaccagtctccactcctcctgtctgcatctcgtggagacagacgtcaccgtcacgttggccgggcagtcacgacaattacactttattacgcctaggtancagcgaagaaggccgagggacgtacgttacctaaattagtgtactcttctgtctcggtccgtccgtaccgttgacggtacggttacccggggtcctacgttacggttccggttacgtacgggttaggggtcgggttaggtacgttaaccgtaagggtaaactacggttaacttacccgacctttcctaaccctaacctaacctacccgaaacccccgtaacccgtacgtaccccgttaaaccctaggggtaaacgtacggttttacgggttaaggtttaaacgttttttaacgttaccggtaacggtttactaaaccggttaaccgtttaagggttacggggttccgggtacccggggtccccgtttacggttaccggttttaacccgggggttttacccggggtaacgggggtaaccgggtaaaccggttaacggggtaccggaaacggtaaacgtaaccgtttaaaacccgggtaaaacccggttaagggttttcgggaacgggtcccttaacccgggtaaccccggtttaacgttacccgtttaccgttcccggttttaactttaaccccccggg

SEQ ID NO: 249731 - DNA, 666 bp, Homo sapiens
  misc_feature: GYAE6OF01CFDNM.13.4.A04.1.454.CMB.1.raw
  modified_base (180)..(180): a, c, t, g, unknown or other
  misc_feature (180)..(180): n is a, c, g, or t
  modified_base (566)..(566): a, c, t, g, unknown or other
  misc_feature (566)..(566): n is a, c, g, or t
  modified_base (655)..(655): a, c, t, g, unknown or other
  misc_feature (655)..(655): n is a, c, g, or t
  modified_base (660)..(660): a, c, t, g, unknown or other
  misc_feature (660)..(660): n is a, c, g, or t
tcagtcacgtactacacgaccggtgctcgatttagagtagtgatcagggggcaggagtcagtcccaaccaggacacagcatggacatgagggtccctgctcagctccgtggggctcctgctgctcgtggctctcaggtcgccaggatgtgaacatccgagatcgaccctacgtcctaccncttccctcctgtcctgacctatcgtaggaggacgagagactaccacctatccacttcggacgacggcgtacgtacgaagtactaaacttaaactaactttaagtttaaagtaggttaactacgaacgacgtaaaccggtaaacgaacggtaaacccgtacccctaaagccttacgtacgtaacttacgtaacgtcgtactctaacgtacctttaaggttaaccgaaacggtaccggtctaagtacggtaacgttagaggtaaggtacgtagtacgtacggtaaggtacgtttaacgttctttaacgtacccatacgtcgacgacgtcgactgacgtacgtacagtagaatacgtaagtacctaataacttatcgtagtacacgtanacgttaatacgtaataccgtacctacgtactaccgacctacgaacggtacgacgtacggacgagtaaagtaacgttaaacgcgtacgtntacgngtaacc

SEQ ID NO: 249732 - DNA, 763 bp, Homo sapiens
  misc_feature: GYAE6OF01DUD8N.13.4.A04.1.454.CMB.1.raw
  modified_base (185)..(185): a, c, t, g, unknown or other
  misc_feature (185)..(185): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
tcagtcacgtactacacgaccggtgctcgatttagagtagtgatcagggggcagttggtagatcgcccctctgggagagactccccgaggggtgacagccagtcggaccctggaagggcctgggctagggacagggaccagagccagtccgagggagaggacagagccaaagtggacgtggggtntactagtaacacgccctgcgtggacgaggacgggaccagggccaccgtccnccgagggcncccagtcgctgacgtaaggccgggacaggcggtccgcccctaggaacccgtggaacggaccctaaagtacggaacgaacccgaaaggaaccgacggacccgtaaaggttcgggttaggtacgaccgtacccgtggaggacggcgtccgggccgtcggccgagcgacgcgtccgtcggcctcggtctcggctcggtcggttgggtacgtccggccgtacggttccgccggtccgacgtccggtccgtacgtccgtcggaccgtaccgtaacggttcgggtcccaccggaaccggacggtaaaccgggcccgggaacccgaccggtaacccgtcgggaccgtaccgtacggaggttacggacgtaccgacggtcccgtacgtcccgaacgggtccgcggacgggtccgtcgggttcgggacgggaccggcgggtaccgacccggaaccccggaaccggtaaccccctacccggtacgtacccgttaacccgtcccgttcccgtccccgtttaaccccccg

SEQ ID NO: 249733 - DNA, 910 bp, Homo sapiens
  misc_feature: GYAE6OF01BQ3WV.13.4.A04.1.454.CMB.1.raw
tcagtcacgtactacacgaccggtgctcgatttagagtagtgatcagggggcaggagtcagtcccaaccaggacacagcatggacatgagggtccctgctcagctccgtgggctcctgctgctctggctctcgaggtcgccagtagtgtacgactatcccagtactacgaccctagtcctccacttccctcccttgtcgtgtactagttcgtaggtaaggaacgaacgacggacgtaccaacctacttaccgtaaccgtttccggaccggagggtaccgtaacggtacgaacggtaacttaaaacgtttaaaaccttaaacttttaaagtttttaaaaggtggttaacctacgaaacggaaccttaaaaccggaaaaccgtaaacgggtaaacccgtaacccccgttaaggtcccttaccgttagtaaccttacgtaaacgtcgtcgtaaccgttaaccttaacgtttaaacgggttaaaccggtaaaccgggtacccgggtaaccctaaaggttaccggttaaaggttacggtaacgggttaagggtaacggttacgggtaacgttcggggtaacgggtaaacttttaaacgtttttacccttttaaccggttacccaaacgttacgaccggtacgaacccgtacggtcctaacgggaccgtaacgtacgttaaggtaattactttacgaaaccgtacgaaagttttactttacgggttactacggtacctaggaaccgttaagggttaacctttaagtacccttaaccgtcccgtttaaacccacggtttacccctaccgggtttaacccgggaaaacccggaggtaaccccgttaaggaccggtttaaaaggaacccgttaaaaccggttacggttacgtcgggttaactccccgaaagttaccccg

SEQ ID NO: 249734 - DNA, 754 bp, Homo sapiens
  misc_feature: GYAE6OF01BML6C.13.4.A04.1.454.CMB.1.raw
  modified_base (235)..(235): a, c, t, g, unknown or other
  misc_feature (235)..(235): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgaggacgggaccagggccaccgtcctaccgaggggacncccatgctgacaaggtccgggccaggacggtcgcccctagaacctgaacggccaagtacgacgaccaagacacggaccgaaggtgggtagtcgacgaccccgtggacggagtcgtacgggccctcggcccaggcacggcgcgtcggcccctggctcgtctcggccgttgggtacgtcggtccgtacggttcgggtaccgtcccgtaggtccggccgtacgtccgtcgtacccgccgtaagttcgggtacgacccgaaccgggtacgaaccgggtccggggaaccccgtacggaccccgtcgggaaccgtcccggttacgggtaaccggttaccggggaacgccggtaacccgggtccggaccgttacccggaacggtcccgttaccggggacgaccgggttcccgttaacggggggtcgggtaccggtacgggtaccggacccggtccccgaaaccggggtacccccaaacccggttccgtacgttacccgacccgttccgttacccgtttaccccccg

SEQ ID NO: 249735 - DNA, 688 bp, Homo sapiens
  misc_feature: GYAE6OF01BQWSK.13.4.A04.1.454.CMB.1.raw
  modified_base (123)..(123): a, c, t, g, unknown or other
  misc_feature (123)..(123): n is a, c, g, or t
  modified_base (129)..(129): a, c, t, g, unknown or other
  misc_feature (129)..(129): n is a, c, g, or t
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (337)..(337): a, c, t, g, unknown or other
  misc_feature (337)..(337): n is a, c, g, or t
  modified_base (451)..(451): a, c, t, g, unknown or other
  misc_feature (451)..(451): n is a, c, g, or t
tcagtcacgtactacacgaccggtgctcgattttagagtagtgatcagggggagtcagtcccaaccaggacacagcatggacatgagggtccctgctcagctccgtggggctcctgctgctcngctctnaggtcgccagatgtaganactccagatcgaccctagtcctccactccctccctgtctgctatcgtgtagganacngactcacctatctacgtgcccgaggcgtagtacaacggaactaacgtttaaactaactttaattttaaacgttgtatacgaagacaacgaaaccgaggtaaccccacccgtagccttcgtatactacgaagtntacgactactaccgttaaaggttacggaacgccggttacaacgtacgttaacgtcgaggttacggaagtgtacgtacggtagacctattttactttaccgacacgtactagacncctacggtctacgcacgtacgagtaacttgttacgtcgttaaacttacgtttacgttacgtattacaaacgtagttacctaacctaggttaaccttcggtacccgggttacggttaaccggccggtaaaccggtaacgggtacccgtaaaagggaaccgttaaacgaaccgttaaggttacggcgaccggttacaccgggttacctagttccgttaccgttacgtcccgtttacccg

SEQ ID NO: 249736 - DNA, 604 bp, Homo sapiens
  misc_feature: GYAE6OF01D15FR.13.4.A04.1.454.CMB.1.raw
  modified_base (176)..(176): a, c, t, g, unknown or other
  misc_feature (176)..(176): n is a, c, g, or t
  modified_base (231)..(231): a, c, t, g, unknown or other
  misc_feature (231)..(231): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccaggggcaccgtcctccgagggacncccatcgctgcaaggtcgggccaggaggtcgcccctgaacctgaaggccaatgagacccaagacaggccaagtggttgtgacgacccgtggaggagcgtacgggccctggtcccgaggcgagcgcgtcggccctgctgctgcgtggtcnggcagtcggcgccngtcggcctgcgtcgccgtccgaagttcggttcgccgtacgacgaacggccgggaccacggacccgtggacgtcctacgacggttacggaacgccgacgccgtactccgacgtccgaggccggacgtcggtggtacgggcgtacggtccgaacgtcccgaaccgggccccaacccgtacgtaccgtaccgtcctccgtcccgttacccccg

SEQ ID NO: 249737 - DNA, 747 bp, Homo sapiens
  misc_feature: GYAE6OF01DCY9E.13.4.A04.1.454.CMB.1.raw
  modified_base (234)..(234): a, c, t, g, unknown or other
  misc_feature (234)..(234): n is a, c, g, or t
tcagtcacgtactacacgaccggtgctcgatttagagtagtgatcagggggcagttggtagatgcccctctgggagagatccccaggggtgacagccatggaccctggaaggcctgggctagggacagggaccagagccagtccagggagaggacagagccaatggacgtggggtgtactgtaacagccctgctgggcgaggacgggaccagggcaccgtccgtccgagggacncccaatcgctagcgaaggtccgggaccaggacggtacgccccgtgtaaccgtagaacggaccaaagtggaacgaaccccaaggaacaacggtacccgaaggtggggttcgtaggtaacggacccccgtaggaacgggacggacgttccggggcccgttcggtacccgagggtccgacggaccgccgtccgggcccgtcgtccgtcggcctcgggccggttcgggtcgtcggtacgtacgtcggccgtccgtacgtggccgtcgcgtcgccgacctaacgttcgggtacgaccgaccgtaacgaacgggcccgggtaaccgacccggtacccgtcggtaaccgtaccgtacgtacggtacggagaccgaaccgtcgtaccgtccgaacgtccggtaccggacgggtcgtaccggtcggggtacgggtaccgtaccggtacctaccggtacccggaaacccgtaccccgtacccgtccgtacaccgtttaccccgtcgtttaccccctacccccg

SEQ ID NO: 249738 - DNA, 864 bp, Homo sapiens
  misc_feature: GYAE6OF01DJSX6.13.4.A04.1.454.CMB.1.raw
  modified_base (195)..(195): a, c, t, g, unknown or other
  misc_feature (195)..(195): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagactcgacccagtcctccactcctccctgtctgcatcgtgtagganacagacgtccaccatctaccttagccgagggcgtagtacgacggactaattaaactaacttaattttaaagttggtaactcgaacggacctaaaggaaaaccgtaaggtaaaaccgcccccctaaaggccttaccgtagtacttacgtaaccggattcggacctaacttaacccgttaaaagttttaacggggaaaaccggtaccgggggttacccctaaagttaccggttaaacgggtttaccgtaacggggttaacggggttaaaggggttaccgggtaagtttacccgggtacggggttaaacccgttaacggtttttaaaccgtttttttaaaccccggttttacccgaaaccctttaacgtttacccgaacgggtacccttaaccggtcccccgttaggacccggtaccgttaacccggttaagtaaacggtactttaacgttacggaaacccttaaaccgtaaggttttaactttaaccggtacgttacgaacgttaccgttaagttaacgtacgtaaactttaccgtaccccgtttaccgtaccttaccggtaaccccgggttcggaacccggtaaacgggacctaacggtaaggttacgggaaaccgttaaacgtttaaaccgacggttacggtacggtataccgtacccgtcttaaccgg

SEQ ID NO: 249739 - DNA, 772 bp, Homo sapiens
  misc_feature: GYAE6OF01CB6MG.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgacccagtcctccatccctccctgtctgctatctggtaggagacagacgtcaccatcctacttcgccgaggcgagtcgaggaacctaattaaactaaacttaattttaaagttggtaactcaaggtaccaaacggtaaaaccgtaaggtaaaaccgtaccccctaaagccttaccgtagtactacgtacgatcgtctaacttaccgtaaagtttacgggaaaaccgtccggggtaccctagtacggtaacggttacgaagggtaggggtaacgtggtaggttccggtaggggtacttaaggtttaactttttaccgtttaccactatccgacgactacggtacctgacctacgtaccgttaaggaaacgtattaccgtacgaacttaaacgttactttaacgttactacggtaacgtaactacgttaagtaacgttaggtaaaccctttaacgttcccccttaacccgttacgttacccccgttaccggttaccccggggaaaccgtaaacggggaacccgtaccgggtaaccgttaagggtaaaaccggttaaacgtttaaaaccgggacccgtttaggggtaaccggttaccaacccggttaactaccctttaccgg

SEQ ID NO: 249740 - DNA, 757 bp, Homo sapiens
  misc_feature: GYAE6OF01C8CHR.13.4.A04.1.454.CMB.1.raw
  modified_base (147)..(147): a, c, t, g, unknown or other
  misc_feature (147)..(147): n is a, c, g, or t
  modified_base (205)..(205): a, c, t, g, unknown or other
  misc_feature (205)..(205): n is a, c, g, or t
tcagtcacgtactacacgaccggtgctcgatttagagtagtgatcagggggcaggagtcagtcccaaccaggacacagcatggacatgagggtccctgctcagctccgtggggctcctgctgctctggctctcgaggtgccagatgngacatccagatacgaccctatctaccactccctcctcgtctgcctgtctaggtagganacaggtactaccaacctatccaacgttcggaccgaggacgacgtacggaagtaactaatttaaaactaactttaagttttaaaagtgttacacaacgacgaaacgaaacgaaacggttaaacccgaccctaagtccttacgtagtaacctacggaactagtactactaacgttaaccttaaaggttaaccggaaacgggtaccgggtacctaaacgtaacgttaacgggttacgtagggtacgggtaaagttcgggagtttacgggacggtaagttacgtttaacgtttaccttaaccgaaccttaataccgtacacgtacgtccgtacgacgacctacggtaaaggaactagtaacgtagaaactaacgtaactttacttaacggtcgttaacgtacgtaacgttaagttaaccgttaacgtaatttaaccctccttaacccgacgtttaccctaaccccgggttacggaacccgaaaccggggtaactaacgggtaacgaacggtttaacgaaaacggttaccgaagttaccggtctaccggacctaccg

SEQ ID NO: 249741 - DNA, 764 bp, Homo sapiens
  misc_feature: GYAE6OF01CR5DA.13.4.A04.1.454.CMB.1.raw
  modified_base (196)..(196): a, c, t, g, unknown or other
  misc_feature (196)..(196): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcgaggtgccagtatgtgacatccagatgacccagtctccatcccgtccctgtctgctatctgtacgganacaggactccacactcacttcgaccgaggcgacgtacgagtactaattaaactaacttaattttaaagttggtaactacgaacgacaaacgtaaaaccgaaacggtaaaccgtccccctaaagtccttaccgtagtaccttacgtacgacgtcgaccgtacttaccgtaagtttaacggaaacgtaccggggtacccaagtaccgtaaggttacgagggtaggtaagtgtaacgttcggaggtaactacgtttaacttttacctttacaccgtacttcgaacgtcgaactccgtagaccgtacgtaccgtaaggtaaaagtcctttaagttacggaacctaaaacgtttacttttaacgtttaactacgtaacgtaacggtaccttaaggttaacttaacggtaactttaaccgttaaccccgtacgtttaccgtaaccccggttaacccgttacccgggaaaacgtaaccgggtaaccgtaaacggttaacgggttacggtaaaaccgtttaaacgttaaaaccgttcgggtaggtacccgttagaaccgttacccgtacgtttacg

SEQ ID NO: 249742 - DNA, 887 bp, Homo sapiens
  misc_feature: GYAE6OF01DL8DS.13.4.A04.1.454.CMB.1.raw
  modified_base (458)..(458): a, c, t, g, unknown or other
  misc_feature (458)..(458): n is a, c, g, or t
tcagtcacgtactacacgaccggtgctcgatttagagtagtgatcgagggggcagttggtagatcgcccctcgtgggagagactccccgaggggtcgacgagccagtcggacccgtggaacgggcctgggacgtagggacgagggaccaggacgccgagtccgagggagaggacagacgaccgaagtggacgtggggtacgtacgtgtaacgcgcccgtggccgtggcgaaggacgggaccgacgggccaccggtccgaccggaggacgtcccagtcgcgtgacgtaacggccggaccgaggtcggtccgcccgtaacgaaccgaggaaccggaccaagtacggaaaccgaacccgtaaaggaccgtacggtaccgtaagggttcggttacggaacggaccccgtaacccggtgggaacggtaccggtccggtaccgggtcccgtaccgggaccccgngggaacccgacggcccggtcccggttcccggccccgtggtccggtcggtcggttcggccggtttaacgggtccgaaccggtccgttccgggtcccgtaccggtaacccggtcggtcccggtaacccgttacggcccggttacggacccgtaacccgttaggtcccggtaaccgaccggtaccggaaccggaccggtacccgggacctacgggtccgtacggccgtaccgaacggttacgggacggaccgtaccgggacctaacccgggtacgtaccgaccgggtccgtaacgggtcccgtacggggtaccgttaccggggccgggtacggtaccggaacccgggacccgtaaccccgggaacccgtaccccgaaacccggtcttaaacccggcgtttacccccggtcccgttccccccggttaaccccg

SEQ ID NO: 249743 - DNA, 848 bp, Homo sapiens
  misc_feature: GYAE6OF01EYWBN.13.4.A04.1.454.CMB.1.raw
  modified_base (704)..(704): a, c, t, g, unknown or other
  misc_feature (704)..(704): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccgaggggagaggacaggagaccaatggacgtggggtgtactgtaacagccctgctggcgaggagggaccaggggcaccgtccgtaccgaggggacgcccatcgctcgacgaacggtccgggccgaggacgggtccgcccccgtaggaacccgttaggaacggacccgtaaagtacgaacggaaccccaaaggaccgaacgggacccgtaaagggtcggggtttaggtacggtaaccggaacccccggtgggaacggggacggtccgggttaccggggtcccccggttcgggttaccccggagggacccggaaggcccggtcccgttccgggtcccccgtggccgttcggccgtcggtccggttcggggtcttacggggccgttacggtccgggtcccgtacccggacggttcccgggcccgtcggtcccgtaccggccccggtacccgtacggttcgggtacccgaccggtaacccgggacggaaaccgggacccgggacccgaccgggtacccgtcggaccgtcccgtaacgtcgggtagacgtaccgacgccggaacnccgtaacggtccgtagggtaccggtacggtcggtagggtcccggggagtacccggggtacgaaccccggtccccggaaaccccgggtacccaaacccccgtacgtcccgtaaccctaccgttccccgtcccgttaacccccccg

SEQ ID NO: 249744 - DNA, 876 bp, Homo sapiens
  misc_feature: GYAE6OF01EZ11C.13.4.A04.1.454.CMB.1.raw
tcagtcacgtactacacgaccggtgctcgatttagagtagtgatcagggggcagttggtagatgcccctctgggagagatccccgaggggtgacagccatggaccctggaagggcctgggctagggacagggaccagacgccagtccagggagaggacagagccaatggacgtggggtgtactgtaacagccctgcgtggcgaggacgggaccgacggggccacccggtcctaccggagggacgcccatcgctacggacaacggtccgggaccaggacgggtccggcccccgtagaaaccgtaggaaacgggacctaagtcggaaacgaacccgaaacggaacgaacgggaccgtaagggtggggttaggttacggaaccgaccccggttaggacgggaacggtcggtcggggcccttacgggtcccgaggacgacggcgccgtccggcccctgccgtcgtccgtcggcggtcgggtcgtaccggtccgtacggtcgggacccgtacccggtgttccgggtcccgttcggtccgtccgtacccggtaacccgtacgggttccgggttacccgacccggtaaccggtaccgggaaaacccggggacccggggtaaacccgaacccgggtacccgttccggggacccgttcccggtaacggtacggggtaacggtaccggaccgtaccggacccgtaccgtaaccggtaccggcccgtacgggacccggtcgggcccggttacggggtaccggggacccggtaccggttacccgggaacccggtaacccccgggacccgggtaaaccccccaacccccggttaccgtcccgtaaccccgttaccccggttccccggttcccccgtttacccccccggg

SEQ ID NO: 249745 - DNA, 797 bp, Homo sapiens
  misc_feature: GYAE6OF01AQJ39.13.4.A04.1.454.CMB.1.raw
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (241)..(241): a, c, t, g, unknown or other
  misc_feature (241)..(241): n is a, c, g, or t
  modified_base (347)..(347): a, c, t, g, unknown or other
  misc_feature (347)..(347): n is a, c, g, or t
tcagtcacgtactacacgaccggtgctcgatttagagtagtgatcagggggcagttggtagatgcccctctgggagagactccccgaggggtgacagccatcggaccctggaagggcctgggctagggacagggaccagagccagtccgagggagaggacagagccaagtggacgtggggtntactgtaacncgccctgctggcgaggacgggaccagggccaccgtccgtccgagggacncccatcgctgacaaggtccggaccaggacggttccgcccctacggaccgtaggaacgccaagcgaacgaccaagacgacggacgtaggtggttagcgaccgaccgnggacggagccggtcgggccctcggtcccgaggcgcgccgcgtccggcccgtgccgtcgcgtcggcgtcgggtcgtcggcgtcggtcgtccgccgtcgtcggtccgtcgtccggtccgtacccgtaccgtaggttccgttaccgaacccgaacccggaaccgggtaaccccgggacccgggtaacccgacccgggtacccgtacgggacccctcggtaaccggttaccgggtacggaccgaaccggtacccggtacccgtaaccgtcccggtaaccggtccggtccgggtaacccggtccggggttccggtaccgggggtaccggggtacccggtacgggtaacccccggaacccgggtaacccccggaaaccccggtaaccccccgtaacccgtacccgttaacccggtccccttaccccggttacccggttccccccttaaccccccgg

SEQ ID NO: 249746 - DNA, 876 bp, Homo sapiens
  misc_feature: GYAE6OF01AVRSS.13.4.A04.1.454.CMB.1.raw
  modified_base (176)..(176): a, c, t, g, unknown or other
  misc_feature (176)..(176): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggccagggcaccgtcctccgagggcgcccatggctgacaaggtccgggccaggacggtcgcccctagaacccgtggaacggccaatcgaacgaacccgaacgaaccgacggacccgtaaaggttgggttcgtacggacgtacccccgtaggacggacgtccggtcgggtccccgttcgggtaccccgaggaccgtacggtcccggtcccggttcggtccccccggttcggtccgtttccggccgttcgggtcccggtttcggggtcccgttaccggacccgttagggttcccgggttcccgtccccggtaacggttccggtcccgttgggtcccgtccggacccgtaccccggttaacggttcgggtttaccggacccggaacccggtaccggaaacccggggtacccggggaacccccgaacgggtaccccggtacgggtacccgtcccgttacggtacggttacggaacgtaccggaccggtacccgaccgttaccgaccggtacccggtaccgggaccggtacccggtccggttacggggtaccgggtacccgtacgggttaccccggacccgggtaaccccggtaaccccggaacccccggtaacccccgttacgttaccccgtaccccgttaacccttcccgggtttaccccccgtttaacccccccgg

SEQ ID NO: 249747 - DNA, 774 bp, Homo sapiens
  misc_feature: GYAE6OF01D3HLQ.13.4.A04.1.454.CMB.1.raw
  modified_base (523)..(523): a, c, t, g, unknown or other
  misc_feature (523)..(523): n is a, c, g, or t
tcagtcacgtactacacgaccggtgctcgatttagagtagtgatcgagggggagtcagtcccaaccaggacacagcatggacatgagggtccctgctcagctccgtggggctcctgctgctcgtcggctctcgaggtcgccagtatgtacgactactaccgagtactacgaccctagtcctacctacctccccttcccttggtctcgactacttacggtaggtaaggacgacgacggtaacctccaacctactacctacgttccggaccgacgggacgtacgtacgaacgtaacttaaacttaaactaacgttttaaatttaagttcggtaactaccgaagaacctaaaacggtaaaccgtaacggtaaaaccccgtccccgtaacgtccgtaccgtagtaactaccgtacgtagtaccgtactaacgttaacgttaacggtaacgggaaccggtaccggtactagtacgtacggtagaggtaggtagtgtagtacggagtatacgtttcttactactactancgacgcaccgtcagaccgagtacgtaagtaactgttacgtacaacttaacttacttacgttacgacgtaccgagtttaactaagttaacgacgtttaaccgtacccttaccggtacctacccggttaaccggtaccgtaccggggtaaaccctaaccgggaacggttaaacccggttaaggtaacggtaaaccttaaaacggtttacgacgggtttccgtaacgtacgacccttaacgtgggtttaacccc

SEQ ID NO: 249748 - DNA, 680 bp, Homo sapiens
  misc_feature: GYAE6OF01E2U4X.13.4.A04.1.454.CMB.1.raw
  modified_base (177)..(177): a, c, t, g, unknown or other
  misc_feature (177)..(177): n is a, c, g, or t
tcagtcacgtactacacgaccggtgctcgatttagagtagtgatcagggggcagttggtagatgcccctctgggagagatccccagggggtgacagccatggaccctggaagggcctgggctagggacagggaccagagccagtccagggagaggacagagccaatggactggggtntactgtaacagccctgactggcgaggacgggaccagggccaccgtcctccgagggacgcccatcgctgcaaggtccgggaccaggacggtcgcccctagaaccgtgaacggccaatcgacgacccaagacaggaccaggtgggtgtcgacgaccccgtgacggagcgtcgggcctcggtcccaggcacggcgctcggccctgctcgctgtccgtcgggtcgtcggccgtagtccggtccgtcccgtagtcggaccgttcgacgtcggacccggacctaaggttcggttacccgaccgaaccggacgaaaccgggacccgggtaaccgaccggtaccgtcggacctccgtacgtaggtacgaacgtacgacgccgactaccgacgtccgagaccggcgtcggtcgggtacgggaccgtcggtaccgaaccggaccccgtaaaccgggacccccaaaccccgtacgtacctacccgccttcccggttccccgtttacccccccgg

SEQ ID NO: 249749 - DNA, 698 bp, Homo sapiens
  misc_feature: GYAE6OF01ALMRE.13.4.A04.1.454.CMB.1.raw
  modified_base (124)..(124): a, c, t, g, unknown or other
  misc_feature (124)..(124): n is a, c, g, or t
  modified_base (138)..(138): a, c, t, g, unknown or other
  misc_feature (138)..(138): n is a, c, g, or t
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
tcagtcacgtactacacgaccggtgctcgatttagagtagtgatcagggggcaggagtcagtcccaaccaggacacagcatggacatgagggtccctgctcagctccgtgggctcctgctgctntggctctcaggtcnccagatgtgacatccagatcgaacccngtcctcactccctcctgtctagctatcgtagtagganacagntccacctatcactgccaggcgatcgagtacaataactaagttatttaagtgtacttacagacaacgaaaccgaaggttaaccgacccgtaagccttaccgtagaccttacgtacgtagactaccgtaacttaaccgtagtttaacgggaacgtaccggtaccctagttacgtaacggttctaagggtacggtaagtacgggtacgttcggtacggtaacttaagtttactttaccttacgactatacagtccacgtcctacggtacacgtacgtagtaacttacgttagtacgaactacgttacgttacttaaccgtcgtaacgtacgtaattaacgttaacttacggtaaacttaccgttcccgtaaccgttaaccgtaccgttaaccccggttaacggaaccggtaaacggtacccgtaaaccggttggaaacggttaacttaaacggttaaacccggtcgttaaacgggctaacccgttacgaacccg

SEQ ID NO: 249750 - DNA, 660 bp, Homo sapiens
  misc_feature: GYAE6OF01DXRZB.13.4.A04.1.454.CMB.1.raw
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
tcagtcacgtactacacgaccggtgctcgatttagagtagtgatcagggggcagttggtagatgcccctctgggagagatccccaggggtgacagccatggacctggaagggctgggctagggacagggaccagagccagtccgagggagaggacagagccaatggacgtggggtgtactgtaacacgccctgctggcgaggacgggaccaggggccaccgtcctccgagggacgcccatgctgcagtcggcagaggtcgccctgaactgacggacaagtgacgaccaagacaggccaaggtggtgtgacgaccgtgaggngcgtcgggcctcggccaggcacgcncgcgcccngctcgctgcgtgggtctcggcctcgtcggtcccnccgacgtcggcctggaccgtccggaccgtccgtaaggttccggtacggccgtaacccggaaccgaacgggacccggggtaacccgaccggtaccgtcgggacgtccgtcggtaacggttacggaacgtcgacggccgtacgtaccgaccgtccggtacggtacggaccgtcggtcggggtcgggtaccggtacggcccgaaccggtacccgaaaccggtaccccaaaccccggtcgtaacctccgtaaccctcggttcccccggttaccccg

SEQ ID NO: 249751 - DNA, 745 bp, Homo sapiens
  misc_feature: GYAE6OF01DQSE1.13.4.A04.1.454.CMB.1.raw
tcagtcacgtactacacgaccggtgctcgatttagagtagtgatcagggggcaggagtcagtcccaaccaggacacagcatggacatgagggtccctgctcagctccgtggggctcctgctgctctggctctcgaggtcgccagtatggtacgactactccagtactccgaccctagtcctaccacttccctcctgtctgctacgttcgtaggaggacacgagtacgaccaacctacttacctacgtcgaccggaggcgtacgtacgaacggtaactaacgttaaactaaactttaaagttttaaacgttacggttaactacgaacgtaccgaaacggaaaaccggtaacggtaaacccgtaccccgtaacgtaccgttaccgtacgaacgttaccgtacgtacgacgtactacgtaacgttaacgtaacggaaccggtacgggtacctaagtaccggtaaggtacgtaggtacgggtagtacggtacgttacggtacgtacgttaagtttacctttttaacctacctaacgtacgtacctagtaccgtacgtaccgtacgtacgacgtacgttaagaacgttaggttaactacgaaactaacgttacgtttaacgttcttaggtacaaggttactaagtagttaactacgttaacctccgtaaccgtacttaccggtacccgtaggacccggtacgtaacgacgtacgacgttaagtaacgtaacgtgtacgacgtcgctacgg

SEQ ID NO: 249752 - DNA, 706 bp, Homo sapiens
  misc_feature: GYAE6OF01A5N2N.13.4.A04.1.454.CMB.1.raw
  modified_base (698)..(698): a, c, t, g, unknown or other
  misc_feature (698)..(698): n is a, c, g, or t
tcagtcacgtactacacgaccggtgctcgatttagagtagtgatcaggggggagtcagtcccaaccaggacacagcatggacatgagggtccctgctcagctcctggggctcctgctgctctggctctcaggtgccagatgtgacatccagatgacccagtctccactcctcctgtctgcatcgtaggtaggacgacagacgtaccacctatcctacgttcgcccgagggcgacggttacaggtaactaattaactaactttaagttttaaacgtttgggtaattccgaacgaccaaacggaaaaccgtaacgggtaaaccgacccccgttaaacgccttacccgtagtacgtaccgtaacgacgttacgactaactttacctaaggtttaacgggaaaaccggtcggggtaccccaagttacgtaacggttacgagggtaaggtaggtacggtagtcggtacggggtaactaacgtttaactttttaccttaccgactactcgaacgtcaacgtctacgcacgggtactagaacttagtacttacgacttaagtactttagttaactcgtagtacgtactagtattacgtaacttacgtaccctaccgtacttaccgacccggtacggtaacccggtaagggaccgtcggaaggtaacgggtataaaccgttacgacgttcggtacgctccgtaacnccgttacg

SEQ ID NO: 249753 - DNA, 695 bp, Homo sapiens
  misc_feature: GYAE6OF01CQ3TE.13.4.A04.1.454.CMB.1.raw
  modified_base (134)..(134): a, c, t, g, unknown or other
  misc_feature (134)..(134): n is a, c, g, or t
  modified_base (146)..(146): a, c, t, g, unknown or other
  misc_feature (146)..(146): n is a, c, g, or t
  modified_base (191)..(191): a, c, t, g, unknown or other
  misc_feature (191)..(191): n is a, c, g, or t
  modified_base (439)..(439): a, c, t, g, unknown or other
  misc_feature (439)..(439): n is a, c, g, or t
tcagtcacgtactacacgaccggtgctcgatttagagtagtgatcagggggagtcacgtcccaaccaggacacagcatggacatgagggtcctgctcagctcctggggctcctgctgctctggctctcaggtcnccagatgtgacntccagatgacccagtctccatcctccctgtctgcatctgtagganacagacgtcactatcacttgaccgtaggctagtcaggactaattaactaacttaatttaacgttaggtactacgaagtacaacggaaaaccgtaagggtaaaccgaccccctaaggtacccttccgtagtactacgtaacgatacgactactaccgtaagtttacggaaacgtcgggtaccagtcgtaaggttcagtaggaagtgagtcggaggtactagttactttaccttacactagtacagtacncgtaccttcgaccgtacgtccgtaagaacgtacttataccgtaactaaacgtacttaacttacgtacgttaccaagttactacgttaacggtaacttaacgttaaccggtccctttaacccggtacttaaccccgtaccgggttacccggtaaaccggaaacgggtaccctacggggttaagtaccgggtaaaaccgttaaacgttaaaaccgtcgtacgggttaacggccctaaccgacggttaaaccctccggg

SEQ ID NO: 249754 - DNA, 725 bp, Homo sapiens
  misc_feature: GYAE6OF01B71HF.13.4.A04.1.454.CMB.1.raw
  modified_base (585)..(585): a, c, t, g, unknown or other
  misc_feature (585)..(585): n is a, c, g, or t
  modified_base (717)..(717): a, c, t, g, unknown or other
  misc_feature (717)..(717): n is a, c, g, or t
tcagtcacgtactacacgaccggtgctcgatttagagtagtgatcagggggcaggagtcagtcccaaccaggacacagcatggacatgagggtccctgctcagctccgtgggctcctgctgctctggctctcaggtgccagatgtgacatccagatcgacccagtcctacctactccctccctgtctcgctatcgtagtaggacgacaggactacacctactacgtacttcggaccgaggacgtaggtacgaaggaactaactttaaacctaaactttaagtttaaacgtttacggttaactacaaggaaccgtaacggaaaacccgtaaccgggtaaaccgaccccgtaacgtcccttaccgtagtacctacgtacgtataccggtactaactacctttaaacgggttaacgaaacgggtccggtacctagttacgtaacgttacggtagtagggtaaggtggagttcggtaggaccttaagtttactttttaccgttaactaccgtaacttccgaagtaccgtacggtcacggtaccgtaacgtccgtaaacgtaagtacgttaacgttacgaactaacgttnttaacttacgtcgtacgaagtacctagggttaatacgtaacttacgtaccctacgtaccgtaccgtaccggttaccgacgtaacggaactacggtacgaacgtaacggtaaacgtatacggtaccgtacggntaccgtac

SEQ ID NO: 249755 - DNA, 768 bp, Homo sapiens
  misc_feature: GYAE6OF01E3C9Z.13.4.A04.1.454.CMB.1.raw
  modified_base (188)..(188): a, c, t, g, unknown or other
  misc_feature (188)..(188): n is a, c, g, or t
  modified_base (292)..(292): a, c, t, g, unknown or other
  misc_feature (292)..(292): n is a, c, g, or t
tcagtcacgtactacacgaccggtgctcgatttagagtagtgatcagggggcagttggtagatgcccctctgggagagatccccgaggggtgacagccatggaccctggaaggcctgggctagggacagggaccagagccagtccagggagaggacagagccaagtggacgtggggtgtactgtaacngcctgcgtggcgagacggaccagggccaccgtccgtccgagggacgcccagtcgctcgacgaacggtccgggaccgaggacggtccgacccctagtaaacccgnggaacggccaaagtcggaacgaacccgaaacggaaccgtacggaccgtaaggtgggttagtccggacgaccccgtgacgggagccggtcgggcccgtcggtacccgaggcgacgccgcgtccggcccgtgcgtcgccgtggtccgtcgggtccgtacggccgtcgtaccggtcccgaccgtcgtccggtcccgtacggtccgtcccggtacccgtacccggtaacgtttcgggttacccgacccgtaacccgggaccggaaacccggggtaccccggggtaacccgtaacccgggtacccggtaccggaacccgttccgtaaccggtacggttacggacgaccgtaccgaccgtacgtccgccgtacggtcggaccggccgtcggtcggacgggtacgaccggtcgaacccggtacccgaacccggacccctaaccccgtactccggtaccctacgttcccgttcccgtacccccg

SEQ ID NO: 249756 - DNA, 557 bp, Homo sapiens
  misc_feature: GYAE6OF01EBNUX.13.4.A04.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (344)..(344): a, c, t, g, unknown or other
  misc_feature (344)..(344): n is a, c, g, or t
  modified_base (423)..(423): a, c, t, g, unknown or other
  misc_feature (423)..(423): n is a, c, g, or t
tcagtcacgtactacacgaccggtgctcgatttagagtagtgatcagggggcaggagtcagtccccaaccaggacacagcatggacatgagggtccctgctcagctccgtggggcctcctgctgctctggctctcgaggtgccagatgtgacatccagatcgacccagtcctccactccctccctgtcctgcntcgtgtaggnacagacgtccaccatcaccgttcgccgaggcgagcaagaactaacttaactaacgtaatttaaattagtatacagacgaacgaaaccgtaaggtaaccgcctacgcctacctgactacgtacgtactcgtactactacaantttaggggtaaaaccagggggttccccaagttcaaaggttcgagtgggaagtggtagtactgggactagatttaccttntaccatcagctagcctgcagactgaagtatatacgacaactatatactgtacagtacagtatagtaactactcttcccgactccaccgtcgaccgaaggacacgacgtagacgtaactaacgaatcgtgcgtcg

SEQ ID NO: 249757 - DNA, 850 bp, Homo sapiens
  misc_feature: GYAE6OF01A4ON4.13.4.A04.1.454.CMB.1.raw
  modified_base (428)..(428): a, c, t, g, unknown or other
  misc_feature (428)..(428): n is a, c, g, or t
tcagtcacgtactacacgaccggtgctcgatttagagtagtgatcaggggggcaggagtcagtcccaaccaggacacagcatggacatggagggtccctgctcacgctccgtggggctcctgctgctcgtggctactgaggtcgccagtatggtacgactactccgagtacgttaccgaccctacgttcctacctaccttcccgttcccgttcgttccggtgtaccttacgttacggttacgggtaagggaacgaaccgtacggacctaccgtaacctacttcctacggttcgaccggaggacgtacgacgaacgtaactaacttaaactaaagttttacttaaagttgtacgtacgaacaacggtaacgtaaaaccgaacgggtaaaccctacccgtaacgtccgttaacggtactacgtacggtanacgttacgaccttaacgttacgtaaggttaaccgggaacggtaccggtaccttaagtaccgggttaactcgggtaagggtaagtaggaacgttaggacccgggttaggtaaccttaattttccgtttaaaccgacctaaacgttcgtaacgacgtaccgtaccggtctacggacgtaacgtaccgaaggttaagttacgtagttaccgtaactaaaggtttaacttacggttacgtacggttaacgtacgttacgtagttaaccgtaactaacttaccggtaccctaaacccgtccgggtttaacccgtaaccggttaccggaaacccggtttaaacgggacccggttaaacggttaacgaacgggttaaaaccgtaaccggttaaacggcggttaacgggtacctaccgttaacgtaaccg

SEQ ID NO: 249758 - DNA, 801 bp, Homo sapiens
  misc_feature: GYAE6OF01B2O49.13.4.A04.1.454.CMB.1.raw
tcagtcacgtactacacgaccggtgctcgatttagagtagtgatcaggggggagtcagtcccaaccaggacacagcatggacatgagggtccctgctcagctcctggggctcctgctgctctggctctcaggtgccagatgtgacatccagatcgacccagtcctccactccctccctgtctgctatcgtgtaggacgacagacgtccaccatctacgttcgacccgagggcgtaggtacgacggtactaacttaaacctaactttaagttttaaagttggttactacgaacgacgaaacgaaaccggtaacggtaaaacccgaccccgtaacggtccttaccggtagtaacttaccgtacggtactacggacctaacttaacccgttaaaggttttaaccgggaaaccgggtaccggggttaacccagttaacggtaacggtttacggaagggttacgggtaacgggtaggtaacgtcgggttagggtaacttaggttttaaccgttttacccttaccacgtatccgaacgtaccgtacgtccgtacgaccggtacgtacgtaaggtaacgtattacggtacaactaacttagttacttaccgtagaccgacggttagttaaacgttggtaaacttaacgttaccctaccggttacccgttaaccgtacccgtttacccgggtcccgtaaaaccgggaaccgggtaaccgtaacgggtacgttaacggggtaaacctttaaaaccggtaaaccggttcgggtaacgtaccggtaccgtaccctaacggttacccttacgg

SEQ ID NO: 249759 - DNA, 884 bp, Homo sapiens
  misc_feature: GYAE6OF01BXK22.13.4.A04.1.454.CMB.1.raw
tcagtcacgtactacacgaccggtgctcgatttagagtagtgatcagggggcaggagtcagtcccaaccaggacacagcatggacatgagggtccctgctcagctccgtggggctcctgctgctctggctctcagggtgccagatgtgacatccagatcgacccagttcctcctacttcccttccctgtcctgctattcgtggtaggagacagtacgtacacctatctacgttcgccgaggcgagtcgacggactaacttaaactaaatttaagttttaaacgttggtaactacgaacgactaaacgtaaaacccgtaaacggtaaacccgtacccccgtaacgtcccttaccgtacgtaaccttacgtaacgtactacgacctaacgttaaccgttaaaggtttaaccgggaaacccggtacgggtaccctaacgtaaccggtaagggttacgaggttaggtaaggtcggtacgtacgggttaggtaactttaagtttacctttttaaccgttacaaccgttacgtaccgtacgtaccgtaccggtcctacggaccgttaacgtaccgttaagtaacgttacttaacgttaacccgaaactttaaacgttaacttttaaccgttaaccgtttacgggaaccttaagggttaaccgtttaaggttaacgttaacgttaaacccttttaccccgttacccgtttaacccccgtaaagtttccccccggtttaaacccggttaaaccccggggaaaccgggtaaaccggggtaaccccgttaaccgggggttaaacgttaaacggggttaaaaccggttaaacccgggtttaaaaacccggttacggttacggggttcccggtaaacccgttccgtaaacccccgg

SEQ ID NO: 249760 - DNA, 689 bp, Homo sapiens
  misc_feature: GYAE6OF01CL0AC.13.4.A04.1.454.CMB.1.raw
  modified_base (544)..(544): a, c, t, g, unknown or other
  misc_feature (544)..(544): n is a, c, g, or t
  modified_base (672)..(672): a, c, t, g, unknown or other
  misc_feature (672)..(672): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacatccagatcgacccagtctccatccctcctgtctgctatcgtgtaggagaacgagagtccactatacctagttcgccagggcgagtacgaggtactaaacttaaacgtaaacttaattttaaaagttggtaacttcgaagaacgaaacggtaaaacccgtaagggtaaacccacccccgtaagtcccttaccctaggtaacctacttaacggactacgtcctaaacttaccgttaaacgggttttaccggaaaaccggtaccgggtaccctaagttacgtaaacgggtttacgaaggtaggtaacggttggaagttccggtaggaactagtttactttacgtacgtacacgtccaggtctacgacctgaccgtaacgcgtaaagagtattacgttanactaacctatttaacgcttacgtagacgtagtaacttagtactaaacttacgtcctaaccgtctaacccgtaccggttaccgaacggtaacggagtaaccgtgtaacggtaataaagtaacgtaacgnggtcgtacgtccgtacg

SEQ ID NO: 249761 - DNA, 684 bp, Homo sapiens
  misc_feature: GYAE6OF01BBO0H.13.4.A04.1.454.CMB.1.raw
  modified_base (204)..(204): a, c, t, g, unknown or other
  misc_feature (204)..(204): n is a, c, g, or t
  modified_base (590)..(590): a, c, t, g, unknown or other
  misc_feature (590)..(590): n is a, c, g, or t
tcagtcacgtactacacgaccggtgctcgatttagagtagtgatcaggggggagtcagtcccaaccaggacacagcatggacatgagggtccctgctcagctcctggggctcctgctgctctggctctcgaggtcgccagatgtagacatccagactcgaccctagtcctccactccctccctgtctagctatcgtagtagganacagactcaccatcacgttcgccgaggcgagtacgaggtaactaattaaactaacttaatttaaagtggtaactcgaacgaacgtaacggtaaaaccgtaacggtaaaccgtaccccttaaagtcctacgtagtacttacgtaacgtatacgactactacgtaaagttaacggaaacgtacgggtaccagtacggtaagtacgtagggtaggtaacgtaggtacgttacgtacgggtaacttaacggtttactttttaccgtaaccactacgtaccgacgtacgtacgtccgtaggactacggtactaacggtaatacgttacgtaccgaactaagtattactacgtagtacagtactatacgataacctacgtacctaccggtanacccgtaccgtacgggaaccaacggtaccgacgttaacggtagtaaaacgttaacgtaaacgacggtacggtacgtacgctaactaccgttacg

SEQ ID NO: 249762 - DNA, 726 bp, Homo sapiens
  misc_feature: GYAE6OF01AEGSI.13.4.A04.1.454.CMB.1.raw
  modified_base (563)..(563): a, c, t, g, unknown or other
  misc_feature (563)..(563): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacactccagatcgacccagtcctccactcctccctgtctgcatctgtaggagacgagacgtccacactctacttcgccgaggcgtacgtacgaaggactaattaaacaacttaattttaaattggtatacagacaacgaaaccgaaggtaaaccgtcccctaaggtcctaccgtagtaacttccgtaacgtatacgacctacttaccctaaaggtttagggaaaaccggacgggggtacccctaaggttaccgtaaacgggtttccgaagggttacgggtaaaggtacggtaacttcggtacggggtaaacgttaaggtttacttttttaacttttaccgaaccctattcacggactacggtccgttacgacgtaacgtacccgtaaggtaagtactttagtacgtaacctaaactntttaacgtttacctcggtaactacggacgttaaggtacttagtaacttaacctacccgtacccgtaactcccgtacccgttacccgggaaccgtaaccgggtacccaacgggtactacgggaaacttaacgttaaacgacgttaggcgtaccgtcgtaacccg

SEQ ID NO: 249763 - DNA, 725 bp, Homo sapiens
  misc_feature: GYAE6OF01D9K81.13.4.A04.1.454.CMB.1.raw
  modified_base (202)..(202): a, c, t, g, unknown or other
  misc_feature (202)..(202): n is a, c, g, or t
  modified_base (520)..(520): a, c, t, g, unknown or other
  misc_feature (520)..(520): n is a, c, g, or t
  modified_base (551)..(551): a, c, t, g, unknown or other
  misc_feature (551)..(551): n is a, c, g, or t
  modified_base (628)..(628): a, c, t, g, unknown or other
  misc_feature (628)..(628): n is a, c, g, or t
  modified_base (691)..(691): a, c, t, g, unknown or other
  misc_feature (691)..(691): n is a, c, g, or t
  modified_base (714)..(714): a, c, t, g, unknown or other
  misc_feature (714)..(714): n is a, c, g, or t
  modified_base (720)..(720): a, c, t, g, unknown or other
  misc_feature (720)..(720): n is a, c, g, or t
tcagtcacgtactacacgaccggtgctcgatttagagtagtgatcgaggggggagtcagtcccaaccaggacacagcataaggacatgacgggtccctgctcagcctccgtgggctcctgctgctcgtcgctctcgaggtcgccagtagtggtagacactaccgagtactcgacccagttcctcctactcccttcctagtcngtctagtcgtaggtacggacacgaggtactaccaacctacgtcctaacgttcggaccggacggtacgtacgttaccgaagtaacctttaaaactttaaaccttaaacgttttaaaacgtttttaaaagttacggttaacctacccggaaagtaaccgtaaaacggtaaaacccggtaaaccggtaaacccaccccgttaacgcccgttacgtacgtaaccgttaccgtaacggtagtaccgtacctacgtttaacgtaaacggttaacggaaccggttaccgggtactacgtaacggtacgtacgtaggtaggtacgngttacgacgtagtacttattactttacctanaccgtacgtacgatacccgtcgacgtcgtacgacggtataggtatactctaagactataatactcgtagtacgtaancgttagacacgtaccttcgacctcgactaaccgcgtaccgactaaccggatacgtacggttanaacgttacacggtgtcgtcgaanacgtcngttcg

SEQ ID NO: 249764 - DNA, 749 bp, Homo sapiens
  misc_feature: GYAE6OF01E3KJI.13.4.A04.1.454.CMB.1.raw
  modified_base (138)..(138): a, c, t, g, unknown or other
  misc_feature (138)..(138): n is a, c, g, or t
tcagtcacgtactacacgaccggtgctcgatttagagtagtgatcgagggggcaggacgtcagtcccaaccaggacacagcatggacatgagggtccctgctcagctcctgggctcctgctgctctggctctcaggtnccagatcgtgacagtccagatcgacccagtcctccactcctccctgtctgctatcgtagtacggagacagactcactactctacttcgaccgaggtacgtagtaccgaacggtaacctaaactttaaacctaaacttttaagtttaaaagttggtactacgaacgaacgaaacggaaaaccgtaaacggtaaacccgtaccccgtaaacgtccttaccgtagtacctacgtaacgtactacgtaacctaccttaaccgttaaacgtaaccggtaaccggtaccggtacctaacgtaacgtaacggtacgtaggtaacggttaggtacgttacgtacggtacgtaaccgtttaacttttacctttaaccctaaccgtacgtactacgacgttaccgacgttcacgtaacgcgtacgaagtaacgtactacgtacaacttaatacgtttacgtactacggttaccgaacgtaacgttagtaacgttaaacgtaccttacccgttaccgtaccccgttactacccccgggtaaccgtaaccggaaccggttacgaacccggtacggtaacgtaagtaaccgttaaacgaacggtacgtcgaccgttgacctacg

SEQ ID NO: 249765 - DNA, 694 bp, Homo sapiens
  misc_feature: GYAE6OF01C1F48.13.4.A04.1.454.CMB.1.raw
  modified_base (178)..(178): a, c, t, g, unknown or other
  misc_feature (178)..(178): n is a, c, g, or t
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (500)..(500): a, c, t, g, unknown or other
  misc_feature (500)..(500): n is a, c, g, or t
  modified_base (606)..(606): a, c, t, g, unknown or other
  misc_feature (606)..(606): n is a, c, g, or t
tcagtcacgtactacacgaccggtgctcgatttagagtagtgatcagggggcagttggtagatgcccctctgggagagatccccgaggggtgacagccatcggaccctggaagggcctgggctaggacagggaccagagcagtccagggagaggacagagccaagtggacgtggggtntacgtgtaaacngccctgctggcgagacgggacagggccaccgtccnccgagggacncccatcgctcgacgtaacggtcggccgagaggtccgccctagaacctagaacggccaagtcgaaacgacccgaaagaaccgaggccgtaaagggttcggggttggaccgggtaccccgtaggacggtacggtccggtacgggtccccgtcggtaccccgaggcgacggccgccgttccgggcccctggtccgtacggtccgttcggtccgttacggggttccgacggtccggtacggttcggcccgtacccgaggttccggtccncggtccgtccggcgtacccgtagtcggttaccgaccgtaccgtacggaaccggcggacccgtacgacccgtgacccgctcggacgtacgagccacggacctgtccncgtccgcgcggacgcgtcgggacggtcgacggtcgaccggtacccacgccccgaaaccgtctccgactccctctccctccccgtaccg

SEQ ID NO: 249766 - DNA, 773 bp, Homo sapiens
  misc_feature: GYAE6OF01E04T0.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctagtaaggagacagactcaccatcacttgccaggcgagtcaaggactaattaaaaccaaactttaattttaaaagtggtaatacgtaacgacgaaacgaaaacgaacggtaaacccaccccgtaaagtccttacccgtagacttaccgtaacgtatacgactaactaccgtaaaagtttacgggaaaaccgtacggggtaccctaagtaccggtaaacggttcgtaaaggttagggaaacgttgggtaacgttacggtaacgggtaaccttaaaggtttaacttttttaaccgttaccaaccgtaagttaccgaacgtaccgtaacgtcgttacgactaacgtacgttaacggaattagttaacgttacgaacctaaacgttaacgttaacttttaacgacggttactaaacgtacgttaacgttaagttgttaaacgttaaccttacccgtaaccccggtactaacccggttacccgttaacccggggaaacccgaaaaccggggttacaaacccggtacgttacgggtaaaactaaaccggtttaaaaccggacgtttagggtaccgtaccggtcctaaaacccg

SEQ ID NO: 249767 - DNA, 772 bp, Homo sapiens
  misc_feature: GYAE6OF01CBCKW.13.4.A04.1.454.CMB.1.raw
tcagtcacgtactacacgaccggtgctcgatttagagtagtgatcgagggggcaggagtcagtcccaaccaggacacagcatggacatggagggtccctgctcagctccgtgggctcctgctgctctggctctcaggtcgaccagatgtgacatccagatcgaccctagtctccattcctccctgtctagctatcgtaggtacggagactaggactaccacactctaacgttcgaccgagggacgtagacgaacggaactaactttaaaaccaacttttaaggttttaaaagttggtaactaccgaagaccgaaacgtaaaaccgtaacgggggtaaaacctcccccgtaaagtaccctttaccgtagtaacgttacccgtaaggtaacttcggaccttaaacttaccttaaaggttaacggaaaccggtaccgggtaccaagttaaccgtaaggttacgaggttaggtaaagtcggtaagttcggacgggtaactagttttaacgttttaacctacaacgtaacgtacgaatacgtacgtaccgttagaccggtaactaacccggtaagtaacggtaactttaacgttcggtaaactaacgttaagttaacctttaagtttacggaaccaagttaccggtaaattacggtaacgttaacttaaccgtcctaacccggtacttaccgtaacccgttacgggaaccgtaaacggaccaacggttcggaacgtaaagtaaaccgtaaacgacggttacaggtcccgtagtaacc

SEQ ID NO: 249768 - DNA, 631 bp, Homo sapiens
  misc_feature: GYAE6OF01ACMOG.13.4.A04.1.454.CMB.1.raw
  modified_base (233)..(233): a, c, t, g, unknown or other
  misc_feature (233)..(233): n is a, c, g, or t
  modified_base (404)..(404): a, c, t, g, unknown or other
  misc_feature (404)..(404): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggagggaccagggccaccgtcctccgagggacncccatcgctgcaaggtcgggccaggacggtcgcccctgaacctgaacggccaatgacgacccaagacaggccaaggtgggttgtgacgaccccgtgacggagcgtgggccctggtcccaggcagcgcgtcggccctgctcgctgctcgggtctcggccagtcggtccgccngtcggcctgctcgcgtccgtagtcggtcgccaccgacgaaacgggccgggaacccacgacccgtggcgccgtacgacgttaggacgacgacgccgactccgacgtcctcggcggtacgcgttcgggcgggccgtacgggtccgaacccggtccccggaaacggaccccccgtaaaccccgtaccggttaccgtacccggtacccttccgttcccgttaacccccccg

SEQ ID NO: 249769 - DNA, 664 bp, Homo sapiens
  misc_feature: GYAE6OF01AI1LG.13.4.A04.1.454.CMB.1.raw
  modified_base (176)..(176): a, c, t, g, unknown or other
  misc_feature (176)..(176): n is a, c, g, or t
  modified_base (229)..(229): a, c, t, g, unknown or other
  misc_feature (229)..(229): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagaggaccagggcaccgtcctccgagggacncccatcgctgcaaggtcgggcctaggacggtcgcccctgaacctgaacggccaatgacgaaccaagacaggaccgaaggtgggttgtcggacgaccccgtagaggagcgtcgggtcccgcggtcccgacggcacgtccgcgtcggccctgcctcgcgtcgcgttcggtcgtcggtcgcgtcggtccgccgtagtcggctgcgcgaccaccgagtcggtcgacgaccggacgaacggccgggaaccgacggaccgtcgacctcgtacgacggttacggacgacgtaccggtacgacgtaccgacgtcccggacggccggtacgcgggttcgggacggggacggtaccgggtacccggtaccggaccccgaacccggaccctaaccccgttaccgtaccgtaccctacccgtttacccgttccccggttaccccccg

SEQ ID NO: 249770 - DNA, 737 bp, Homo sapiens
  misc_feature: GYAE6OF01DRKGE.13.4.A04.1.454.CMB.1.raw
  modified_base (79)..(79): a, c, t, g, unknown or other
  misc_feature (79)..(79): n is a, c, g, or t
  modified_base (651)..(651): a, c, t, g, unknown or other
  misc_feature (651)..(651): n is a, c, g, or t
tcagtcacgtactacacgaccggtgctcgatttagagtagtgatcgagggggcagttggtagatgcccctcgtgggganagactccccgaggggtgacagccatcggacccgtgggaagggccgtgggcgtagggacgagggaccagacgccagtccgagggagaggacagagaccaagtggacgtggggtagtactagtaacgcgtccgtgcgtgggacgaggacgggaccgacgggccacccgtccgtaccggagggacgaccgagtcgctaggacgtaacgggccggacgaggacggtccgacccgtagaaccgtacggaacggaccaagtacgaacgaaccgtaagaccgacggacgtaggtcgggtagtacggaccgtaccggaggtacggacggcggtccggaccgtcggccgaggcgacgtccgtcgtccggcctggcgtcgcgtggtcggtcggacgtcgcgtacggtcgccgtccgagtccggctacggcgtaccgcgtaccgtaggtcggtacgaccggaacggtaccggaaccgggacccggaccggacgtacccggtagccggtacggtacgtaggtacggacgtcgaccgtacgaccgtcgacggtaccggacggtcggacggtcggtacgggtcggnggacccggtaccggaacccgacccggtaaccccgacccgtacccgtacgtcccgtaccgcccggtttcccgtcccggttacccccg

SEQ ID NO: 249771 - DNA, 710 bp, Homo sapiens
  misc_feature: GYAE6OF01BRWAQ.13.4.A04.1.454.CMB.1.raw
  modified_base (387)..(387): a, c, t, g, unknown or other
  misc_feature (387)..(387): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtgtactgtaacacgcccgtgctggcgaggacgggaccgaggggccaccgtcctccgagggacgcccatgctcgacgtaacggtccgggccaggaggtccgccccgtaggtaaccgtggaacggacctaagtcgaacgaccacgaacgacgacgacgtaggtggtgacgacccgtaccgtggacggacggtcggtccggtccgtccggaccgnggccgcgccgtccgtccgcctgctcgcgcgtggtcggtcgacgtcgcggtccgccgtcgtcgtcgcgtcgacgtcccgtccgtaacgttcgttccggacgaccggaaccggaacgggtacccgggacccggtacccgaccgtccggtactaccggtacgtaggacgtacggaccgaccgaccggtacccgtccgaccgtcggcgtccgggacggtccgttccggggacggtacgggtcctaaccgggacccgacccggaaccccgaacccgtacccgtacccggtacgttaccccgtcccttcccggtcccgttcccccccgg

SEQ ID NO: 249772 - DNA, 731 bp, Homo sapiens
  misc_feature: GYAE6OF01CY3B9.13.4.A04.1.454.CMB.1.raw
  modified_base (196)..(196): a, c, t, g, unknown or other
  misc_feature (196)..(196): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctcgtgctctcaggtgccagatgtgacatccagatagacccagtctccactccctccctgtctgcatctgtagganacagctacaccatcacttcgccgacggcgacgtcaaggaactaacttaaaactaaacttaattttaaaacgttaggttaattaccgaacgtaaccgaaaacggtaaaacccgtaaacggtaaaacccgtaaccccccgttaaacggtacccgttaccgttacggtaacttaacccgtaacggtactacggaacctaaacttaaccgtaaacgtttaacgggtaaaaccggtaccgggtaaccctagtaaccgtaaacgggttacgaggtaagggtaaggttagtacgtacggtacgggtactaagtttaacttttacgttacgactacttacgactcgacgtcgtacgacgacgtacgtagaacgtaatacgttacgaactaacttaagtaacctttacgtacgttaaccgtaagacgttaaggtactaacgttaactaccttcccgtacctaccgtaccgtaccgttacggaccggtaaagtaccgtacggtaacgtagaacgtaaacgtaacgtacgtgacggtcgtactacg

SEQ ID NO: 249773 - DNA, 747 bp, Homo sapiens
  misc_feature: GYAE6OF01DZ2HU.13.4.A04.1.454.CMB.1.raw
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
tcagtcacgtactacacgaccggtgctcgatttagagtagtgatcagggggcaggttggtagatcgccccctcgtgggagagactccccgaggggtgacagccatcggaccctggaaggccgtgggcctagggacagggaccagacgccagtccgaggggagaggacaggacgccaaagtggacgtggggtntactgtaacacgccctgcgtggcgagagggaccaggccaccgtccnccgagggacnccatgccngcacggcggcagcggtcacccngtaaccgcgacgcaatcgacgaccaagaccgagacgaaggtggtgtacgaccgacccgtggaggacggtcggtccggccgtacgggtcccgaagtccggaggccgtccggtccggacccttcggacgtcggtcgtacggtccggttcgggttccgcggtccgacgtcccgggtccgcccgtaggccggtcgtacgggccgtccggtacccgaccgtaaggttccgggtacgccggaaccggtaacccgggtaaccgggaccccgggaaccgacggtacccgtaccggtaccgtacgtacggtacggttaacgaccgacgtaccggaccgtacgtcccggacggtaccgtcgggtaccggcgtccgggtcgggaccgggtacgtaccgggaccgaaccccggtacccgaacccgtacccccgtaacccgttccgtaacccgacccttcccgtctttccccggttaccccg

SEQ ID NO: 249774 - DNA, 770 bp, Homo sapiens
  misc_feature: GYAE6OF01A6BIW.13.4.A04.1.454.CMB.1.raw
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (600)..(600): a, c, t, g, unknown or other
  misc_feature (600)..(600): n is a, c, g, or t
  modified_base (625)..(625): a, c, t, g, unknown or other
  misc_feature (625)..(625): n is a, c, g, or t
tcagtcacgtactacacgaccggtgctcgatttagagtagtgatcagggggcagttggtagatgcccctctgggagagactcccgagggtgacagccatggacctggaagggcctgggctagggacagggaccagagccaggtccgagggagaggacagagccaagtggacgtggggtntacgtgtaacgngccctgcnggcgaggagggaccagggccaccgtcctacgaggacgccagtcggctgacgaacggtcggaccaggcggtcgaccccgtagaaccgtcggaacgaccaagtacggacgaacccgaagacgacggacgtaggttggggtagtacggacggaccccgtagaggtcggtacgtccgggacccgtcgggtcccgaacgggtcgacggtcccggtccgtaccggtccccgtgacgtcggccggtcggttcgacgggtcgccggtcgacgtccgggtccaccggtgttcccgggccgttggttccgcgtcccggtacctagggttccgttacgacccgtaacgacggaaccgggacccggaccggtaaccggcccgtacggcgtacggttcgaacggtcggtaaccncggtaccgtacccgacgtaacccgngggtccgtaccggcggtaccggtacgggttcgggaccgggtcggttaccggacccgttaaccggaccccccgaaccgggtaacccccttacccgttaaacccgtcgttaccccttacccggtccggtttaaccccccgtccccgg

SEQ ID NO: 249775 - DNA, 822 bp, Homo sapiens
  misc_feature: GYAE6OF01B8LV8.13.4.A04.1.454.CMB.1.raw
  modified_base (252)..(252): a, c, t, g, unknown or other
  misc_feature (252)..(252): n is a, c, g, or t
tcagtcacgtactacacgaccggtgctcgatttagagtagtgatcagggggcagttggtagatgcccctctgggagagatccccaggggtgacagccatcggaccctggaacgggcctgggctagggacagggaccagagccagtccgagggagacggacagacgaccaagtcggacgtgggggtatactcgtaaacacgcccttgcgtggccgaggacgggaccgagggccaccgtccgtccgaggggacncccagtcgcgtgaccgacggtccgggaccgtaggtacgggtccgaccccgtacggaaccgtggaaccggacctaagcgaacgtaacccaacggacgacggaccgtaggttggggttcgacggtaacgccccgtggaaggccgtccggacgggtccccgtacggacccgaggccgacgccggccgtcccggccctcggctcggtctcggtccggtacgggccgtcggacgtcggttccggtcccgccgtacggtccggtcgtacggtccgcgaccgtaccggtaagttcggtaccacccggaccggaacccggaaaccgggaccccgggtaacccgacggtaccccggtacggtacccgacccggtttacgggaacggttaccggaaaccgtcggaccggtaccgtaaccgttaccggaccgttccggaccggtaccgggtcgtttacccggggacggggttccgggaacggtaccggacccggacccgacccggtaaaccccgaccccgaaccccgttacgttacccggtaacccgttcccgttccccgttaccccgtttaaaccccccg

SEQ ID NO: 249776 - DNA, 724 bp, Homo sapiens
  misc_feature: GYAE6OF01ELA23.13.4.A04.1.454.CMB.1.raw
  modified_base (492)..(492): a, c, t, g, unknown or other
  misc_feature (492)..(492): n is a, c, g, or t
  modified_base (607)..(607): a, c, t, g, unknown or other
  misc_feature (607)..(607): n is a, c, g, or t
  modified_base (614)..(614): a, c, t, g, unknown or other
  misc_feature (614)..(614): n is a, c, g, or t
  modified_base (637)..(637): a, c, t, g, unknown or other
  misc_feature (637)..(637): n is a, c, g, or t
tcagtcacgtactacacgaccggtgctcgatttagagtagtgatcagggggagtcagtcccaaccaggacacagcatggacatgagggtccctgctcagctccgtggggctcctgctgctctggtctctcaggtgcagtatgtgactatccagatcgaccctagtcctcctactccctccctgtcctcgctacgtcgttaggaggacgaccgaaggtacctacccaacctattaccgtaccgttcggcccgaagggtccgtaggtacgaacggtaacttaacttaaaacccttaaagttttaatttttaaaaggttcggtaactaccgtaacggtaaccgaaaacgtaaaccgtaaacgggtaaaaccccgtaccccttaacggtacctaccgttacgtaacgttaccgtaacgtactacgacttacttaacgtaaagtttacggaaccgtacgggtaccctagtaccgtaaggttcgaaggtaggtaacgngttagtacggtaggtaacctagtttaccttttaccgtacactacgtacgacgtaccacgtcctagaccgtacggacttaaggaagttacttacgtcaacttaacgatttaacgtntacgtanagtagtagtactacgaattaccnccgtaactcttacccggacgttccgacgaacggtacgacgagtagttaacaaacggtactacgggttaccgacacgacctacgtacg

SEQ ID NO: 249777 - DNA, 767 bp, Homo sapiens
  misc_feature: GYAE6OF01DZMK0.13.4.A04.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (519)..(519): a, c, t, g, unknown or other
  misc_feature (519)..(519): n is a, c, g, or t
  modified_base (677)..(677): a, c, t, g, unknown or other
  misc_feature (677)..(677): n is a, c, g, or t
tcagtcacgtactacacgaccggtgctcgatttagagtagtgatcaggggcagttggtagatgcccctctgggacgagactccccgacgggtgacaagccatcggacctggaacggcctgggacctagggacaggaccagacgtccagtccaggggagaggaccagacgcctaatggactggggtctactgtaacncgccctgacctaggacgaggcgggacccagggtccacccggtcctaccggagggtaccnccctagtgaccgtcgacgtaacggtcccgggacctaaggtcgtcgcccccttagaaccgttacggaacgaccgaacgttaacgaccgacccaaggactacggaccgtaaggtaggtcgttacgacgtaacccgtggacggtacgcggtaccggcccgtacggacccgaagcgaacggtccgacgtccggtacccctgaccggttcgcgtcggtccgtcggtaacgtcggaccgtcggtcgtccgacccgttcgtccgtcgttcncgttaccgccgtaccgtagttccgtgaccgaaccgacggaccggtaacccgggacttaacccggaccggaggtaccgttacgacgggttaacgacggacgaccggaaccgtaccgacgtaccgcgtcccgtacggccgggtacgtccggttaccgggnggttacccgcgggtaaccccgtccgaacccggacccttacccccggaaccctttctaaccggtcttaacccgttccgtacccggttcccc

SEQ ID NO: 249778 - DNA, 1013 bp, Homo sapiens
  misc_feature: GYAE6OF01BFV5H.13.4.A04.1.454.CMB.1.raw
  modified_base (756)..(756): a, c, t, g, unknown or other
  misc_feature (756)..(756): n is a, c, g, or t
tcagtcacgtactacacgaccggtgctcgatttagagtagtgatcagggggcaggagtcagtcccaaccaggacacagcatggacatgagggtccctgctcagctccgtggggctcctgctgctctcggctctcgaggtgccagactgtcgacatccagactcgaacccaagtcctccactcctcccgtgtctcgacgtactcgtagtacggacgaacctagtactccaacctactccgtaaccttcggacccgtaggggaccgacggttaccgaacggaacccttaaacgttaaaacctaaaacttttaacgttttaaaacttacgggttaactaaccgtaaaccggaacgtaaaaccggtaaaacccggtaaaccgggtaaaacccctacccccgtaacggtacccttacccggtaagtaacccgttaccgtaaacggtacttacgaaccttaccgttaaccgtaaacggtttaaacgggaaacccggttccggggtaacccctaacggtaaaccgttaacgggttacgtaacgggtaacgggttaaacggttacggtaccgttacggggtaaccggtaacgtttaaacggttttaaccctttttacccgttaacccgaacccgttacggtaacccgtaaccggttaaccctaacgggttacccccttaggacccgttaacggttaaaccccgtaaaggggtttaaaccgtttaaatttacccggtttaaccggaaactttaaaccccggtttnttttaaaaccggttcccgttaagggaaacccttaacggttaacggtaaaccggtttaaacttacccggttaaaatttaccccgttacccccgggttaacgttaacccttacccccccggggttaaaaggtaccccggggtaaaccgggtaaacccgggaccgttaaaccgggtccgggaaaagggtttaaaacttaaccccgggtttaaaaccgggtcgttttaaacggccccggttaaagtcccccgggtaaaccc

SEQ ID NO: 249779 - DNA, 813 bp, Homo sapiens
  misc_feature: GYAE6OF01AOF4Q.13.4.A04.1.454.CMB.1.raw
  modified_base (577)..(577): a, c, t, g, unknown or other
  misc_feature (577)..(577): n is a, c, g, or t
tcagtcacgtactacacgaccggtgctcgatttagagtagtgatcaggggggagagaggagcccagccctgggtattttcaggtgttttcatttggtgatcaggactgaacagagagaactcacatggattggctgagctggttctttttctgtggtcttaagttttaaaggtgtcgagtgtagaagtgacagtcgtgggtaggtacggttcgggtggggggtagtcgtttaggtaccgacggtccggtaggggaccggtacccttagggaacgtacccgttccgttccggtagtccgtacgaccgttccgttacgtacggttaccttttacctaaccgtttaacggaccttaaccgtaagtcgaccttaggtcgacggtccggttacggggtccaccgggtacggcccggtacggggaacgggggtacgggtcggttaggggtacggttcgggttactaaccggtacttaaggttcgtacggttcggtaaggtccggttaccaacctaccgtactaacgtacgtaccgacgtaaccgtcgtaccgggaggtaaccggtctaactccgacgtacctnaccgagtactaacgtaaaccgtacaacgtaacctacgtacgtacttacgtacagtaacgaacgacgaacgacgtccgtaagacgacggtaaccggaccgtaggtacccgttagtaccttaggtcgtacgggtaaccttaaacgggtaaaccctttaacccttacccggtttatttacccggtttaacgtacccgtaggtacccgggttaaccgacccggtcggttaacccggtccc

SEQ ID NO: 249780 - DNA, 735 bp, Homo sapiens
  misc_feature: GYAE6OF01CO8JZ.13.4.A04.1.454.CMB.1.raw
  modified_base (136)..(136): a, c, t, g, unknown or other
  misc_feature (136)..(136): n is a, c, g, or t
  modified_base (149)..(149): a, c, t, g, unknown or other
  misc_feature (149)..(149): n is a, c, g, or t
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
  modified_base (361)..(361): a, c, t, g, unknown or other
  misc_feature (361)..(361): n is a, c, g, or t
  modified_base (552)..(552): a, c, t, g, unknown or other
  misc_feature (552)..(552): n is a, c, g, or t
tcagtcacgtactacacgaccggtgctcgatttagagtagtgatcagggggcaggagtcagtcccaaccaggacacagcatggacatgagggtccctgctcaggctccgtgggcctccttgctgctctggctcctnaggtgccagatgngacatcagatcgacccagtctccatcctccctgtctganctctgtaggacgacagatacaaccntacgtactcgaaccgtaggacgagtccaaggtactaacttaaataaacgttatttaaaagttaggtatacacgaacaaacgaaaccgaacgttaaaaccaccccgtaaacgtacgttaccaggtaacaccgtacgtaatgtaacctanaaccgttaaagttaacggaaaccggtacgggtaacccagtaactaaaggttacgtaaggtaggaaagttaggacgttacggtaaccgggaaacgtttaacgttaactttttaccttaactaaccgttactaacggtacaaccgacgtacccgtagtacctaacggtaacgtttagaacgtattaacgttanaactaaacgttaactaattaaccctgttaacgaactaacggttaattaagtacaacttaaccgtacccttaaccgacgtttaaccccaccgggttaccgaaacggttaaaccgggaactacggtaaaccgaggttaaaccgtaaacgttaaacgtaaagcggttaaggccgttaacgtaaccg

SEQ ID NO: 249781 - DNA, 893 bp, Homo sapiens
  misc_feature: GYAE6OF01EJY2U.13.4.A04.1.454.CMB.1.raw
  modified_base (138)..(138): a, c, t, g, unknown or other
  misc_feature (138)..(138): n is a, c, g, or t
tcagtcacgtactacacgaccggtgctcgatttagagtagtgatcagggggcaggagtcagtcccaaccaggacacagcatggacatgagggtccctgctcagctccgtggggctcctgctgctctggctctcaggtnccagatgtgacatccagatcgaccctagtcctccactccctccctgtctgctatcgtagtaggagacgagactaccacctatcctacttcgccgaggcgagtcgaaggtaactaattaactaaactttaatttaaagttggtatacgaagacaaacgaaaccgaacggtaaaccgcccctaaggtccttaccgtagtacttaccgtaacgattacgactaacgttaccgtaaaggtttaaccgggaaaccggtaccggggtacccctaagttacggtaaacggttacgaacgggttagggtaagtacgggtacgtacgggtaacggggtaacctttaaggttttaaccttttttaacccgttaccgaacccttagtacccgtaacggtacccgtaaccggttcccgttacggaccggtaacggttacccgtttaaagggaaactttaacggtttacggttaactaaacccgttaaactttaaacttttaacgtttaccgtaacggttaccgaaacggttacgttaacggtttaactaacgttaaacgtttaaccccgtaccccgttaaccccgttaaaccgtttaccccccggttaaaccccgggttaaccccggggggaaaacccccgttaaacgggggtaaacccccttaacgggggttaaacccggttaaaggggtaaaaccggtttaaaacccggttaaaaccgggttacgggtttaaccggtacggggttaccctaccgggtaaaccccc

SEQ ID NO: 249782 - DNA, 730 bp, Homo sapiens
  misc_feature: GYAE6OF01DI0PA.13.4.A04.1.454.CMB.1.raw
  modified_base (160)..(160): a, c, t, g, unknown or other
  misc_feature (160)..(160): n is a, c, g, or t
  modified_base (720)..(720): a, c, t, g, unknown or other
  misc_feature (720)..(720): n is a, c, g, or t
tcagtcacgtactacacgaccggtgctcgatttagagtagtgatcagggggcaggagtcagtcccaaccaggacacagcatggacatgagggtccctgctcagctccgtggggcctcctgctgctcgtggctctcaggtcgccagatgtcgacatccagntcgacccagttcctccactcccttcctgtctgctattcgtaggtaacggagaccgaaggtactccaacctactacctacgttcgaccgagggtccgagtacgaaggtaactaacttaaactaaacgtttaattttaaagttacggtactacgacgaacgtaaacgtaaaaccgaacggtaaaccgtaccccttaagccttacgtacgtacttaccgacgatcgactactaaccgtaaggttaacgaacggtacgggtacctagtacggtaacggttacgaggttaaggtacggtaggacttacgggacggtaacttacgtttacttttaccgtaccacgactacgacgacctacgtccggtagaccgtagtactagggaacttattagtacgaacttaactactttaagttccgttagacctaaggtacttaacggttataacggttaccttaaccttcctaacccggttaaccgttaccgtaccgggttaaccggaacggtaacggaataacccggtaggtaaaccgtacgttaaacgttaacgggtactggggtaccngtactacccg

SEQ ID NO: 249783 - DNA, 728 bp, Homo sapiens
  misc_feature: GYAE6OF01CD52A.13.4.A04.1.454.CMB.1.raw
  modified_base (135)..(135): a, c, t, g, unknown or other
  misc_feature (135)..(135): n is a, c, g, or t
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (209)..(209): a, c, t, g, unknown or other
  misc_feature (209)..(209): n is a, c, g, or t
  modified_base (519)..(519): a, c, t, g, unknown or other
  misc_feature (519)..(519): n is a, c, g, or t
  modified_base (580)..(580): a, c, t, g, unknown or other
  misc_feature (580)..(580): n is a, c, g, or t
  modified_base (614)..(614): a, c, t, g, unknown or other
  misc_feature (614)..(614): n is a, c, g, or t
tcagtcacgtactacacgaccggtgctcgatttagagtagtgatcagggggagtcagtcccaaccaggacacagcatggacatgagggtccctgctcagctccgtgggctcctgctgctcgtggctctcaggtcncagactgtgactatccagatcgaccngtcctcactcctcctgtcngntatcgagtaggacacagacgtcaactntcacttgaccaggcgacgtgaaggacttaattaaactaactttaagtttaacgttgtaagtacacggtacaaacgtaaaaccgtagtaaaccgtcccgtaagtccttcgtacgtactaccgaagtactcgaacctacttacgtaaggtttaacggaaccggtaccgggtaacctaggtaaccggtaaacggtgtacgggtaaggtaacggttcgggacttaccggtgggtaaacgttcggttttaaacttttacccgtaaccggtaacctaacgttccggaaccccgtacgtaaccgtccgttaaccggngttaaacccgtccgtaagtaacgtagttagtaaccagttaactacgtttagtacctagganacgttcgaaaggttactacgggtaaatttccccnccgttaaccgtcgtaccccgtacggaacgtcccggtaagacgtacccgggttagaacggttaacgtaaacccgtaaagggtcccgttagtcggtaaccctccgaacctaggtcc

SEQ ID NO: 249784 - DNA, 723 bp, Homo sapiens
  misc_feature: GYAE6OF01BT6WB.13.4.A04.1.454.CMB.1.raw
  modified_base (321)..(321): a, c, t, g, unknown or other
  misc_feature (321)..(321): n is a, c, g, or t
  modified_base (716)..(716): a, c, t, g, unknown or other
  misc_feature (716)..(716): n is a, c, g, or t
tcagtcacgtactacacgaccggtgctcgatttagagtagtgatcagggggcaggagtcagtcccaaccaggacacagcatggacatgagggtccctgctcagctccgtggggctcctgctgctctggctctcaggtgccagatgtgacatccagatcgacccagtcctccactccctccctgtctgctatcgtaggtaggagacgagacgtccaaccatcctacttgaccgaggcgagtcgaggtaactaacttaaactaacttttatttaaagttggtaactcgaaggtacaaacggtaaacccgaagggttaaacccnccccgttaaggcccttaaccgtaggtacttaccgtaacgtacgtcgacttaacgttaccgtaaaaggttttaaccgggaaaaccggtccggggttaacccaagttacggtaaacgggtttcgaagggtacgggtaacggtttgggacgttacgggtaacggggtacctttaaggttttaacctttttaaccgttaccaaccgttacgtacgacgtaccgaacgtcccgttacgaacgtacgacgtaacgaagtaacttagtacgaactaatactttactacgtgactagtataagttatagtaacttacgtaccgtacctactaccgtacccgttaccggacgaaccggacaacgtcgtaaggacgtaaaccgttaacgaccgttaggccgtcgngtaaccc

SEQ ID NO: 249785 - DNA, 844 bp, Homo sapiens
  misc_feature: GYAE6OF01CUIRD.13.4.A04.1.454.CMB.1.raw
  modified_base (385)..(385): a, c, t, g, unknown or other
  misc_feature (385)..(385): n is a, c, g, or t
tcagtcacgtactacacgaccggtgctcgatttagagtagtgatcgaggggggagtcagtcccaaccaggacacagcatggacatggagggtccctgctcagctccgtggggctcctgctgctctggctctcgagggtgaccgagtatggtagactactaccgagactaccgaccctacgtccttccctaccttccccttcccttgttctgactattcggtaggaggaacgacgagtacgtaccaccgtactcctacgtacggaccgaggaccgtacgtacgaacggtaactaaattaaaccttaaagtttaatttaaggttagtacactaacggaacgaaacggaaaccggtaaacgtaacccgtacccctaacgtcctactanaccgttacctaggtactacgtaactacgtacgttaacggttaacggaaccggtacgggtacctagttaacggtacggttagaggtagggtaggtacgtcgtacgggtaagttaaccgttagttttaactttaccgtacctaacgactacgtaccgtacgtcggtccgtacggaaccgtaacgtcggtaagtaagttacttacgtaaccgtaaactaaacgtttacgtttaacgttccgttaacgtaaccgttaaggttagtaacccggtttaagtaaccgttaaccgttacccgttaccctaaccggttacccgttacccgggttaacccgaacccgggtaaacccgggtaccggttaacggtaacccggttaaaggggtaacccggttaaacgtaacgggtttaaaaccggtcggttaaccgggcgtacccgttaaaccgacccggtttcttacccgg

SEQ ID NO: 249786 - DNA, 647 bp, Homo sapiens
  misc_feature: GYAE6OF01A85E2.13.4.A04.1.454.CMB.1.raw
  modified_base (208)..(208): a, c, t, g, unknown or other
  misc_feature (208)..(208): n is a, c, g, or t
  modified_base (621)..(621): a, c, t, g, unknown or other
  misc_feature (621)..(621): n is a, c, g, or t
  modified_base (633)..(633): a, c, t, g, unknown or other
  misc_feature (633)..(633): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtcgccagatgtcgacatccagatgacccagtcctccatcctccctgtctgcatctgagagacagagtcaaccntcacttgacctaggcgagtcgaaggacctaattaactaacttaagttttaaagtggttactacgacgacgtaacgaaacccgtaggtaaaaccgccccgtaagtcctcgtactactacgtacatacgctaactccgttaagttaacggaacgtacgggtacctagtacggaaacggttcaaggtaggagtagacgtacggtagggacctaaggtttaacttttcctactaacctaaggttcaacgaccgtacgtacccttgaccaccgtattaacgatacgttattacgactataagttaatcgtaactcgtaggtacctatagttaactaattacgacctaccgtatacccggtaccgtaacggaaccgacggtaaccgtcccgaaagggtagaaaccgttaccgtaaaacncgggttagttanccggtaactacccg

SEQ ID NO: 249787 - DNA, 774 bp, Homo sapiens
  misc_feature: GYAE6OF01BM17I.13.4.A04.1.454.CMB.1.raw
  modified_base (141)..(141): a, c, t, g, unknown or other
  misc_feature (141)..(141): n is a, c, g, or t
  modified_base (584)..(584): a, c, t, g, unknown or other
  misc_feature (584)..(584): n is a, c, g, or t
tcagtcacgtactacacgaccggtgctcgatttagagtagtgatcagggggcaggagtcagtcccaaccaggacacagcatggacatggagggtccctgctcagctccgtgggctcctgctgctcgtggctctcgaggtcncagatgtgacagtccagatcgacccagtcctaccctactcccttcccgtgtctgactatcgtagggtaggaacgacgagtacgtccaacctacttaccgtaccgttcgaccgagggcgagtcgaagtaactaaattaaaccttaactttaagttttaagttagttaacgactaacgaaccgaaaacggtaaaaccgtaaacggtaaaccctaccccgtaacgtccttaccgtacgtaccgttacgtaacgtacgtacacgttaacgttaaccgttaaggttaacggaaaccgggtaccgggtacctaagtacggttaaagggttacggaaggtacggtaggtaggtacggttacggtaggtaactttaacgtttactttaccgtactaccgtactacgtaccgacgtacgtccgtacgtaccgtacgtaacgtagtaacgttnttaacggtacgtaaccttaagtacttttacgtagtacgtaacgagtacttaagtacgtacgttaacctaccgtttaccgaccggttaaccgttacccgccggtaaccgggaccggaacgttaccccgaacggtcgtaaacggtaacgttaaacggtaaccgtacggttaggcccgttagtacccgtaacc

SEQ ID NO: 249788 - DNA, 553 bp, Homo sapiens
  misc_feature: GYAE6OF02IZ310.13.4.A04.1.454.CMB.1.raw
tcagtcacgtactacacgaccggtgctcgatttagagtagtgatcagggggagagaggagcccagccctgggattttcaggtgttttcatttggtgatcaggactgaacagagagaactcaccatggaatttgggctgagcgtgcgtttctaggtggctatttaaaaggtgtccagtgtgaagtgcagctggtggagtctgggggaggcttggtacagcctgggaggtccctgagactctcctgtgcagcctctggattcacctttagcaactatgccatgagctgggtccgccagggctccgaggggaaggggctgggagtgggtctcgaactattagtgctagtggtgccacacatactacgcagactccgtgaaagggccgatttccacatcctccagacgacaattccaagaacacgctgatctgcaaatgaacagcctgacgagcccggaaggaccacgggccgtaatattactgtacgacggaaggtaaatttaccccgtaattaccttttagacttacgtcgggaccacgggtaccctggtacccg

SEQ ID NO: 249789 - DNA, 528 bp, Homo sapiens
  misc_feature: GYAE6OF02JG1FR.13.4.A04.1.454.CMB.1.raw
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
tcagtcacgtactacacgaccggtgctcgatttagagtagtgatcaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagctgggccctggtcccaggcagcgctggcccctgctgctgctgggtctggccatggtcgcccatggcctgctgcgccaatggttgcaccgcaaacgcgggacccagacctcgcgcnccncgtagtaggacncgacgcgactcgcgcgcggcgcgcgtcgggcggcggtacgcgaccgaccgaccgacccaccgacgtcgactacctctcccg

SEQ ID NO: 249790 - DNA, 504 bp, Homo sapiens
  misc_feature: GYAE6OF02F6BMX.13.4.A04.1.454.CMB.1.raw
  modified_base (386)..(386): a, c, t, g, unknown or other
  misc_feature (386)..(386): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaacgcccctaagctcctgatctacgatgcatccaatttggaaacaggggtccatcaaggttcagtggaagtggatcgtggactagtattttacttcaccatcagcagctgcagcctagaanatattgacaacatattactgtcagcagtatagataatctaccgatccaccgttcggacctaagggacacggaactgggaactaacgttaaacgacttggtacggctaggaccactacg

SEQ ID NO: 249791 - DNA, 589 bp, Homo sapiens
  misc_feature: GYAE6OF02H0IR8.13.4.A04.1.454.CMB.1.raw
  modified_base (509)..(509): a, c, t, g, unknown or other
  misc_feature (509)..(509): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggccaagtggttgtgagacccctgaggagctgggccctggtcccaggcagcgctggcccctgctgctgctgggtctggccagtcggtccgcccgagttcggcccttggcctcggccgccccgtaagtcgggttcgccgtaccgaccgaaacggccggggaaccccacggaccccgtggacgcctcgacggttggaacgcgagccgatccgagcctggccgngccgtggtcgggcagggtccgacggccccgaacggccccaaccccgaccgtacgtacccacttcccgtccgttacccccg

SEQ ID NO: 249792 - DNA, 537 bp, Homo sapiens
  misc_feature: GYAE6OF02I8Y1S.13.4.A04.1.454.CMB.1.raw
  modified_base (375)..(375): a, c, t, g, unknown or other
  misc_feature (375)..(375): n is a, c, g, or t
tcagtcacgtactacacgaccggtgctcgatttagagtagtgatcaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagcgtgggccctggtcccaggcagcgctggccctgctgctgctgggtctggcatggtcncccatcggcctgctcgcgccaatggtcgcacgcaaacgcgggacccagaccctggacgccctcgagttggaagcgagccgatccagccgtcgcggacgccgtgtgggcgaggtcacggcccaacggcccaaccccgacgtcgtaccacctcctcgttccccg

SEQ ID NO: 249793 - DNA, 519 bp, Homo sapiens
  misc_feature: GYAE6OF02F53RI.13.4.A04.1.454.CMB.1.raw
  modified_base (473)..(473): a, c, t, g, unknown or other
  misc_feature (473)..(473): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggacgcctcagttggaagcagccgatccagcctgcgagcctgngggcaggtcaggcccaaggcccaacccgctcgtcactctcgtcccc

SEQ ID NO: 249794 - DNA, 581 bp, Homo sapiens
  misc_feature: GYAE6OF02JQKJG.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattggtatcagcagaaaccaggtaaagcccctaagctcctgatctacgatgcatccaatttggaaacagggtccatcaaggttcagtggaagtggatcgtgggacagtattttacttcactatcagcagcctgcagcctagaacgtatattgacaactattaacttactagtacgagtctaagttatagtaattaacttccgtaccccgtaattacccgtaacccgtttaccgggacccgtaaacggggtaaccctaaccgggtaaccgttaggggaacgtaaacgtttaaaccggaaaccgttgggttaccgggtactacgggtacctaacccgttaacg

SEQ ID NO: 249795 - DNA, 491 bp, Homo sapiens
  misc_feature: GYAE6OF02ITQ8X.13.4.A04.1.454.CMB.1.raw
  modified_base (388)..(388): a, c, t, g, unknown or other
  misc_feature (388)..(388): n is a, c, g, or t
  modified_base (465)..(465): a, c, t, g, unknown or other
  misc_feature (465)..(465): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaaagctcctgatctacgatgcatccaatttggaaacaggggtcccatcaaggttcagtggaagtggatctgggacagtattttacttcacctatcagcagcctgcagcctagaanatattgactaacatattactgtacagcagtatagataatcctccgatccaccttcgaccaagggcaacgactagganattaaacgactggtagctgacactac

SEQ ID NO: 249796 - DNA, 532 bp, Homo sapiens
  misc_feature: GYAE6OF02GXZD7.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatcggcctgctgcgccaatggtgcacgcaaagcgggacccagaccctggacgcctcagttggaacgcagccgatccagcctgccggagccgtgtcgggcagggtccaggcccaaggcccaaccccgacgtcgtaccacgtcctcgttaccccc

SEQ ID NO: 249797 - DNA, 545 bp, Homo sapiens
  misc_feature: GYAE6OF02FYJU1.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagcccctgctggcgagagggaccagggcaccgtcctccagggagcccatgctgcaagtcgggccagaggtgcccctgaacctgaaggccaatgagaccccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggaccagacctggacgcctcagttgaagcagccgatccagcctgcggacgcgtggcgggcgtcggtcacggacccgaacggaccccaacccgtacgtaccgtaccaccgttccgtaccgttcccccg

SEQ ID NO: 249798 - DNA, 476 bp, Homo sapiens
  misc_feature: GYAE6OF02H0S31.13.4.A04.1.454.CMB.1.raw
tcagtcacgtactacacgaccggtgctcgatttagagtagtgatcagggggcaggagtcagtcccaaccaggacacagcatggacatgggggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtccaatcaaggttcagtggaagtggatctgggacagattttacttcacatcagcagcctgcagcctgaagatattgcaacatattactgtcagcagtatgatatctccgatcaccttcgaccaagggcacgactggagattaacgactgttggctgcac

SEQ ID NO: 249799 - DNA, 485 bp, Homo sapiens
  misc_feature: GYAE6OF02IJ4NC.13.4.A04.1.454.CMB.1.raw
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcagtcaggacattaacaactattaaattggtatcagcagaaaccaggtaaagcccctaagctcctgatctacgatgcatccaatttggaaacagggtccatcaagttcagtggaagtggatcgtgggacagtattttactttcactatcagcagcctgcagcctagaagatattgcaacatattacngtnagcagtatgataatctacccgatccaccttcggaccaagggacacgactaggagtattaaacggactgtcggctgacc

SEQ ID NO: 249800 - DNA, 538 bp, Homo sapiens
  misc_feature: GYAE6OF02HZSIK.13.4.A04.1.454.CMB.1.raw
  modified_base (174)..(174): a, c, t, g, unknown or other
  misc_feature (174)..(174): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
tcagtcacgtactacacgaccggtgctcgatttagagtagtgatcaggggtctgagagaggagcccagccctgggattttcaggtgttttcatttggtgatcaggactgaacagagagaactcaccatggaatttgggctgagcggtgtgtttctaggtggctattttaaaggngtcagtgtgaagtgcagctggtggagtctgggggaggcttggtacagcctgggaggtccctgagactctcctgtgcagcctctggattcacctttagcaactatgccatgagctggtcccgcaggctccgaggggaagggctggagtgggtctcgaacttgtacgtgctagtggngccaccanatactacgcagactccgtgaacgggtccgattcaccactctccagagacattaccaagaacagctgtatctgacaaatgaacacgcctgagagccgagacgacgcgtatacttacgtgtgacgtaaggtaactttaccctaagttacttttacgaccttacgtcgggtccgaggtaacccg

SEQ ID NO: 249801 - DNA, 520 bp, Homo sapiens
  misc_feature: GYAE6OF02JGY9G.13.4.A04.1.454.CMB.1.raw
tcagtcacgtactacacgaccggtgctcgatttagagtagtgatcagggggagagaggagcccagccctgggattttcaggtgttttcatttggtgatcaggactgaacagagagaactcaccatggaatttgggctgagctggctttttcttgtggctattttaaaaggtgtccagtgtgaagtgcagctggtggagtctgggggaggcttggtacagcctggcaggtccctgagactctcctgtgcagcctctggattcacctttgatgattatgccatgcactgggtccgcaagctccagggaaggcctgggagtgggtctcaggtattaggttggaatagtggtagcataggctatgcggatctgtgaagggccattcaccatctccagagacaacgccaagaactccctgtatctagcaaatgaacagcctgagagctgaggacacggccttgtattatgtgacaaagactaccgaacccttacgtattttcggagttcggttagtacgtacggg

SEQ ID NO: 249802 - DNA, 489 bp, Homo sapiens
  misc_feature: GYAE6OF02IBHSX.13.4.A04.1.454.CMB.1.raw
  modified_base (392)..(392): a, c, t, g, unknown or other
  misc_feature (392)..(392): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaaagctcctgatctacgatgcatcctaaatttggaaacagggtcccatcaaggttcagtgaagtgatcgtggacagtattttactttcacctatcagcagcctgcagcctgaagntattgacaatatattactgtcagcagtatgataatctccgatccaccgttcggccgaaagggaccacgactaggagtataaacgattgaggtctgac

SEQ ID NO: 249803 - DNA, 519 bp, Homo sapiens
  misc_feature: GYAE6OF02IXPXA.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtccatcaaggttcagtggaagtggatcgtggactagtattttactttcactatcagcagcctgcagcctagaagtattattgacaaactatattactgtacagctaagtatagaattaatcctacccgattccacctttcggaccgaaagggccaacggtactgggaagtaacttaaacggtacttggtacggcttagacccg

SEQ ID NO: 249804 - DNA, 567 bp, Homo sapiens
  misc_feature: GYAE6OF02HVFBH.13.4.A04.1.454.CMB.1.raw
  modified_base (438)..(438): a, c, t, g, unknown or other
  misc_feature (438)..(438): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggccaagtggtgtgagaccctgaggagctgggccctggtcccaggcagcgctggcccctgctgctgctgggtctggccagtcggcgcccagtcggccctgctcgcgcccaatcggttgcaccgcgaaacggccgggacccacggacccgnggacgccgtcgacggttggaacgcgacgccgatccagccgtgccggagccgtggtcggggcgaacgggtccacggccccgaacggccccaaccccgaccgtcgtacccgacttcccgtccgttcccccg

SEQ ID NO: 249805 - DNA, 507 bp, Homo sapiens
  misc_feature: GYAE6OF02GAQY7.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattggtatcagcagaaaccagtaaacgcccctaagctcctgatctacgatgcatccaatttggaaacaggggtcccatcaaggttcagtaggaagtggatcgtgggactagtattttactttcacctatcagcagcctgcagcctagaagtattattgacaactattattactgtacagctaagtatgaataatctcccgatcctaccttcggaccgaacgggacacggactaggagtaacttaacgacttggcggtctgacc

SEQ ID NO: 249806 - DNA, 546 bp, Homo sapiens
  misc_feature: GYAE6OF02GNQ2Q.13.4.A04.1.454.CMB.1.raw
  modified_base (490)..(490): a, c, t, g, unknown or other
  misc_feature (490)..(490): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatgtcgcccatcggcctgctcgcgcccaatggttcgcaccgcaaacggccggggacccaggaccccgtggacgccgtcgagttcggaagcagccgatccgagcccgtgcggacgccgtgngggcagggtcacggcccaacggcccaacccgctaccgtcacgtcctcgttcccccg

SEQ ID NO: 249807 - DNA, 507 bp, Homo sapiens
  misc_feature: GYAE6OF02I4E1E.13.4.A04.1.454.CMB.1.raw
  modified_base (366)..(366): a, c, t, g, unknown or other
  misc_feature (366)..(366): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaattggaaacagggtcccatcaagttcagtgaagtgatctgggacagtattttacttcacatcancagcctgcagcctagaagattattgacaanattattactntacagcagttatgaattaactcctaccgattccaccgttcggaccgaagggaccaacggactaggaataacgttaaacggaacttggtacggtactgtacc

SEQ ID NO: 249808 - DNA, 510 bp, Homo sapiens
  misc_feature: GYAE6OF02JWDNE.13.4.A04.1.454.CMB.1.raw
  modified_base (136)..(136): a, c, t, g, unknown or other
  misc_feature (136)..(136): n is a, c, g, or t
  modified_base (192)..(192): a, c, t, g, unknown or other
  misc_feature (192)..(192): n is a, c, g, or t
  modified_base (297)..(297): a, c, t, g, unknown or other
  misc_feature (297)..(297): n is a, c, g, or t
  modified_base (375)..(375): a, c, t, g, unknown or other
  misc_feature (375)..(375): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctctggctctcaggtnccagatgtgacatccagatgacccagtctccatcctcctgtctgcatctgtagganacagagtcaccatcactgccaggcgatcagacatacactattaatgtatcagcagaaccagtaaacgccctaagctcctgactctacgatgcatcaattggaacngggtccatcaagttcagtgaagtgatcgtggactagtattttactttcactatcagcaagcctgctacgcctgaaagntacttgacaactatattacattcgagctaagtatgaattaactcctaccgattccacctttacggacccgaagggtaccacggtaacctaggtaactaacggttaaaccgaacttggtaacggtctaggtaaccc

SEQ ID NO: 249809 - DNA, 579 bp, Homo sapiens
  misc_feature: GYAE6OF02IUZQK.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagaccctgaggagctgggccctggtcccaggcagcgctggcccctgctgctgctgggtctggccagtggtcgcccatcggcctgctgcgccaatggttgcaccgcgaaacggccgggacccgacggacccgtggacgccgtacacggttggaacgccgacggccgacgtccgacgccgtaggccggacgccgtcggtcggggccgacgggtccgacggaccccgaacgggacccaacccccgacgtccgtacctaaccttccgtccgttcccccg

SEQ ID NO: 249810 - DNA, 596 bp, Homo sapiens
  misc_feature: GYAE6OF02JOWE4.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggtgtgagaccctgaggagctgggccctggtcccaggcagcgctggcccctgctgctgctgggtctggcatggtccgccatcggcctgcctggccgccaagtcggttgccgtaccggcgaaacggccggggacccacggaccccgtgggaaccgcccgtacgacggttacgggaacgccgacggacccgactcccgacgcctcggcggtacgccgtggtcggggacgcgggtccacggccccgaacgggccccgtaaccccgacgttaccggcctaccgttacccttccgttacccccg

SEQ ID NO: 249811 - DNA, 565 bp, Homo sapiens
  misc_feature: GYAE6OF02GJ1DM.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaaagacaggccaagtgggttgtgagacccctgaggagctgggccctggtcccaggcagcgctggcccctgctgctgctgggtctggccatcggtcgcccgatcggcctggctcggccgcccaagtcggttgcctacccgcgaaaacggccggggaacccgaggacccctgggacgcccgtcgagttggaacgcgagcccgatcccaagcctaggcggagccgtggtggggcagggtccaggcccaaggcccaaccccgctcgtccacttcctcgttaccccc

SEQ ID NO: 249812 - DNA, 464 bp, Homo sapiens
  misc_feature: GYAE6OF02GAASJ.13.4.A04.1.454.CMB.1.raw
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcagtcaggacattaacaactatttaaattggtatcagcagaaaccaggtaaagcccctaagctcctgatctacgatgcatccaatttaggaaaagggtccatcaaggttcagtggaagtggatctggacagtattttacttcacatcagcagcctgcagcctgaagatattgacaacattattactgtcagcagtatgatatctccatcactcgcaggacacgatgganattaacgatgngctgcacntc

SEQ ID NO: 249813 - DNA, 563 bp, Homo sapiens
  misc_feature: GYAE6OF02H10BB.13.4.A04.1.454.CMB.1.raw
  modified_base (172)..(172): a, c, t, g, unknown or other
  misc_feature (172)..(172): n is a, c, g, or t
  modified_base (289)..(289): a, c, t, g, unknown or other
  misc_feature (289)..(289): n is a, c, g, or t
  modified_base (345)..(345): a, c, t, g, unknown or other
  misc_feature (345)..(345): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
tcagtcacgtactacacgaccggtgctcgatttagagtagtgatcagggggagagaggagcccagccctgggattttcaggtgttttcatttggtgatcaggactgaacagagagaactcaccatggaatttgggctgagcgtgtgtttctaggtggctaattttaaaaggngtccagtgtgaagtgcagctggtggagtctgggggaggcttggacagcctgggaggtcctgagctctctgtgcagcctgtggattcacctttagcaatatgccatgagcgtgggccncaggctccgagggaagggctggagtgggtactcaaactattagtgctaggttggcncccaaccacattactacgcaacgtctccgtaggaaacgggccatttccacctatcnccaganacaattccaaagaacncgtacngtatcgananaananacacgcagagacgacgacgacgacgacgtatactacgtgtacgtacgtaacgtaacttaaccttaactttactttacgttacgtacggtaccggtaccggacggtaccggtacggtacg

SEQ ID NO: 249814 - DNA, 533 bp, Homo sapiens
  misc_feature: GYAE6OF02F0KA5.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaacgcgggacccagaccctggacgcctcagttgaagcagccgatccagcctgcggagcctgtgggcagggtccaggccccaaggcccaaccccgactacgtccaccgttcctcgttcccccg

SEQ ID NO: 249815 - DNA, 512 bp, Homo sapiens
  misc_feature: GYAE6OF02I7C1B.13.4.A04.1.454.CMB.1.raw
  modified_base (273)..(273): a, c, t, g, unknown or other
  misc_feature (273)..(273): n is a, c, g, or t
  modified_base (415)..(415): a, c, t, g, unknown or other
  misc_feature (415)..(415): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaacncccctaaagctcctgactctacgatgcatccaatttaggaaacagggtcccatacaaggttcagtggaagtggatcgtggactagtattttactcacatcagcagctgcagcctagaagtatattgactaactatatttacngtacagctaagtatagaattaactcctaccatcctaccgttcggaccgaaggaccacgacgtagaagtaacttaacggacgtgtacggtctagtacc

SEQ ID NO: 249816 - DNA, 512 bp, Homo sapiens
  misc_feature: GYAE6OF02HZ1AE.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacataacaactattaaattggtatcagcagaaaccaggtaaacgcccctaagctcctgatctacgatgcatccaatttggaacagggtccatactaaggttcaggtaggaagtggatcgtgggactagtattttactttcacctatcagcagcctgcagcctgaagtatattgactaactatattacgtgtcagcagtatagtaataatcctaccgtatcctaccgttcgaccgaagggaccacgacgtaggagtaacttaaacgagttaggtacggtctagtac

SEQ ID NO: 249817 - DNA, 537 bp, Homo sapiens
  misc_feature: GYAE6OF02G27HY.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgcccctgaacctgaaggccaatgagacccaagacaggccaagtgggttgtgagacccctgaggagctgggcctggtcccaggcagcgctggccctgctgctgctggtctggccatggtcgccatggcctgctgcgcccaatggttgcaccgcaaacgcgggacccacggaccctggacgcctcgagttcggaagcgagccgatccagcctgcgagccgtgtggggcagggtccacggcccaacggcccaaccccgtcgtacgtccaccgttcctcgttaccccc

SEQ ID NO: 249818 - DNA, 575 bp, Homo sapiens
  misc_feature: GYAE6OF02IEH5W.13.4.A04.1.454.CMB.1.raw
  modified_base (506)..(506): a, c, t, g, unknown or other
  misc_feature (506)..(506): n is a, c, g, or t
tcagtcacgtactacacgaccggtgctcgatttagagtagtgatcagggggcagttggtagatgcccctctgggagagatcccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcgtcgcccgatcgggccttgctcgccgccccaaatcggttgcaccgcgaaaggccgggaacccacggaccctcggacgcctcgagttggaacgcgacgaccgatccacgcctgcgacgccgtaggtcgggacgnggtaccgacggaccccgaacggacccgaaccccaccgtacgtaccgaccttccgtccgttaccccccgg

SEQ ID NO: 249819 - DNA, 533 bp, Homo sapiens
  misc_feature: GYAE6OF02F6VAO.13.4.A04.1.454.CMB.1.raw
  modified_base (458)..(458): a, c, t, g, unknown or other
  misc_feature (458)..(458): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatcggcctgctgcgcccaatggttgcaccgcaaagccggggacccagacccgtggacgcctcagttgaagcagccganccagcctggcgagccgtgcggggcgaggtccaggcccaaggcccaaccccgactcgccacttcctcgttcccccg

SEQ ID NO: 249820 - DNA, 541 bp, Homo sapiens
  misc_feature: GYAE6OF02H5A3U.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaaacgcccctaaagctcctgatctacgatgcatcctaatttaggaaacagggtcccaatcaaggttcagtggaagtggatcgtgggactagtattttactttacactatcagcagcctgcagcctagaagtattattagactaacattattactgtacagctagttatgtaattaactcctacccgtatcctaccgttcggaccgaagggtaccaacggtaacgtaggaagtaacgttaaaccggtacgttacggtacggacctactaaccg

SEQ ID NO: 249821 - DNA, 575 bp, Homo sapiens
  misc_feature: GYAE6OF02HBUCU.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaaggccaatgagacccaagacaggccaagtgggttgtgagacccctgaggagctgggccctggtcccaggcagcgctggcccctgctgctgctgggtctggccatcggtcgcccatcggcctgctgcgcccaagtcggttcgctaccgcaaacggccggggaacccacggacccctgggacgcccgtacgaggttcggaagtccgagcccggatcccgagcccgtgccggagcccgtggtcggggcagggtccaacggtcccgaacgggcccaaccccgactcgtaccacttccgtcgttaccccc

SEQ ID NO: 249822 - DNA, 567 bp, Homo sapiens
  misc_feature: GYAE6OF02G7EZ7.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgccctgaacctgaaggccaatgagaccaagacaggccaagtggtgtgagacccctgaggagctgggcctggtcccaggcagcgctggccctgctgctgctgggtctggccagtcggtccgcccagtcggccttgcctcgcgcccaagtcggttgccaccgcgaaacgccggggaacccaggacccctgggacgcccgtcgacggttcggaacgcgacgccgatccgagccgtgccggagccgtggtcggggccgagggtccacggcccaacggcccaaccccgtactacggtccaccttccgtcggttcccccg

SEQ ID NO: 249823 - DNA, 472 bp, Homo sapiens
  misc_feature: GYAE6OF02F7UWP.13.4.A04.1.454.CMB.1.raw
  modified_base (359)..(359): a, c, t, g, unknown or other
  misc_feature (359)..(359): n is a, c, g, or t
  modified_base (450)..(450): a, c, t, g, unknown or other
  misc_feature (450)..(450): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttacttnaccatcagcagcctgcagcctgaagatattgcaacatattactgtcagcagtatgataatctccgatcaccttggcaaggcacgactgganattaacgactgtgctgcactac

SEQ ID NO: 249824 - DNA, 546 bp, Homo sapiens
  misc_feature: GYAE6OF02H2133.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaacttattaaattggtatcagacaagaaaccaaggtaaacgcccctaaagctacctgactctacgatcgcatcctaagtttaggaaacacggggtaccatcaaggttcaagtggaagtggatcgtaggacagtattttactttcactatcagcagcctgcagcctagaagtattattagacaaactattattaacttgtacaagtctaagtatagtaataactctacccgtataccaccgttccggaccgaaaggaccaacgaccgttaggaacgtactttaaaccggagttacggtacgccgtagacccg

SEQ ID NO: 249825 - DNA, 490 bp, Homo sapiens
  misc_feature: GYAE6OF02FHU6X.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattggtatcagcagaaaaccaggtaaagcccctaaagctcctgatctacgatgcatccaatttggaaacagggggtcccatcaaggttcagtgaagtggatctgggacagattttacttcaccatcagcagcctgcagcctgaaagataattgcaacatattactgtcagcagtatgataatctcccgatcaccttcgccaaggacgaacgactacggagattaaaacgaactagtaggctgcgaccaac

SEQ ID NO: 249826 - DNA, 541 bp, Homo sapiens
  misc_feature: GYAE6OF02GFOGW.13.4.A04.1.454.CMB.1.raw
tcagtcacgtactacacgaccggtgctcgatttagagtagtgatcaggggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccatcacttgccaggcgagtcaggacattaacaactatttaaattggtatcagcaagaaaccaggtaaacgcccctaagctcctgatctacgatgcatccaatttggaaacaggggtcccatcaaggttcagtggaagtggatcgtgggactagtattttacttcacctatcagcagcctgcagcctagaagtatattgacaaactattaattactgtacagacagtatagtaataactcctaccgtatcctaccgttacggaccgaacgggaccaacggtacgtagggaacgtaacgttaaaccgacgttggtacggtacctacggacctaccgtaacg

SEQ ID NO: 249827 - DNA, 518 bp, Homo sapiens
  misc_feature: GYAE6OF02H5U5I.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcagtcaggacattaacaactatttaaattggtatcagcagaaaccaggtaaagcccctaagctcctgatctacgatgcatccaatttggaaacagggtccatcaaggttcagtggaagtggatcgtgggacaggtattttactttcacctatcagcagcctgcagcctagaagtatatttgacaactatattactgtacagcaagtatagtaataactctacccgtatccaccgtttcggaccgaagggacctacggactacggaagtaacttaaacggacttaggtacggtctgtaacc

SEQ ID NO: 249828 - DNA, 594 bp, Homo sapiens
  misc_feature: GYAE6OF02JP7SA.13.4.A04.1.454.CMB.1.raw
  modified_base (205)..(205): a, c, t, g, unknown or other
  misc_feature (205)..(205): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtaccnaccactactacttcgaccgacggacgacgtacgagactaactaactaacttaattaattagtatacgtagacgaacgaaacgaacggtaaacgtacccgtaacgtactaccgtacgtactactacgtatacgactactactaacgttaacggtaacgtacggtaccgtacgtacgtacgtacgtagtaggtaaggtaggtagtacgtaggtacgtagtatttacttactactactactacgtacgacgacgtacgacgacgtacgtagaagtaatatacgtactaactaatattactagtacagacgtagtatatatactactacctactactaccgtacgacgacgacgacgacgtagtacgtacgtaacgtagtacgtagtagtacg

SEQ ID NO: 249829 - DNA, 484 bp, Homo sapiens
  misc_feature: GYAE6OF02G35JM.13.4.A04.1.454.CMB.1.raw
  modified_base (480)..(480): a, c, t, g, unknown or other
  misc_feature (480)..(480): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggcaagtcagggcattagaaatgatttaggctggtatcagcagaaaccaggtaaagcccctaagctcctgatctacgatgcatccaatttggaaacaggggtcccatcaaggttcagtggaagtggatctgggacagtattttacttcacctatcagcagcctgcagcctagaagatattgacaactatattactgtacagcagtatgaatatcctaccgatcacgttcgccaaggacacgactggatattaaccgatgtcggntacg

SEQ ID NO: 249830 - DNA, 521 bp, Homo sapiens
  misc_feature: GYAE6OF02HM50Y.13.4.A04.1.454.CMB.1.raw
  modified_base (269)..(269): a, c, t, g, unknown or other
  misc_feature (269)..(269): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattgtatcagcagaacaggtaaancccctaagctcctgatctacgatgcatacctaatttggaaaacaggggtacccagtctaaggttcaggtaggaagtggaatcgtaggacagtattttactttcacatcagcagcctgcagctagaagattatgacaacattatactgtcagcagtatagataatctaccatacaccgttccggacctaagggaccctaacgaccgttaggaagtacgttaaaaccggaaccgttaggtggaccttcgaaccg

SEQ ID NO: 249831 - DNA, 578 bp, Homo sapiens
  misc_feature: GYAE6OF02IVRQT.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgcccctgaacctgaaggccaatgagacccaagacaggccaagtgggttgtgagacccctgaggagctgggccctggtcccaggcagcgctggcccctgctgctgctgggtctggccagtcgtcgccagtcggcctgctcgcgccagtggttgcgaccgacgaaacggccgggacccagaccctggacgcctcacggttcgaagcgagccgagtccgagcctggccggagccgtgggtcgggccgagggtccgacggtaccccgaacgggaccccaacccccgtaccgtccgtacccgtaacccgttccgtcccggtttccccccg

SEQ ID NO: 249832 - DNA, 564 bp, Homo sapiens
  misc_feature: GYAE6OF02FZ24Z.13.4.A04.1.454.CMB.1.raw
  modified_base (475)..(475): a, c, t, g, unknown or other
  misc_feature (475)..(475): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccccaagacaggccaagtgggttgtgagacccctgaggagctgggcctggtcccaggcagcgctggcccctgctgctgctgggtctggccagtcggtcgcccgatcgggcctgctcgccgcccaagtggttcgcaccggacgaaacggccggggacccaggacccgtggacgcctcgagttcggagcgagccganccgagcctggccgacgccgtggtgggccgtaggtccgacggcccgaacggcccaaccccgctaccgtaccaccgttcctcgttaccccc

SEQ ID NO: 249833 - DNA, 541 bp, Homo sapiens
  misc_feature: GYAE6OF02H8GJ9.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattgtatcagcagaaaccaggtaaacgcccctaagctcctgatctacgatgacatcctaatttaggaaacgtagggtcccatacaaggttcagtaggaagtggatcgtggactagtattttactttcacatcagcagcctgcagcctagaagtattattgacaactattattactgtacagctagtatagtaataactcctacccgtatccctaccgttcggacccgtaaagggacccacggtaacgtaggtaacgtaacgttaaaccgaacgttacggtaggtaccttacggaccc

SEQ ID NO: 249834 - DNA, 500 bp, Homo sapiens
  misc_feature: GYAE6OF02I0W4N.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaaagctcctgatctacgatgcatccaatttggaaacaggggtcccatcaaggttcagtggaagtggatctgggacaggtattttactttcaccatcagcagcctgcagcctagaacgattattgacaacattattactgtcagcagtatgataatcctaccgatccacttcggaccaagggaccacgtactggagtaattaacggatggtgtacgtgtaaccc

SEQ ID NO: 249835 - DNA, 532 bp, Homo sapiens
  misc_feature: GYAE6OF02JBZ9C.13.4.A04.1.454.CMB.1.raw
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcagtcagacataacaactattaattgtatcagcagaacaggtaaacnccctaagctcctgactctacgatgcatcctaatttaggaaacncgggtaccatacaagttttcagtaggaagtgaagtctgggaactagtacttttactttacacattcagcacgctgcacgtccgtagaacgtatacttgactaacattattactgtacagtcagttatagtataacgttctaccattactacccgtttcggaccgtaacggacctacggacctaggaacgaactttaaacggaccgttgtacggtacgctaacccg

SEQ ID NO: 249836 - DNA, 523 bp, Homo sapiens
  misc_feature: GYAE6OF02G3RWU.13.4.A04.1.454.CMB.1.raw
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtcccatcaaggttcagtggaagtggatcgtgggacagtagtttttactttcgtaccattcagcagcctgcagcctgaacgntatgacaanatatactgtacagtacagtatgtaactaatcctaccgattcgaccttcggacctaacgggactacgacgtagggaataacgtttaaaccggaacgttggtacggtacgtgtaacccg

SEQ ID NO: 249837 - DNA, 486 bp, Homo sapiens
  misc_feature: GYAE6OF02JDRRQ.13.4.A04.1.454.CMB.1.raw
  modified_base (395)..(395): a, c, t, g, unknown or other
  misc_feature (395)..(395): n is a, c, g, or t
  modified_base (463)..(463): a, c, t, g, unknown or other
  misc_feature (463)..(463): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggagacagagtcaccatcacttgccaggcgagtcagacattaacaactattaattgtatcagcagaacaggtaagcccctaagctcctgatctacgatgcatccaatttggaaacaggggtcccatcaaggttcagtggaagtggatcgtggacagtattttactttcaccatcagcagcctgcagcctagaagtatattgacaanttaatactgtcagcagtatgattaatctacccgatccaccgttcggaccaagggaccaggctaggaanacgttaaacgactggtcgctgac

SEQ ID NO: 249838 - DNA, 576 bp, Homo sapiens
  misc_feature: GYAE6OF02IK2KE.13.4.A04.1.454.CMB.1.raw
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (403)..(403): a, c, t, g, unknown or other
  misc_feature (403)..(403): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagggagcccatgctgcaaggtcgggccagaggtgcccctgaacctgaaggccaatgagaccaagacaggccaagtggtgtgagacccctgaggagctgggccctggtcccaggcagcgctggcccctgctgctgctgggtcnggcagtcggtcnccatggcctgctgccgcccaagtcggtncgaccgacgaaaggccggggaacccacggacccgtgggaaccgcctacgacgttggaaacgtcgacgaccgagtcccgagtcccgtcggcggacgtccggtggtcggggccaagggtccgacggccccgaacggcccaacccgcgtccgtaccacgttccctacgttaccccc

SEQ ID NO: 249839 - DNA, 538 bp, Homo sapiens
  misc_feature: GYAE6OF02HFRV6.13.4.A04.1.454.CMB.1.raw
  modified_base (401)..(401): a, c, t, g, unknown or other
  misc_feature (401)..(401): n is a, c, g, or t
  modified_base (486)..(486): a, c, t, g, unknown or other
  misc_feature (486)..(486): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccctgaacctgaaggccaatgagacccaagacaggccaagtgggttgtgagacccctgaggagctgggccctggtcccaggcagcgctggccctgctgctgctgggtctggccatggtcgccatggcctgctgcgcccaatggttncaccgcgaaacgccggggacccagacccctggacgcctcgagttggaacgcagccgatccagcctgcggacgccgtgtcggggcngggtcacggcccgaacggcccaaccccgacgtgccacgttcctgttcccccg

SEQ ID NO: 249840 - DNA, 578 bp, Homo sapiens
  misc_feature: GYAE6OF02JIJMS.13.4.A04.1.454.CMB.1.raw
  modified_base (195)..(195): a, c, t, g, unknown or other
  misc_feature (195)..(195): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatccctccctgtctgcatctgtagganacagagtcaccatcacttgccaggcgagtcaggacataacaactattaaattggtatcagcagaaaccaggtaaacgcccctaaagctcctgactactacgatgcatccaatttaggaaacagggtccatacaaggttcagtaggaagtggatcgtgggacagtattttactcacatcagcagtcctgccagcctagaacgtattacgttgacaaactattaacttacgtgtacgaagtactaagttatacgtaattaacgtccttacccgtaattcccgtaacccgtttcgggacccgtaaaggggtaccctaacggtaacgttacgggaacgttaaacgttaaaaccggaacgttacgggtacggtaccgtacgtaacccg

SEQ ID NO: 249841 - DNA, 582 bp, Homo sapiens
  misc_feature: GYAE6OF02HHV4G.13.4.A04.1.454.CMB.1.raw
  modified_base (192)..(192): a, c, t, g, unknown or other
  misc_feature (192)..(192): n is a, c, g, or t
tcagtcacgtactacacgaccggtgctcgatttagagtagtgatcagggggaggtcagtcccaaccaggacacagcatggacatgagggtccctgctcagctcctggggctcctgctgctctggctctcaggtgccagatgtgacatccagatgacccagtctccatcctccctgtctgccatctgtagganacagagtcaccatcacttgccaggcgagtcaggacattaacaactatttaaattgtatacagcagaaaccaggtaacaccctaagctactgactactacgatgcatcctaatttaggaaacacggggtacccagtacgaacggttcaagtggaagtggatgtaggactagtattttacttacactatcagcacgctgcagctagaactattatgactaaactattaacttactaggtcaaggtacaagttatacgtaatttaaaccgtccttaacccggattacccgtacccgtttacgggaccgtaacggggaccctaacggttaacgacggttaacggtaaacgtttaaaccggacgttaggtacgggtaacctcgacgtaaccctag

SEQ ID NO: 249842 - DNA, 505 bp, Homo sapiens
  misc_feature: GYAE6OF02IJ95J.13.4.A04.1.454.CMB.1.raw
  modified_base (421)..(421): a, c, t, g, unknown or other
  misc_feature (421)..(421): n is a, c, g, or t
  modified_base (443)..(443): a, c, t, g, unknown or other
  misc_feature (443)..(443): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattggatcagcagaaaccaggtaaagcccctaagctcctgatctacgatgcatccaaatttggaaacagggtccatcaaggttcagtggaagtggatcgtggacagaattcactctcacaatcagcagcctgacagcctagaagtattttgactaaacttattacttagtacaaacngtacttaaattacgttacccgnttacacgtttcgcggagggacgaaggtggagatacaaacgaacgtgtggctagcaccattcg

SEQ ID NO: 249843 - DNA, 566 bp, Homo sapiens
  misc_feature: GYAE6OF02HWFN3.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctggaggagcgtgggccctggtcccaggcagcgctcggcccctgcctgctgcgtcgggtctggccagtcggtcgcccgatcggcctgctcgcgcccaagtcggtgcaccggcgaaacggcgggacccacgacccgtggacgcctcgaggttcggaacgcacgccgactccgagccgtagccggcgcgtggtggggcgaggtccacggcccgaacggcccaacccgctcggtacccacgttccgtccgttcccccg

SEQ ID NO: 249844 - DNA, 537 bp, Homo sapiens
  misc_feature: GYAE6OF02GIWMC.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattgtatcagcagaaaccaggtaaacgcccctaagctcctgactctacgatgcatccaattggaacagggtccatcaaggttcagtggaagtggatcgtagggactaggtattttacctttcacctatacagcagtcctgcacgcctagaagtattatgactaactatacttactgtacagtctaagtatagtattaactcctacccgtatccgtaccgttccggaccgtaacgggaccaccggtactagggaacgtaacgttaaaccggacttggtacggtacctggaccc

SEQ ID NO: 249845 - DNA, 521 bp, Homo sapiens
  misc_feature: GYAE6OF02F1CV6.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaacgcccctaagctcctgatctaacgatgcatccaatttaggaacaggggtcccatcaaggttcagtggaagtggatcgtgggacagtattttacttcaccatcagcagcctgcagcctgaagattagttgacaacattattactgtacagcaagtatagaattatcctaccatccaccgttccggaccgtaacgggaccaacggtacgtaggaagtaacttaaacggaacgttggtagtcgtagtaacccg

SEQ ID NO: 249846 - DNA, 568 bp, Homo sapiens
  misc_feature: GYAE6OF02IAH7O.13.4.A04.1.454.CMB.1.raw
  modified_base (307)..(307): a, c, t, g, unknown or other
  misc_feature (307)..(307): n is a, c, g, or t
  modified_base (395)..(395): a, c, t, g, unknown or other
  misc_feature (395)..(395): n is a, c, g, or t
  modified_base (513)..(513): a, c, t, g, unknown or other
  misc_feature (513)..(513): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccgtctccagggagccatgctgcaagtcgggccagaggtgcccctgaacctgaaggccaatgagaacccaagacaggacctaaagtgggttgngagaacccctgaggagctggccctggcccaggcagcgctggcccctgctgctgcgtgggtctaggccatggtcgcccagtgccgtgcngcgcccaatcggttgccacggcaaagcggggacccaggaccctcggacgctcacgttgaacgcacgtccgaatccaacgccgtcgacggagtccgtcggtcggggacaacgggttccncgaacccgaacggtccccgaaacccgaccgtgtaccacctcgtcccgttaccccc

SEQ ID NO: 249847 - DNA, 589 bp, Homo sapiens
  misc_feature: GYAE6OF02IY79K.13.4.A04.1.454.CMB.1.raw
  modified_base (248)..(248): a, c, t, g, unknown or other
  misc_feature (248)..(248): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaatgtatcancagaacagtaacgccctaagctcctgatctacgatgcatacctaagtttaggaaacgtacggggtaccctagtacgtaaaggttcgaaggtacgggaagtggtatcgtagggacagttacttttacttacacctatcacgacacgcctgcagccgtagaagtatattagactaactattacttactgtacagtcgtaagtactagtaattaactccttacccgtacttaccgtacccgtttaccgggaccgtaacggggaacctaaccgggtaacgtacgggtaaagtaacggtttaaaccggaacgttacggtacgggtacctacggtacccaccttacg

SEQ ID NO: 249848 - DNA, 641 bp, Homo sapiens
  misc_feature: GYAE6OF02IR93X.13.4.A04.1.454.CMB.1.raw
  modified_base (523)..(523): a, c, t, g, unknown or other
  misc_feature (523)..(523): n is a, c, g, or t
tcagtcacgtactacacgaccggtgctcgatttagagtagtgatcaggggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatctacttcgccaggcgagtcaggacattaacaacttaatttaaattggtatcagacaagaaaccgaaggttaaaacgccccttaaagccttaccgtgtacttaccgacgtactcgacctacttaaccctaagttttaacgggaaaacgtacggggtaccccaagttactaaagggtttccaggacggacgaggtacggtactcgtggaccacgaagtaccttacactttcgtacaacctagtccaacgccgacgtcccgtagacctacgtcgtagaagtaattacgtacgactaaacttattaacgttactcgtanacgtactaagttatagtaactaactcccgtaccgtactacccgtacccggttacggaaccggaacggtaaccctacggtaccggtaggtaaaccgtaacgttaaaccgagttaccggg

SEQ ID NO: 249849 - DNA, 579 bp, Homo sapiens
  misc_feature: GYAE6OF02GCJMY.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaacgcccctaagctcctgatctacgatgcatccaatttggaacaggggtcccatcaaggttcagtggaagtggatcgtagggacagtattttacgttcacctatcagcacgcctgcacgcctaggaagtaatagttcgaacaactattaactttacgtgtacaggactaagttatagtaacttaatcccttacccgacttacctaccgttaccgggacccaaacggggtaaccaacgggtaaccttaagggaacgttaaacgtttaaaaccggacgttacgggtacggaccttacggaccctaaccgttaaccg

SEQ ID NO: 249850 - DNA, 624 bp, Homo sapiens
  misc_feature: GYAE6OF02HIEHR.13.4.A04.1.454.CMB.1.raw
  modified_base (229)..(229): a, c, t, g, unknown or other
  misc_feature (229)..(229): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcggccagaggtcgcccctgaacctgaacggccaatgagacccaagacaggccaagtgggtgtgagacccctgaggagcgtgggccctggtcccaggcagcgctcggcccctgctgctgcgtgggtctggccagtcggtcgccagtcggcctgctcgccgccaagtcggttcgcgaccgcgaaacggccggggaccctaggaccctgggacgccgtcgtacgggttacggaacgccgtacgacccgacgttcccgacgtccgtaggcccggagtcccggtacgggtcggggaccgtacgggtcccgaccgggtacccccgaacggccccgaaccccgtacgtaccgtaccgtacccgttccgttcccggtttacccccccgg

SEQ ID NO: 249851 - DNA, 543 bp, Homo sapiens
  misc_feature: GYAE6OF02IASYU.13.4.A04.1.454.CMB.1.raw
tcagtcacgtactacacgaccggtgctcgatttagagtagtgatcaggggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacaattaacaacttaatttaaattggtatcagacagaaaccaaggtaaagcccctaagcctcctagatctacgatgcatacctaaatttaggaaaacgtaggggtacccaataccgaaaggtttacaggtgggaaggttaggaatcgtggacaggttatttttactttcacatcagcagcctgcagtcctagaacgattacttgactaactatattactgtacaagcaagtatagataactcacccgtatccaccttacggaccgaagggaccacggtactaggaagtacttaacgaagttgaggtctgtacccg

SEQ ID NO: 249852 - DNA, 517 bp, Homo sapiens
  misc_feature: GYAE6OF02GXEXV.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaacgcccctaaagcctcctgatctacgatgcatccaatttggaaacaggggtacccatacaaggttcagtggaagtggagtcgtgggactagtatttttacttcacctatcagcagcctgcagcctagaatattattgacaactatattactgtacagctagtatagaataatcctaccgatcctaccttcggaccgtaagggaccacggacgtggaataagttaaacgacgttggtcggactgaccc

SEQ ID NO: 249853 - DNA, 539 bp, Homo sapiens
  misc_feature: GYAE6OF02FFQJM.13.4.A04.1.454.CMB.1.raw
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (388)..(388): a, c, t, g, unknown or other
  misc_feature (388)..(388): n is a, c, g, or t
  modified_base (434)..(434): a, c, t, g, unknown or other
  misc_feature (434)..(434): n is a, c, g, or t
tcagtcacgtactacacgaccggtgctcgatttagagtagtgatcagggggagagaggagcccagccctgggattttcaggtgttttcatttggtgatcaggactgaacagagagaactcaccatggaatttgggctgagctggctttttctgtggctattttaaaaggtgtccagtgtgaagtgcagctgggtggagtctgggggagcttggtacagcctgggaggtccctgagactctcctgtgcagcctctggattcacctttagcaactatgccatgagctgggtccnccaggctccaggggaagggctggagtgggtctcaactattagtgctaggtggtgccaccanatacacgcacnctccgtgaacggccatcaccatcncagagacaattccaagaacacgctgtatctgacaaatgaacagccngagacgccgaggaccacggccgtatacttactgtagacggaaaggtaactttaccccgtattaccttttagacttacgtcgggtaccacgggtaccctggtaccc

SEQ ID NO: 249854 - DNA, 498 bp, Homo sapiens
  misc_feature: GYAE6OF02FXK4K.13.4.A04.1.454.CMB.1.raw
  modified_base (190)..(190): a, c, t, g, unknown or other
  misc_feature (190)..(190): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcgagtcaggacattaacaactatttaaattggtatcagcagaaaccaggtaaagcccctaagcctcctgatctacgatgcatccaaattttgggaaacaggggtcccatcaaggttcagtggaagtggatcgtgggacagtattttacttcaccatcagcagcctagcagcctaggaagatagttgacaactattaattactgtacagcagtatgatatctccatccacgttcgacaggacacgactggaatattaaaccgactggtacgctagacctactacg

SEQ ID NO: 249855 - DNA, 566 bp, Homo sapiens
  misc_feature: GYAE6OF02GFKR5.13.4.A04.1.454.CMB.1.raw
  modified_base (542)..(542): a, c, t, g, unknown or other
  misc_feature (542)..(542): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagcgtgggccctggtcccaggcagcgcgtcggccctgctgctgctgggtctggccagtcgtcgcccagtcggcctggctcgccgcccgtaatcggttcgcgacccgacgaaacggccggggaacccacggacccgtcggacgtcctcgacggttggaacgtcgagccgatccgagccgcgcggcgccgtggtcgggcgcggtcacggcccgaacggcccgaacccncgtacgccaccttcctccgtcccc

SEQ ID NO: 249856 - DNA, 589 bp, Homo sapiens
  misc_feature: GYAE6OF02HM0OI.13.4.A04.1.454.CMB.1.raw
  modified_base (322)..(322): a, c, t, g, unknown or other
  misc_feature (322)..(322): n is a, c, g, or t
  modified_base (473)..(473): a, c, t, g, unknown or other
  misc_feature (473)..(473): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtgcccctgaacctgaaggccaagtgagaccaagacaggaccaagtgggtgtcgacgaccccgtgaggngcgtcgggccctcggtcccaggcaggcgcgtcggcccctgcctgcgtgcgtgggtctcggcctagtcggtccgcccgagtcggccgtgctcggccgacccgtaagtcggttcgcgaccgacgaaacgggccggaaccacgacccgtggacnccgtcgacggttggaacgcgtacgccgagccgacgccgtcgcggacgccgtggtcggcgacggccacggacccgaacggcccaacccgtcacgtacctaccgttctaccgtacccc

SEQ ID NO: 249857 - DNA, 582 bp, Homo sapiens
  misc_feature: GYAE6OF02FMNJC.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtgggttgtgagacccctgaggagctgggccctggtcccgaggcaggcgcgtcggcccctgctgctgctgggtctggccatcggtcgcccagtgcctgctcgccgccaatcggttgcaccgacgaaacggccgggaacccacgaccccgtaggaccgccgtcgaacggttggaacgcgacgcccgagtccacgtccgtcggcggacgccgtggtcgggacgaggtccgacggcccgtaaacggaccccaaccccgacgtcgtaccaccgtctaccgttaccccccg

SEQ ID NO: 249858 - DNA, 543 bp, Homo sapiens
  misc_feature: GYAE6OF02FI43C.13.4.A04.1.454.CMB.1.raw
  modified_base (341)..(341): a, c, t, g, unknown or other
  misc_feature (341)..(341): n is a, c, g, or t
  modified_base (438)..(438): a, c, t, g, unknown or other
  misc_feature (438)..(438): n is a, c, g, or t
  modified_base (496)..(496): a, c, t, g, unknown or other
  misc_feature (496)..(496): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggccagtcaggacattaacagttatttagtctggtatcagcaaaaaccagggaaatccctaagctcctgatctatgtgcatccactttgacaaaggtggggtccatcaaggttcagcggcagtgatcgngggacagaattcactctacacaatcagcagccctgcacgtcctagaacgtattttcggactaaactttattactcgttacaaactagtactttaaanacgtttacccgcttacgtaggtttccgggacgggtaagggaccctaagggtcgggaanacgtacgaaaccgtaacttggtacggactggacctacactcgttacg

SEQ ID NO: 249859 - DNA, 534 bp, Homo sapiens
  misc_feature: GYAE6OF02GYM69.13.4.A04.1.454.CMB.1.raw
  modified_base (363)..(363): a, c, t, g, unknown or other
  misc_feature (363)..(363): n is a, c, g, or t
tcagtcacgtactacacgaccggtgctcgatttagagtagtgatcagggggagtcagtcccaaccaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgccttgcaagtcggggtcccatctcggttcagtggcggtggatctaggacagaattcactctcaccancaccaactgcaccctgaacgatgtggtaagttattactgtcacgtacctataggtaggtcggcccgtctctagttttccgggcggacgggaaccgagggtcgcgaaggtacgtaccgaaaccggtaacttggtaggcgtacgtacacccagttaccttggttaccttaccg

SEQ ID NO: 249860 - DNA, 538 bp, Homo sapiens
  misc_feature: GYAE6OF02HBV41.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtcctgcatctgtaggagacagagtcacctatcacttgccaggcgagtcaggacattaacaacgtaatttaaattggtatcagcagaaaccagtaaacgcccctaagctcctgatctacgatgcatccaatttggaaacagggtccagtcaaggtcagtggaagtggatcgtagggacagtattttactttcacgtatcagcacgctgcagcctagaatatatgaccaagtataattactgtacagtcaagttatagtattaagtcccttacccgattaccctccgttaccggaccgaaacgggaccacgacgttacggaagtaacgttaaacggacttagggtacggtacgtagaacccg

SEQ ID NO: 249861 - DNA, 668 bp, Homo sapiens
  misc_feature: GYAE6OF02HUQE7.13.4.A04.1.454.CMB.1.raw
  modified_base (194)..(194): a, c, t, g, unknown or other
  misc_feature (194)..(194): n is a, c, g, or t
  modified_base (270)..(270): a, c, t, g, unknown or other
  misc_feature (270)..(270): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcgagtcaggacattaacaactattaaattgtatcagcagaaacaggtaaacncccctaagctcctgatctacgatgacatacctaagtttacggaaaacgtacggggtacccaagttaccgtaaagggtttcaaggttgggaaaggtgggtattcgtaggggacaggtttactttttaaccgtttcaaccctataccgaagtaccgaacgtcccttagctaacggccctaggaaagtaacgttagtttacgactaaacgtaattactttaacctaggtacctaagggtacctaaggttaatacgtaaattaaccttaccgttaaccccgtaagttacccgttacccgtttaccgggaacccggtaaaaggggaccctaaacggtacccggttaagggaacgttaaacgttaaaaccggaagtttcgggttacggtacgttacggtaaccc

SEQ ID NO: 249862 - DNA, 578 bp, Homo sapiens
  misc_feature: GYAE6OF02FTABP.13.4.A04.1.454.CMB.1.raw
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
  modified_base (492)..(492): a, c, t, g, unknown or other
  misc_feature (492)..(492): n is a, c, g, or t
  modified_base (548)..(548): a, c, t, g, unknown or other
  misc_feature (548)..(548): n is a, c, g, or t
tcagtcacgtactacacgaccggtgctcgatttagagtagtgatcagggggcagttggtagatgcccctctgggagagatccccagggtgacagccatggaccctggaaggcctgggctaggacagggaccagagccagtccagggagaggacagagccaatggactggggtgtactgtaacagccctgctggcgagagggaccagggcaccgtcctccagggacgcccatgctgcaagtcgggccagaggtgcccctgaacctgaaggccaatgagacccaagacaggccaagtcgggttgtgacgacccctgaggagctgggccctggtcccaggcagcgcgtcggcccctgctgctgcgtgggtcctggccagtcggtcgcccgatcgggcctgcctcgccgccaagtcggtnccgaccgacgaacggccgggacccacgacccgnggaccgctcgagttcgggaactcgagccgactccgacgtccgngtcggacgtccgtgggtcggcgtacggtcaccggtacccgaaccgacccgaacccncgtccgcctaccgtccgttcgttacccccc

SEQ ID NO: 249863 - DNA, 537 bp, Homo sapiens
  misc_feature: GYAE6OF02HMVMH.13.4.A04.1.454.CMB.1.raw
  modified_base (348)..(348): a, c, t, g, unknown or other
  misc_feature (348)..(348): n is a, c, g, or t
  modified_base (402)..(402): a, c, t, g, unknown or other
  misc_feature (402)..(402): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaaacgcccctaagctcctagatactacgatgcatccaatttggaaacaggggtcccatacaaggttcagtggaagtggatcgngggactagtattttacttcacatcagcagcctgcagcctagaatatatgacaanattattatgtacagcaagtatagattaatcctccgtactctacccgttcggaccctaagggaccaacggtaccgtagggaacgtaacgtttaaaccggaacgttaggtacggaccttacggaccctaacgtaccg

SEQ ID NO: 249864 - DNA, 583 bp, Homo sapiens
  misc_feature: GYAE6OF02G2C4Y.13.4.A04.1.454.CMB.1.raw
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
  modified_base (466)..(466): a, c, t, g, unknown or other
  misc_feature (466)..(466): n is a, c, g, or t
tcagtcacgtactacacgaccggtgctcgatttagagtagtgatcaggggtctgagagaggagcccagccctgggattttcaggtgttttcatttggtgatcaggactgaacagagagaactcaccatggaatttgggctgagctggcttttcttgtggctattttaaaggtgtccagtgtgaagtgcagctggtggagtcgtgggggaggcttggtacagcctgggaggtccctgagactctcctgtgcagcctcgtggattccacctttagcaactatcgccatgagcgtcggggtcccgccgaggcctaccgaagggggaacggggctagggagttggggtcctacaacttagttaggtgcttaggtgggtcgcccaaccgacatactaccgcagacctccggaggaacgggccgattccaccntcctccaganacaattaccaaagacacgctgtatcgtanacaaatcgaacacgtcagagacgccgacgggacaccgggcgtatattacgtggctacggaaagtaaacctttacccctattactttacgaccttacggcgggccgtacgggtacccg

SEQ ID NO: 249865 - DNA, 765 bp, Homo sapiens
  misc_feature: GYAE6OF02F49LC.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccatcacttgccaggcgagtcaggacaattaacaacttaatttaaatgtatcagacaagaaacaaggtaaacgaccctaagcctctagatctacgatgactactacctaagtttacggaaaccgtacggggtacccaagttaccgaaaggtttacaagggtaggaaggttaggtagttcggtaggggaactaagtttaacttttttaacctttaccgaaccctaagttacgaacggtacctaacggtcccgtaggtacccgtaacggtaccctaagggtaaacgttaaacttaacgtttacggaaacctaaaaccgttaaagtttaaaccttttaaccgtacggttaaccaacggtaaccgttaaaggtttacttaaacgttaaacgtttaaaccttacccgttaaccccgtaaacttaaccccgttaacccggttaccccgggaacccggaaacggggtaaccctaaacgggtaaaccgttaaggggtaaaaccgttaaacggtttaaaaacccggaacggtttacgggtaaccggtaccgttacggacccctaacccgttaac

SEQ ID NO: 249866 - DNA, 536 bp, Homo sapiens
  misc_feature: GYAE6OF02F1KES.13.4.A04.1.454.CMB.1.raw
  modified_base (194)..(194): a, c, t, g, unknown or other
  misc_feature (194)..(194): n is a, c, g, or t
  modified_base (375)..(375): a, c, t, g, unknown or other
  misc_feature (375)..(375): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcgagtcaggacataacaactatttaataggtatcagtcaagaaccaggtaaacgaccccgtaagctcctagatctacgatgcatccaatttggaaacaggggtccatcaaggtcagtaggagtggatctgggacagtacttttacttacacatcgancagtccgtgcagtcctagaacgtattatgacaactatattactgtcagctacgtaatcgaattaactactaccgatcctaccgttcggaccgtaaagggaccgtaacgaccgtaggtaagtaacgttaaacggtaaccgttggtacggtacgtgtaacccg

SEQ ID NO: 249867 - DNA, 697 bp, Homo sapiens
  misc_feature: GYAE6OF02IPVI5.13.4.A04.1.454.CMB.1.raw
  modified_base (191)..(191): a, c, t, g, unknown or other
  misc_feature (191)..(191): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctccctgtctgcatctgtagganacagagtcaccatcacttgccaggcagtcaggacattaacaacttaattaaatgtatcagcaagaaacaggtaaacaccctaagctacctagactactacgatgacactacctaaatttacggaaactacggggtaccaagttacgaaaggtttacgaaggttagggaagttacggattacgtaacggtaacgtaagttaactttttacgtttaccaacctattacgaacgtctaacgtcccgttagaccgtaacgtacctaagtaacggtaattaacgttacggaactaaactaattaacgttaacttagtaccgttaagacgttaaagttacgtacgtaaattaacgttacccgttaaccccggtaattacccgttaacccgtttaccgggaacccgtaaacgggtaacccttaaaccgggaaccggtttaaggaaacggttaaccggtttaaaaaccggtaacgttacgggtacggtaccggttacgacccgtaaccttacgg

SEQ ID NO: 249868 - DNA, 625 bp, Homo sapiens
  misc_feature: GYAE6OF02F9QVV.13.4.A04.1.454.CMB.1.raw
  modified_base (228)..(228): a, c, t, g, unknown or other
  misc_feature (228)..(228): n is a, c, g, or t
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgccctgaacctgaggccaatgagaccaagacaggccaagtggttgtgagaccctgaggagcgtgggcctgggtcccaggcagcgctcggcccctgctgctgctgggtcnggcagtcgtcgccagtcggcctgcctgccgccaagtcgggttcnccaccgacgaaacggccggggaacccacggacccgtcggacgcccgttacgaggttacggaaaggccgacgcccgtaacgtccgaacggtcccgtcggaccgggtacgtcccggtgggtcgggggtcgaacggggtaccacgggaccccccgtaagggacccccaacccccggacgttacccggtacccgtaaccgttcccgttaccgttaccccccg

SEQ ID NO: 249869 - DNA, 536 bp, Homo sapiens
  misc_feature: GYAE6OF02IDJPC.13.4.A04.1.454.CMB.1.raw
  modified_base (271)..(271): a, c, t, g, unknown or other
  misc_feature (271)..(271): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaacttattaaattggtatcagcagaaacaggtaaancccctaagctcctgatctacgatgcatcctaatttggaaacgtacggggtcccaatcaaggttcaggtggaagtggatcgtggactagtattttactttcacctatcagcagcctgccagacctgaagtattattgacaactattattactgtacagcaagtatagaacttaatcctacccgtattccctaccgtttaccggacctaacgggacctaacggtactaggaagtaacgttaaacggacgtaggtagaccgttgaccc

SEQ ID NO: 249870 - DNA, 617 bp, Homo sapiens
  misc_feature: GYAE6OF02JD6EP.13.4.A04.1.454.CMB.1.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
tcagtcacgtactacacgaccggtgctcgatttagagtagtgatcaggggcgaggagtcagtcccaaccaggacacagcatggacatgagggtccctgctcagctcctgggctcctgctgctctggctctcaggtgccagatgtgacatccagatgacccagtctccatcctcccgtgtctgacctatctgtaggganacagagtccaccattccacttgccaggccagtcaggacataanactattaatgtatcagacagaacagtaacnccctanctaccagatctacgatgacatactaattacggaacncgggtacccagtacgaaggtttcgagtacggtaaggtcggtagttacggtacggggtaactaggttactttttaacgtttcaaccctatcgtaacgtcgaagtcccttaggcctacgtcgtacggaattgttaattgaacctacgtaattaccgtttacagtccgtaagtactaagttattagtaataaacgtcccgtaaccctagttaccccacgtttacccgggaccgtaaagggtaccaaacgggttcaacggggtaataaacctttacgggaaccgttaggtccgggtacttaccggacc

SEQ ID NO: 249871 - DNA, 490 bp, Homo sapiens
  misc_feature: GYAE6OF02GX3XI.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaattggaaacaggggtccatcaaggttcagtggaagtggatctgggacagtatttttactttcactatcagcagcctgcagcctagagtatattgacaacatattactgtcagatagtatagattaatctacccgatccaccttcggaccaaggaccacgacgtgagtactaacgactggtagctagac

SEQ ID NO: 249872 - DNA, 526 bp, Homo sapiens
  misc_feature: GYAE6OF02HQJY5.13.4.A04.1.454.CMB.1.raw
  modified_base (269)..(269): a, c, t, g, unknown or other
  misc_feature (269)..(269): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattgtatcagcaagaaaccaggtaaacncccctaagctcctgatctaacgatgcataccaatttaggaaacaggggtacccatcaaggttcagtaggaagtggatcgtgggaactagtattttacttcactatcagcagcctgcagcctagaagattattgacaaacattaagttactgtaccagtacagttatagaataactcctacccgatcctaccgttccgacgaaggaccaacggtactagggaactaagttaaacgacgtggtgctacggactactacg

SEQ ID NO: 249873 - DNA, 596 bp, Homo sapiens
  misc_feature: GYAE6OF02I34I7.13.4.A04.1.454.CMB.1.raw
  modified_base (212)..(212): a, c, t, g, unknown or other
  misc_feature (212)..(212): n is a, c, g, or t
  modified_base (524)..(524): a, c, t, g, unknown or other
  misc_feature (524)..(524): n is a, c, g, or t
tcagtcacgtactacacgaccggtgctcgatttagagtagtgatcagggggcaggagtcagtcccaaccaggacacagcatggacatgggggtccctgctcagctcctggggctcctgctgctctggctctcaggtgccagatgtgacatccagatgacccagtctccatcctccctgtctgcatctgtaggagacagatcaccatcacttnaccaggcgagtcaggacattaacaactatttaaattgtatcagacaagaaaccaggtaaacgccctaagcctcctagactactacgatgacatcctaaagtttaggaaaacgtcggggtaccaagtacgtaaagttcaagggttaggaaggtagggacttcggtagggtaactaagttaactttttacctttacaaccgtaattccgaacgccgtaagcccgttagacctagtacctaggaaagtacttagttaagacctaaactaattacttactgttaccaagactaagtatagtaactagtcctaccgnttaccaccgtcgaaccgaaggacacgtaagtgaagtaattaaacggacgttggtacgattacggacctaacg

SEQ ID NO: 249874 - DNA, 633 bp, Homo sapiens
  misc_feature: GYAE6OF02JNZ9Q.13.4.A04.1.454.CMB.1.raw
tcagtcacgtactacacgaccggtgctcgatttagagtagtgatcaggggcgaggagtcagtcccaaccaggacacagcatggacatgagggtccctgctcagctcctgggctcctgctgctctggctctcaggtgccagatgtgacatccagatgaccccagtctccatcctcctgtctgcatcctcttggagaccagagttcaccgtcaccttgcccggcgtagtcacgactattaacacttagttactacctggtactactacgactacgaagaccgaggagacgtacccgtaaattattagtatactctgctacgcgtccgtcctcgtctaacgtccggggtcccagtccgttcgtcgtagttggcggtggtagtacgtacggactacgattctactcgtcacctacgtaccaaccctaccgtcgacctacctacgaagtacgtacgtttagtaacgtttaacttacgttacgtactaacgtaccttacgttaacggttcggtaccggtacccgtacttaccgtacggttttacgggcgggttaacgggtaccgtaacgggtcgtacgtagtaacgtaaccgaaaccgttacgtacggttcggacgttacggtaaccaccgttagtccg

SEQ ID NO: 249875 - DNA, 586 bp, Homo sapiens
  misc_feature: GYAE6OF02FPTQI.13.4.A04.1.454.CMB.1.raw
  modified_base (373)..(373): a, c, t, g, unknown or other
  misc_feature (373)..(373): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtgggttgtgagacccctgaggagctgggccctgggtcccaggcagcgcgtggcccctgctgctgctgggtctggcngtggtcgcccgagtcggcctgctcgcgcccagtcggttgctaccgcgaaaggccggggacccacggaccctgggacgccgtcaggttgaagcgagccgagtccgagccgtgccggagccgtaggtcggggcgtagggtccgacggtacccgaaccgggacccaaacccccggcgttaccggtaccctaccgttccctacccgtttaccccccg

SEQ ID NO: 249876 - DNA, 557 bp, Homo sapiens
  misc_feature: GYAE6OF02FIZ4N.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccaatggttgcaccgcaaacgccggggacccaggacccctggacgccgtcacggttggaacgccgagcccgatcccgaacgccctggccggacgccgtggcggggcgaagggtcacggccccaacggcccaaccccgacgtcgtccaccgttctccgttccccc

SEQ ID NO: 249877 - DNA, 680 bp, Homo sapiens
  misc_feature: GYAE6OF02H5RRZ.13.4.A04.1.454.CMB.1.raw
  modified_base (473)..(473): a, c, t, g, unknown or other
  misc_feature (473)..(473): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgaccctagtctccactccctccctgtcctgcatctagtaggagacagagtcaccatcacttgaccaggtcgagtcaggactaattaacaacttaatttaaaattggtatacgagtacaaagaaaccaaggttaacgacccctaaagccgtactagactactaacgatcgactaacgttacctaaagtttacgggaaaccgtacggggtacccaagttacgaaacggtttgaaggtagggtaagtacggtaagtacgagggtacctaagtttactttttaccgtaccgactagtactagtccagtcctagcagaccgttanaaacgtacttaagcgaacctaaactagttaaccttacgtcgtaacacggttaactaaggtagttaacgaaactttaccttacccggtacctaaccttacccgttaaccgttccggggaaccgttaaacggggttaccaaccggtaacggtagtaaacgtaaaccgttaacgtaagttccggaggtaccctacggtccaaacctttcg

SEQ ID NO: 249878 - DNA, 780 bp, Homo sapiens
  misc_feature: GYAE6OF02G9UIA.13.4.A04.1.454.CMB.1.raw
  modified_base (250)..(251): a, c, t, g, unknown or other
  misc_feature (250)..(251): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcagtcagacattaacaactattaatgtatcannagaacagtaacgccctaagctcctgatcgtacgatgacattacctaaagttttacgggaaaacgtacgggggtcccaagttacgtaaacgggtttcaacggttaggggtaaacggttagggtaacgttacggttaggggtaaaccgttaaggtttaacgttttttttaaccgttttaacccgtaacccgttaacgttaccgtaaggtaccctaacggtacccgttcggaccgtacggtacccgttaaggaaacgttaattaacggtttacgaaccctaaaccgttaaattaacttttaaccgttacgggttaacctaacgggtacctaaaggtttaacgttacggttaaacttaaaccgtttcccgttaaaccccggtacgttttaaccccgtaaccccggttttaccggggaaccccggtaaaaccgggggtaacccgtaaccggtaaccggttaacggggtaaacgttaaaaccgttaaacccgggttaaacgttaccggggtacggtaccgttaccgtaaccccgg

SEQ ID NO: 249879 - DNA, 539 bp, Homo sapiens
  misc_feature: GYAE6OF02ITSO0.13.4.A04.1.454.CMB.1.raw
  modified_base (416)..(416): a, c, t, g, unknown or other
  misc_feature (416)..(416): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgttacatccagatgacccagtctccatccctccctgtctgcatctgtaggagacagagtcaccatcacttgccaggcgagtcaggacattaacaactattaaattggtatacagacagaaaccaggtaaacgacccctaagcctcctagatctacgatgcactaccaagtttacggaaactacggggtcccagtacgtaaggttacaggtggtaagtggatacgtgggactaagtattttactttcaccgtatacagcagtcctgacagcctagaanatattacgacaactattattactgtacagactagtatagattactctaccgtatcctaccgttcgaccgaggacaggcctaggacgtaacgtaacgtaacgtgtacggtctgactaccatccg

SEQ ID NO: 249880 - DNA, 610 bp, Homo sapiens
  misc_feature: GYAE6OF02GZCEF.13.4.A04.1.454.CMB.1.raw
  modified_base (416)..(416): a, c, t, g, unknown or other
  misc_feature (416)..(416): n is a, c, g, or t
tcagtcacgtactacacgaccggtgctcgatttagagtagtgatcaggggtctgagagaggagcccagacctgggattttcaggtgttttcatttggtgatcaggactgaacagagagaactcaccatggaatttgggctgagctggctttttcttgtggctattttaaaaggtgtccagtgtgaagtgcagctgggtggagtctggggggaggcttgggtacagcctggggaggtccctgagactctcctgtgcagcctctggaatcactttcagtgacgcctggatgaactggtccgccaggctccgagggagggctgggagtgggattcgggaccgttaagttaaaaggtgagtccgtaggagtgggtagggacaacgagactacgctgccaccgtgaaggcagacttcactntctcagagatagtatacgaaggaaccaacgtagttcgttactagaactaaagtcggaaacacgtaccgtacggaccgtacgggacccggggtactaccggtcgtcccggttagttaaccgtttacgtcgggttccgacccgagacctacggccgtaacggttaccccgtgggtacccctactttatttttacgg

SEQ ID NO: 249881 - DNA, 654 bp, Homo sapiens
  misc_feature: GYAE6OF02ITFJH.13.4.A04.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (377)..(377): a, c, t, g, unknown or other
  misc_feature (377)..(377): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaagtcgggccaggnggtcgcccctgaacctgaaggccaatgagacccaagacaggccaagtggtgtgagaccccgtgaggagcgtgggccctggtcccaggcagcgctcggcccctgcctgctcgcgtggtctcggcngtcggtcgcccgagtcggccgtgcgtcgccgacccgtaatcgggttcgccaccggaccggtaaaccggcccggggaacccgtacggaccccgtcgggacgcccgttcgacggttcggaacgcgaacgtccgactaccgacggccgtcggaccggacggtccggtcgggtcggggacggtaccgggtccggaaccgggaccccgtaaccgggacccctaaccccgaccggttacccgtcccgtaacccggtttccccgtcccggtttaccccccccgg

SEQ ID NO: 249882 - DNA, 523 bp, Homo sapiens
  misc_feature: GYAE6OF02H9IY7.13.4.A04.1.454.CMB.1.raw
  modified_base (308)..(308): a, c, t, g, unknown or other
  misc_feature (308)..(308): n is a, c, g, or t
  modified_base (403)..(403): a, c, t, g, unknown or other
  misc_feature (403)..(403): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaatgtatcagcagaaaccaggtaaacgcccctaagctcctgatctacgatgcatccaatttggaaacngggtccatcaagttcagtgaagtgatctaggacagtattttacttcaccatcagtcagcctgcagcctagaagtatattgacaacattacttacngtacagcaagtatagattaatcctacccatccgaaccttcggacctaagggaccaacgaacgtagggaaagtaacgttaaaaaccggacgttaggtacggtactacggacctaacgtacg

SEQ ID NO: 249883 - DNA, 517 bp, Homo sapiens
  misc_feature: GYAE6OF02HD943.13.4.A04.1.454.CMB.1.raw
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
tcagtcacgtactacacgaccggtgctcgatttagagtagtgatcagggggagtcgagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaatggtatcagcagaaccaggtaaacnccctaagctccgtgactctacgatgcatccaattggaacngggtccatcgaaggttcagtggagtgatcgtggacagtatttacttcactatcagcagcctgcagcctgaagtatatgactaactattatactgtcagtctagtatgaataactccgtaccgtactcctaccgttcggaccgaagggaccgtacggacgtaggtaagtaacgttaaacgacgttcggtcggtctacggtacctacgtacg

SEQ ID NO: 249884 - DNA, 691 bp, Homo sapiens
  misc_feature: GYAE6OF02I0NEK.13.4.A04.1.454.CMB.1.raw
  modified_base (329)..(329): a, c, t, g, unknown or other
  misc_feature (329)..(329): n is a, c, g, or t
tcagtcacgtactacacgaccggtgctcgatttagagtagtgatcagggggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccggtcctccgagggacgcccatgctgcaagtcgggccaggaggtcgcccctgaacctgaaggccaatgagacccaagacacggccaaggtgggtgtgacggaccccgtggaggngccgtgggcccgtggtcccaggcagcgcgtcggccctgctgctgcgtggtcgtcggccagtcgggtccgcccgtacgtcggccgtcggtcgtcggcccgacccgaagttcgggttccggccgtaaccggaccggaaaccgggacccggggaaccccgacggacccccggtacgggtaccggcccgttaccgtacgggttacgggaacggtaccgaccgggacccgaactcccggaacgccggtacggcggacggtcccgtcgggtgggaccggtacgggtacccgacgggaaccccgtaacggacccccgtaaacccgaccgttaccgtacccgacccgttccgttcccggttacccccccg

SEQ ID NO: 249885 - DNA, 594 bp, Homo sapiens
  misc_feature: GYAE6OF02G261L.13.4.A04.1.454.CMB.1.raw
  modified_base (196)..(196): a, c, t, g, unknown or other
  misc_feature (196)..(196): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtcctccatccctccctgtctgcatctgtagganacagagtcaccatcacttgccaggcgagtcagacattaacaactatttaaattgtatcagcaagaaaccaggtaaacgcccctaagcctcctgactctaacgatcgacatacctaatttaggaaaacgtacggggtacccagtactaaggttcaaggttaggaaggtggtacttcgtagggactagttaactttttactttccacctatcacgtacacgtcctgcaggtcctagaagtattagtcgacaactattacttactcgtacgagtactaagttatagtaattaactcctacccgtacttacctacccgtttacggaccgtaaacgggtacctaccggaacgtacggaagttaacgttaaacggtacgttaggtacggtacgtagtaaccccg

SEQ ID NO: 249886 - DNA, 663 bp, Homo sapiens
  misc_feature: GYAE6OF02HY27W.13.4.A04.1.454.CMB.1.raw
  modified_base (228)..(228): a, c, t, g, unknown or other
  misc_feature (228)..(228): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagaccaagacaggaccaagtgggtgtgagacccctgaggagcgtgggccctggtcccaggcagcgcgtcggcccctgctgctgcgtgggtctggcctagtcggtcgcccgagtcggcccgtgcgtcgccgacccgaagtcggtcgccaaccggtacgaaaccgggccggggaacccaacggtacccgtgggacgtcccgtcgtaggttacggaacggtaccgacggcccgtaacgtcccgaacggtcccgtacggaccgggaccgtccggtacgggtcgggggaccgtacggggttaccgaacgggacccccgtaaacgggaccccctaaacccccggacgttacccggtaccctaaccgtttcccgtaccggtttacccccccgg

SEQ ID NO: 249887 - DNA, 590 bp, Homo sapiens
  misc_feature: GYAE6OF02IHAK3.13.4.A04.1.454.CMB.1.raw
  modified_base (190)..(190): a, c, t, g, unknown or other
  misc_feature (190)..(190): n is a, c, g, or t
  modified_base (268)..(268): a, c, t, g, unknown or other
  misc_feature (268)..(268): n is a, c, g, or t
  modified_base (291)..(291): a, c, t, g, unknown or other
  misc_feature (291)..(291): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctcctgtctgcatctgtagganacagagtcaccatcacttgccaggcgagtcaggacataacaacttatttaaattgtatcagcaagaaccaaggtaacncccctaagctcctgactctacgntgcatcaattggaaactgggtccatcgaagttcgagtaggagtgatcgtaggactagttacttttacgttacactatacagctacgcctagctagtcctagaagtacttatttacgaacctaaaccgtaatttacttaaccgtggtaacctagtacctaagttaagtagtaaacttacgttcctacccggtaattcccgtaacccgttccggacccgaaagggtccgaacggtaacttacgggaacgttaaaccgttaaacgacgttaggtaccggtacgttacggccctaacgttacg

SEQ ID NO: 249888 - DNA, 611 bp, Homo sapiens
  misc_feature: GYAE6OF02G1SBV.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtgggtgtgagacccctgaggagcgtcgggcctggtcccaggcagcgctcggccctgctgctgctgggtctggcagtcggtcgccgagtcggcctcgctcgcgcccgtaagtcggttcgccgaccgacgaaacggccggggaacccacggacccgtcggacgccgtacgtacggttcggaacgtcgacgccgaacgtacccgacgtcccgtaggccggtacgtccgtgggtcggggtacgtacgggtccaaccggccccgaaccggtacccgaacccccgcgtaccgtaccaccgttcccgtccgttacccccgg

SEQ ID NO: 249889 - DNA, 544 bp, Homo sapiens
  misc_feature: GYAE6OF02FYVIR.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcagacattaacaactatttaaattggtatcagcagaaaccaggtaaacgcccctaagctacctgatctacgatgcatccaatttggaaacaggggtccatcaaggttcaggtgaagtggatcgtagggactagtatttttactttcgaacctatcgagcaaggcctagcagcctaggaaatatattgacaaactattaattactagtcagtactaagtactagaattaattcctacccgattacctaccgttcggaccgtaagggacctaacgacgtaggaacgtaacgttaaaacgaacttggtaggactacggccaacctacg

SEQ ID NO: 249890 - DNA, 643 bp, Homo sapiens
  misc_feature: GYAE6OF02G283K.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcactatcacttgccaggcgagtcaggacattaacaactatttaatgtatcagcagaaacaggtaacgacccctaagcctcctagtactacgtacgtatcgacactacctaagtttacggaaaccgtacggggtccctaagtaccgtaaaggttcgaaggtacggaaggttcggtagtcggtagggtactagttactttttaccttacacctatacgagtaccgtagtccctgacctacgtacctaagaaacgtattacgtacgaacctaacttaacttaagtttaccgtaggtactaaggtaccgtaagttagttacgtaaacttaacgttccgttaacccgtattacccgtaacccgttcggacccgtaagggacccgtaacggacgttagggaaacttaacggttaaaccgtacgttaggtacggacctacgacctacctacgg

SEQ ID NO: 249891 - DNA, 698 bp, Homo sapiens
  misc_feature: GYAE6OF02HLWS4.13.4.A04.1.454.CMB.1.raw
  modified_base (192)..(192): a, c, t, g, unknown or other
  misc_feature (192)..(192): n is a, c, g, or t
  modified_base (299)..(299): a, c, t, g, unknown or other
  misc_feature (299)..(299): n is a, c, g, or t
  modified_base (330)..(330): a, c, t, g, unknown or other
  misc_feature (330)..(330): n is a, c, g, or t
  modified_base (359)..(359): a, c, t, g, unknown or other
  misc_feature (359)..(359): n is a, c, g, or t
tcagtcacgtactacacgaccggtgctcgatttagagtagtgatcagggggagagaggagcccagccctgggattttcaggtgttttcatttggtgatcaggactgaacagagagaactcaccatggattggctgagctggctttttcttgtggcttattttaaaaggtgtccagtgtgaagtgcagctggnggagtcgtgggggagcttggtacagccgtgggaggtccctgagtactctcctgtgcagcctctggattccaacctttagctaaactatgccatgagcgtgggtcccncgaggctacgagggagggctggagtggctanaacttagtacgtgctaggtgtcgcaccanatactagcagactccgtagaacgggcctaatttcccgaacctatcctacgaacgtagaactaacttaccgaaagtaacaccggtactacgttaactcctaggacctaaagtacgtaaaccacgtaccgtaggaagaccgggtaccgaagggtaacccgtccgggtaaccggttaattaacgtttaaccgtggggtaacgtaaccgggttaaaacggttaaacccggtttttacccctaaacgtttttaacccggttttacgtaacccggttaaccgggtttacccgggggggaacccgtaaacccgggggttaaccccggtttaggggttaaccccccg

SEQ ID NO: 249892 - DNA, 747 bp, Homo sapiens
  misc_feature: GYAE6OF02GU7Z2.13.4.A04.1.454.CMB.1.raw
  modified_base (254)..(254): a, c, t, g, unknown or other
  misc_feature (254)..(254): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccatcacttgccaggcgagtcaggactattaacaacttaatttaaattggtatnagacaagaaaccaggtaaacacccctaagcctacctgaacttccgtaacgatgacctatacctaaagttttaggaaaacgtacggggtacccaagttcgtaaacggtttcaaggggttaggaaacggtgggtaacttacggttacggggtaactagtttaactttttacctttaccgaaccgtaacttaccgagaccgaacggtcccttacggaccaacggtccttaaggtaaacgtacgtttaacttacgaacttaaaccgttaagtttaactttaaccgttcgttaaccgaacggttacctaaaggtttaacgttaagtaaccgtttaaacgtttcccggttaacccccgttacttaaccccggttaaccccgttaccggggtaaccccgtaaaggggaacccgtaaccggttaacggtacggggtaaaggttaaaaccgttaaacgggtaccggtttggtaccgggtactacggtaccctaaccgttacg

SEQ ID NO: 249893 - DNA, 723 bp, Homo sapiens
  misc_feature: GYAE6OF02I86TS.13.4.A04.1.454.CMB.1.raw
  modified_base (141)..(141): a, c, t, g, unknown or other
  misc_feature (141)..(141): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagntgtgacatccagatcgacccagtctccatccctccctgtctgctatcgtgtaggacgacaggagtcacatcacttgccaggcgagtcgagacataacactattaatgtatcagacaagaaccaggtaacgaccctaagctacctagtactactacgtatcgacactacctaagtttaggaaaacgtacggggttaccacgttacgtaaacggttgtaacggtagggaacggtaggtacgtacgtagggtaacgaaggtaacgtttccaacttacctaaccaactaacgtaccgaaggtaccaacggtccgtacgaccgacgttaccgtaagtaacggtttacgttttacggaaccctttaaagtttaccgttaacggtttaagtaacccttaaacgacgggtttaactttaaacggtttaacccggttaaacccgttcccgtttaacggtaacgggttttcccggggaagggtacccggtaaccgggtaaacggttcggggtaaaccgtacgtaaaccgtaaaccggttacggttacggttaacgggaccctttaggggaccctaccggtacgtttaaccgg

SEQ ID NO: 249894 - DNA, 530 bp, Homo sapiens
  misc_feature: GYAE6OF02FJPJG.13.4.A04.1.454.CMB.1.raw
  modified_base (195)..(195): a, c, t, g, unknown or other
  misc_feature (195)..(195): n is a, c, g, or t
  modified_base (403)..(403): a, c, t, g, unknown or other
  misc_feature (403)..(403): n is a, c, g, or t
tcagtcacgtactacacgaccggtgctcgatttagagtagtgatcagggggcagggagtcagtcccaaccaggacacagcatggacatgagggtccctgctcagctcctggggctcctgctgctctggctctcaggtgccagatgtgaccatccagatgacccagtctccatcctcctgtctgcatctgtagganacagagtcaccatcacttgccaggcgagtcaggacataacaactatttaaatggtatcagcagaaccagtaaacgccctaagctcctgatcacgatcgcatccaatttaggaaacagggtacccatcaaggtcaggtgaagtggatcgtagggacagtacttttacttcaccatcagcagcctgcagcctgaaatatagtcacaactntaattactatcagtcagttatacgattaactacctcccgtaatcctacccgttcgggaccgtaaacgggaccgaacgaacgttacgggaagtaacttaaacggtacgtaggtcggtactggtaaccc

SEQ ID NO: 249895 - DNA, 659 bp, Homo sapiens
  misc_feature: GYAE6OF02G9XT9.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaaggtcggccagaggtgcccctgaacctgaaggccaatgacgacccaagacaggccaagtgggtgtgacgaccccgtggaggagcgtcgggcccgtggtcccgaggcagcgctcggccctgctgctgcgtgggtctggccgtagtcggtcgccctagtcggcccgtgccgtcggccgccgtaagtcgggttcgaccgaccgaccggaaacgggccgggacccgaacggacccgtcgggacgtccgtacgtaggttcggaacgcgtaaccggccgacgtcccgacgtccgcggtaccggcgtccggtcggggtcggggaccggtacgggtaccggtaccggaccccggtaaaccgggcccccgaaacccccggtacgttacccggtaccgttaccccgttcccgttccccggttacccccc

SEQ ID NO: 249896 - DNA, 621 bp, Homo sapiens
  misc_feature: GYAE6OF02IXRX6.13.4.A04.1.454.CMB.1.raw
  modified_base (493)..(493): a, c, t, g, unknown or other
  misc_feature (493)..(493): n is a, c, g, or t
tcagtcacgtactacacgaccggtgctcgatttagagtagtgatcagggggagttcagtcccaaccaggacacagcatggacatgagggtccctgctcagctcctggggctcctgctgctctggctctcaggtgccagatgtgacatccagatgacccagtctccatcctccctgtctgcatctgtaggagacagatcaccatctacttcgacaggcgagtcaggactattaacaacttaattaattggtatcagacaacgaaaccgaacggtaaacgacccctaagcctaccgtagactactaacgatcgactaactacctaaagtttacggaaacgtacggggtacctagtacgtaaggttcaaggtggaacgtggatacgacgggtaactagttacttttacttacgactacgtacgacgaccaagtccgtcgtacgacgtccgttaagaaactaagttacgttagactaaacttacgttaattacgtanacgtaacgtataagttatagtaacttaactccgtaacctattacctaccgttcgaaccggtaggaaccacggtacgtacggtaactaaagttaaccgagtttacgcggtacttacggacctattacgg

SEQ ID NO: 249897 - DNA, 552 bp, Homo sapiens
  misc_feature: GYAE6OF02HI9OD.13.4.A04.1.454.CMB.1.raw
  modified_base (348)..(348): a, c, t, g, unknown or other
  misc_feature (348)..(348): n is a, c, g, or t
  modified_base (533)..(533): a, c, t, g, unknown or other
  misc_feature (533)..(533): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggcaagtcagggcattataaatgatttaggctggtatcagcaagaaaccagggaaacgccctaagctcttgatctatggtgcatcctaagtttaaaaagtggggtacccatcaaggttcagcggctagtggatcgngcacagacttcattcacaccagtcagcacgcctgcacgctagaagttatttacggccttaaacttattacctgtacttaacgaaagtactactaactaactttaacttccgtagggttaccgtccgggacccgtaagggaacccgtaaggtacggtaaaactaccgaaacgtaacgttgtacggntaccgactaccgtattccg

SEQ ID NO: 249898 - DNA, 779 bp, Homo sapiens
  misc_feature: GYAE6OF02J1GOP.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgaggagggaccagggcaccgtcctccagggagcccatgctgcaagtcgggccagacggtgcccctgacctgaaggccaatgagacccaagacgaggaccaaggtgggttgtgacgaccccgtgaggacgcgtcgggcccgtagggtccccgaggccgacgccggccgtcgggcccccgtggccgtgccgtcggccgttgggtccgtcgggcctagtcgggtccgcccgtagtcgggtcccttcgggccgtcggacccgtcccgtaaagttccgggttacgccgaacccggtaccggaaacgggtcccggggaacccgtacccggacccggttcgggaaccgtcccgttaccggtaacgggttcgggaaacggacccgaacgggtaccccgtaacgtcccggtaaccgtccccgttacgggacccgggtaccgtcccgggttaggggtaccggggtcggtaaacggggttacccaacccggggaacccccgtaaacccggggtaccccctaaaccccccggtacgttaccccggttaacccgtacccggtttaccccggttaccccggtttcccccccccggg

SEQ ID NO: 249899 - DNA, 560 bp, Homo sapiens
  misc_feature: GYAE6OF02GLDYC.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgactctacgatgcactccaatttggaaacaggggtcccatcgaaggtttcaggtggaagtggatcgtagggactagtatttttactcaccatcagcagcctgctagcctagaagattatgacaatattattactgtcagtctaagtatagaattaactaccttacccgattaccgtaacccgtttcggacccgaagggtaaccgacgtaaccggtaggtaaacgtaaacgtttaaaccggacgttaggtacgggaccttacgggaccctaacgttaacg

SEQ ID NO: 249900 - DNA, 627 bp, Homo sapiens
  misc_feature: GYAE6OF02HLR4Y.13.4.A04.1.454.CMB.1.raw
  modified_base (229)..(229): a, c, t, g, unknown or other
  misc_feature (229)..(229): n is a, c, g, or t
tcagtcacgtactacacgaccggtgctcgatttagagtagtgatcagggggcagttggtagatgcccctctgggagaaatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaaggtcggccaggaggtcgcccctgaacctgaaggccaatgagacccaagacaggccaagtgggttgtgacgacccctggaggagcgtgggccctggtcccaggcagcgctcggccctgctgctgctggtctggccagtcgtccgccagtcggcctgctcgccgcccgtaagtcggtcgccgacgacgaaacggccgggaacccacggtacccgtgggacgccctcgacggttcggaacgcgtacggccgagtcccgaaggtccgtcggaccggacgtccgtcgggtcgggggcctaaggggtccgaaccggtacccggaaaccggtccccgaaaccccgtcgttccggtaacctacccgttaccgttcccggttcccccgtaccccg

SEQ ID NO: 249901 - DNA, 534 bp, Homo sapiens
  misc_feature: GYAE6OF02HBY6E.13.4.A04.1.454.CMB.1.raw
tcagtcacgtactacacgaccggtgctcgatttagagtagtgatcagggggagtcgagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaatgtatcagcagaaaccaggtaaacgccctaagcctcctgactcagatgcatccaattggaaacagggtacccatacgaaggttcagtaggaagtggatcgtagggactagtattttacttcacctatcagcacgcctgcagcctagaagtatatgacaactatattactgtacagtacatatagtaataactcctaccgtacttcgtaaccgttcggaccgaagggaccaacggaacgtaggaacgtaacgttaaaccgtacgttacggtcggtactacgtacctacgtacg

SEQ ID NO: 249902 - DNA, 727 bp, Homo sapiens
  misc_feature: GYAE6OF02JKID5.13.4.A04.1.454.CMB.1.raw
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
tcagtcacgtactacacgaccggtgctcgatttagagtagtgatcagggggcaggagtcagtcccaaccaggacacagcatggacatgagggtccctgctcagctccgtggggctcctgctgctctggctctcaggtgccagatgtgacatccagatgacccagtcctccatcctccctgtctgcatctagtaggatacagacgtcaccatcacttgccaggcagtcaggacattaacaactattaatgtancaganaagaacctaggtaacaccctaagctacgtacgatacctagtatcgtctaactaccgtaagtttaggaaaccggacgggttaccctaacgtacgtaacggtttacaggtaagggtaacgtaggtacgtacgtacgggtaacgttagttaacgtttttactttaccaacctaagttaccaaacggtctaaaccggtccgttacgacgtaaccgtaccgtaagaaagtaacgtttctttaacgaacctaaacttaacgttaactttaccgtacggttaccaagttacggtaaacgttacttaacggaaactttaacgttaccccgttaaccccgttaaacggttaccctaccggttttaccccggaaacccgggtaaccgggtaaaacccgtcggtaaacccgttagggtaaacgttaaacccggtttaaaaccgttaccggttacgggtaacggggttcctaacggtaaccc

SEQ ID NO: 249903 - DNA, 667 bp, Homo sapiens
  misc_feature: GYAE6OF02HQE4H.13.4.A04.1.454.CMB.1.raw
  modified_base (364)..(364): a, c, t, g, unknown or other
  misc_feature (364)..(364): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgcctgcaaggtcgggccagaggtcgcccctgaacctgaacggtccaatgagaccaagacaggaccaaggtggttgtgacgaccccgtgaggacgcgtcgggccctggtcccaggcgagcgctcggcccngctgctgctgggtctgcagtcggccgccgagtcggcctgccgtggacccgaccctaagttcgggttcgccgaaccggtacgaaacggccggggaacccacggacccgtaggaccgccctggacggttgggaacgccgacgcccgacgtcccgacgtcccgaggtaccgggacgtccggtacggggtacggggtaccgacgggtacccgaaccgggtacccccggaaaccgggaccccccgtaaccccggtaccgtaccggttaccccgtaccgtttaccccggtacccgtttaaccccccccg

SEQ ID NO: 249904 - DNA, 584 bp, Homo sapiens
  misc_feature: GYAE6OF02HZ93H.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcgagtcaggacattaacaactatttaaattgtatcagcaagaaaccaggtaaacgcccctaagctcctgactctaacgatgacactacctaaatttacggaaacgtacggggtacccaatcgaaaggttcaaggtaggtaagtggaatcgtaggacaggttattttacttacgaacctatcagcagtcctgacacgcctagaacgtaattgttagactaactaattactactgtacagactagtactagaacttaactccgtaccgtattacccgtaccgttaccggaccggtaaacgggacctaacggtacgtaaggaacgtaacgtttaaaccggaacgttacgggtcggaccgttcgtaacccg

SEQ ID NO: 249905 - DNA, 588 bp, Homo sapiens
  misc_feature: GYAE6OF02FUDXU.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatccacttgccaggcgagtcaggacataacaactatttaaatggtatcagcaagaaaccaggtaaacgcccctaagctcctgatcacgatgcatccaatttggaaacaggggtccatcgaaggttcagtaggaagtggatcgtgggactagtattttaccttcactatacagcagcctgcacgcctagaaagtattaacttgactaaactaattatttaactacgttacaagtactaagtttaatgtaaactttaaactcccgttacccgtaattaccgacccgtttaccgggacccgtaaaacggggaccctaaccggtaaccggttagggaaacgtaaacgtttaaaaccgggaactttagggtacggtactcggtaaccc

SEQ ID NO: 249906 - DNA, 602 bp, Homo sapiens
  misc_feature: GYAE6OF02G8PN2.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatccctccctgtctgcatctggtaggagacagactcaccatcacttgccaggcgagtcgaggactaattaacaacttaatttaaagttggtaatcagacaagaaaccgaggtaaaccgcccctaagcctaccgtgactctaacgatcgactatacctaagtttagggaaaccgtacgggtacccaagtacgtaaaggttcaaggtagggaagtggtacttcggtagggaactaggttactttttactttaccaacctataccagtacacggtcctgcgaacgtccgtaagaagtacttacgtcgaactaattacttattactgtacagtctaagtatatatactcctacctatccaccgttacggacgtaacgggacctacggtaacgtaggaaagttaacttaaccggtaagttcgggtacgcgtacgacccg

SEQ ID NO: 249907 - DNA, 619 bp, Homo sapiens
  misc_feature: GYAE6OF02G9STW.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtcgcccctgaacctgaaggccaatgagaccaagacaggccaagtgggttgtgagacccctgaggagcgtgggccctggtcccaggcagcgcgtcggcccctgctgctgctgggtctggcctagtcgtcgcccagtcggcctgctcgccgccctaagtggttcgccgacgacgaaacggccggggaacccacggacccgtggacgccgtcgacggttacggaacgtccgacggcccgacgtcccgacggtcccgtcggccgggacgtcccggtgggtcgggggaccgtacgggtccgaaccgggaccccgaaccgggaccccaaccccgtacgttccggtaccaccgttaccgttcccgttacccccg

SEQ ID NO: 249908 - DNA, 623 bp, Homo sapiens
  misc_feature: GYAE6OF02IU3N2.13.4.A04.1.454.CMB.1.raw
  modified_base (230)..(230): a, c, t, g, unknown or other
  misc_feature (230)..(230): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaaatggactggggtgtactgtaacagccctgctggcgagacgggaccagggcaccgtctccagggacnccatgctgcaagtcggcagaggtcgccctgaacctgaaggccaatcgagaccaagacaggccaaggtggttgtgacgaccccgtgacggagcgtgggcccgtggtccaggcagcgctcggccctgctgctgcgtggtctggccagtcgtacgcccgagtcggccgtgccgttcggccgtacccgtaaagtcggttacgccgacccgacgtaaacgggcccggggaaccctaacggaccccgtggaccgtcccgtcgaaggttggaacgacacggaccgactcccgacgtcccgtaggaccggcgtaccggtggtcggggaccgtagggtcccgacgaccccggtaacggacccaaacccgctaccgtcctaccgttccgttaccggtaccccc

SEQ ID NO: 249909 - DNA, 691 bp, Homo sapiens
  misc_feature: GYAE6OF02IBZDW.13.4.A04.1.454.CMB.1.raw
  modified_base (544)..(544): a, c, t, g, unknown or other
  misc_feature (544)..(544): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccgagggacgcccatgctgcaaggtccgggccaggaggtcgccccctgaacctgaacggccaaatgagacccaagaccaggccaagtgggttgtgacgacccctggaggagcgtgggccctgggtcccaggcagcgctcggcccctgctcgctgcgtggtcgtggccagtcgtccgcccgatcggccctgctcggccgccctaagtggttcgaccgaccggtaccgaaacgggccggggaccccgaacggaccccgtacgggacgcccgttctaagggtttcgggaacgaccgaacgggccccgtagttacccgacgtccccngggtacccgggtaagggtcccgtgggtcggggggtccgaacggggttcccgaaccgggtacccccgaaaccgggaccccccgaaacccccggtaacccgttccggtaaccccgtaccttcccggtttaccccgtttaaccccccccg

SEQ ID NO: 249910 - DNA, 671 bp, Homo sapiens
  misc_feature: GYAE6OF02HS25R.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccatcacttgaccaggcgagtcaggacaattaacaacttatttaaattggtatcagtacaagaaaccgtaaggtaaacgcccctaagccttaccgtgactcctaacgtatacgcactaccgtaaagtttacggaaaaccgtcgggtacccaagttccgaaggtttcaggtagggaacgttggaacgttcggtagggaaccgtaagttaactttttacctttactaacctagtaccgaagtccaacgtcctacgcaacggtcctaaggaacgtaagttacgttagaacctaaataacttagtttaaccgttcgtacaaggtacctagttaagtacgtaacttaaacttccgtaacccgtaagtcccttaccgttcccggtaaccggaaaccgggtacctaaccggtaaccgtacggggtaacgttaaacgttaacggtaaccgttaggtacggtacgtaccgtacccg

SEQ ID NO: 249911 - DNA, 879 bp, Homo sapiens
  misc_feature: GYAE6OF02GI1MT.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgcctggcgagagggaccagggcacccgtcctccgagggacgcccaatcgcctagccgaaaggtccgggccaggacggtccgccccctacgaaccgtagaacggccgaaatcggaacgaaccccgaaagaaccgaacgggaccgtaaaagggttcggggtttaggtacggaaccggacccccggttaggaacggtacggccgtggggacccccttgggtacccccgaagggccgaggccgcggttccgggccccttggccttggccttagggtccggtcggggttacgtcgggtacctaggttccgggtacccggaccccgtaaggttccgggccccgttgggcccgtttccgggaccccgtaccccgttaaagggtttccgggtttacccggaccgaaccccgggaaccggaaaaccggggttcccccgggggaaaccccgaaacccgggtaaccccggttacgggaacccgggtaccttaccgggtaaacgggtttcggggaaacgtaacccggtacggaaccccggtaccgtacccggaacgtcccgtacggaccgggaccggttccgtcgggggtacgggaccggtaccgggtaacccgaccggtaaccccgaacccgggtaaccccaaacccccggtcttaacccggtacctaacccgttacccggttccctttaaccccccgg

SEQ ID NO: 249912 - DNA, 868 bp, Homo sapiens
  misc_feature: GYAE6OF02HLMGH.13.4.A04.1.454.CMB.1.raw
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgacccagtctccatccctccctgtctgcatctgtaggagacagagtaccaccatcacgttcgccgaggcgagtcaggactaattaacaacttaatttaaattggtatacagacaagaaaccgaggtaaacgacccctaagcctacctagactactacgatcgactactaccgtaaagtttaacggaaaccggtaccgggggttacccaagttaccgtaaacgggtttacgtaagggttaacgggtaaaggttacgggtaagtttaccgggttaaggggtaaacctttaaacggttttaaaccgttttttttaaacccgttttaacccgtaaaccccgtttaacgttacccgtaaacggtacccgtaaccggtaccccgttacggtacccgtaaccggttacccgttaaagggtaaaacggttaacgttttaacgttaaccgtaaacccgttaaaacgtttaacttttaaaccgtttaacgttaccggttaaccgtaacggtaccgttaaaaggtttacttaacggttaaactttaaacccgttccccgtttaaccccgtaaccgttacccgtttaaccccggttacccggggaacccgtaaaccggggtaacccctaaccgggttaaccgttaacggggaaacgtttaaaaccgttaaaaccggtaccgttagggttacccgggtacgttaacccggtacccgtaaccgttaccg

SEQ ID NO: 249913 - DNA, 720 bp, Homo sapiens
  misc_feature: GYAE6OF02IVCE1.13.4.A04.1.454.CMB.1.raw
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatccctctntctncactcgtaggtaggacacgagacgtaccactatacctacgtcgaccgacgggcgacgtacgaacggaacttaacttaaacctaaactttaaagttttaaagttaggttaactacgaacgtacgaaaacgaaaccggtaaacgggtaaacccgtaccccgtaagtcccttaccgtagtacgtaccgtacgtagtcgactacctaacgttaaggttaacggaaacggtaccgggtacctaacgtaacgtaacggttaccgtaagggtagggtaaggtaggtacgtacggtacgggtaacgtaaggttttacctttttaccgtaacctaccttactacgacgtaccgaaccgtccgtagaccgtacgtaccgtaagaagttaattaacgtacgtaaccgaaattacgtttaacttacgttacgtacgaacgtacgtaagttagtaagttaacttacgtacctaccgtactaccgtaccgtaccggacggaacggtacacgtacggtagtaactaacgtaacgtacgtgacgtccgctaaccg

SEQ ID NO: 249914 - DNA, 603 bp, Homo sapiens
  misc_feature: GYAE6OF02I1BG3.13.4.A04.1.454.CMB.1.raw
  modified_base (176)..(176): a, c, t, g, unknown or other
  misc_feature (176)..(176): n is a, c, g, or t
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (377)..(377): a, c, t, g, unknown or other
  misc_feature (377)..(377): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggancccatgctgcaaggtcggccagaggtcgcccctgacctgaagccaatgagacccaagacaggcaagtggtgngacgaccctgaggngcgtgggcctggtcccaggcagcgctcggcccctgctgctgcgtgggtctggccagtcggccnccgagtcggcctgcgtcgcgccagtcggtcgcgacgacgaacggccgggacccacgacccgtcggacgccgtacgacggttacggaacgcgacgccgacgtccgacgccgtggccgggacgccggtacgggtacggggtccgaacgggtccgaacgggtaccccgaaaccggaccccgaacccaccggttcccgtaccgtacccttaccgttaccccgttaccccc

SEQ ID NO: 249915 - DNA, 697 bp, Homo sapiens
  misc_feature: GYAE6OF02I6SPD.13.4.A04.1.454.CMB.1.raw
  modified_base (230)..(230): a, c, t, g, unknown or other
  misc_feature (230)..(230): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgcctgcaacggtcgggccaggaggtcgcccctagaaccctgaacggccaagtcgagaccccaagacacggccaaaggtggggttgtggaagacccccgtggacggaggccgtcggggccccgttcggtccccgagggccaggtcgccgtcggcccctggcctcgcgtcgccgtcggggtctggcctgtcggtccgcccgtagtcgggtcctcgcgtcggccgtccgtaagtcggtacgccaacgacgaaacgggcccgggaaccgacgacccgttacgggccgtaccgtcgtacggttacggaacgtccgacggtaccgacgttccgaacgcccgttcggaccggaccgttccggtacgggtacggggtaccggacgggttaccgaaccggtccccggaaaccggacccgaaaccccgtcggttacccgtaccgtaccggttcccttcccggttacccccgg

SEQ ID NO: 249916 - DNA, 729 bp, Homo sapiens
  misc_feature: GYAE6OF02JZSWY.13.4.A04.1.454.CMB.1.raw
  modified_base (242)..(242): a, c, t, g, unknown or other
  misc_feature (242)..(242): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccaggcaccgtccgacggacggcgcctagtcgtcgngacgacggtccggacgacggtacggtccaccgtacgaaccgtaggacgaccgtaagtacgaccgaacccgtaacgacgacgcgtaaggttggtagacgacgtaccgaggaggtacgcggtccgggtaccgtccgggtaccgaggcacgggtccggccgtccggcctcggtcgcgtcggtccgtcggttacgggtcgtcgaccgtcggtccggtcccgacggtcggtccgcgttcgtaccgtccggacccgtaccgttaggtcgtacgaccgtaccggacggaaccggaccggtaccgaccggtaccggcggtaccgtcggtacgtacggtacgaacgtaccgccgtaccgtccgaccggtacgccggtacgggaccgtaccgggtcggtccgggtacggtaccgaccgggtaccgccggaaaccccggtacccggacccctaccggtccgtaccgtacccgtacccggttccgttccccgtaccccg

SEQ ID NO: 249917 - DNA, 562 bp, Homo sapiens
  misc_feature: GYAE6OF02GYZ9X.13.4.A04.1.454.CMB.1.raw
  modified_base (190)..(190): a, c, t, g, unknown or other
  misc_feature (190)..(190): n is a, c, g, or t
  modified_base (405)..(405): a, c, t, g, unknown or other
  misc_feature (405)..(405): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcagtcaggacattaacaactatttaaattggtatcagcagaaaccaggtaacgcccctaagctctgatctacgatgcatcaatttggaaacaggggtcccatcaaggttcagtaggagtggatcgtggactagtattttactttcacctatcacgcagcctgcagcctagaagtactattcgacaaacttntaatttacctgtaccagactagtagtagtataacgttacctaccggtattaccctaccgttccggacccgtaacgggaccaacgggtaaccgtagggtaaacgtacgtttaaaaccggtaacgttcggtacggtacctcggaccgtaaccttaaccg

SEQ ID NO: 249918 - DNA, 779 bp, Homo sapiens
  misc_feature: GYAE6OF02GU9OZ.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtcctccatccctccctgtctgcatctaggtaggagacagagtcaccatcacttgccaggcgagtcaagacaattaacaactattaaattggtatcagcaagaaacaaggtaaacaccctaagcctctagatactacgatagacactacctaaagttacggaaaacgacggggtacccaagtacgaaaggtttcaaggtaggtaaaggtggtaagtaccgtaggggaactaaggttaacttttttaccttttacaaccgtaacgtactaacgacgtaacggtcctaacggtccgtaaacgtacccgtaagggttaaacggtaaacgtttaaagtttaacggaaccttaaaaccgtaaatttaaacggttttaaaccttcgggttaacctaaacggtaccgtaaaagggtttaacttaaggttaaaacgtttaaaccgtttacccgttaaaccccgttaaccgttaaccccgtaaccccgggttttacccgggaaaccccgggttaaaaacgggggaaacccttaaacccggggtaaccgttaaacggggaaacgttaaaaccgtttaaaaaccggtaaacgtttacggggtaacgggttaccgttaccggtaacccg

SEQ ID NO: 249919 - DNA, 731 bp, Homo sapiens
  misc_feature: GYAE6OF02H5AKL.13.4.A04.1.454.CMB.1.raw
  modified_base (614)..(614): a, c, t, g, unknown or other
  misc_feature (614)..(614): n is a, c, g, or t
  modified_base (674)..(674): a, c, t, g, unknown or other
  misc_feature (674)..(674): n is a, c, g, or t
tcagtcacgtactacacgaccggtgctcgatttagagtagtgatcagggggcaggagtcagtcccaaccaggacacagcatggacatgagggtccctgctcgagctcctggggctcctgctgctctggctctcgaggttgccagatggtgacatccagtatcgaaccctagtctccatccttcctgtcctgactattctggtaggacgacgagcgttccaacatccacgttcgacagggcagtacaggtaacaatttaaccaaatttaatttaaaagttttcggtaatccgaagtaccaaacggtaaaacccgtaagggttaaaacaccccccgtttaaaggcccttaaccgtgaacgttccgtaacgtacgtcgtactaacttaccttaaagtttacgggaaaccgtcgggtaccctagttaccgtaaggtttcgaaggttggggaactacggattcggtaaggggacttaaggtttacctttttacctaccgtaaccagttacgacgacctaacgcccgttgaccgacgtaccttaaggtaagttactttaggtaaccttaaagttactttaactcgaaacttaacgattaacctttaagaccgtttaaccncgtttaccgtacgggttaaccgggaacggtacggggtaaccgttagggtactacggtaanaaccggtaaacggtaagttcggtacgtctaccgtactaactcttccgttagttaccc

SEQ ID NO: 249920 - DNA, 647 bp, Homo sapiens
  misc_feature: GYAE6OF02JSOIV.13.4.A04.1.454.CMB.1.raw
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (519)..(519): a, c, t, g, unknown or other
  misc_feature (519)..(519): n is a, c, g, or t
tcagtcacgtactacacgaccggtgctcgatttagagtagtgatcagggggcagttggtagatgcccctctgggagagatccccgaggggtgacagccatggaccctggaagggcctgggctagggacagggaccagagccagtccagggagaggacagagccaatggactggggtgtactgtaacngcctgctggcgagnggaccngggcaccgtcctccgagggacncccagtcgcctgcaaggtcgggccaggtaggtcgacccctggaacctggaacgccaagtcgaacgaacccaagacgacggaccgaaggtgggttagtaggacgaccccgtggaggacggcgtacgggccctggtcccaggcacggcgcgtcggccccgtgcgtcgcgtgcgtagggtcgcgacgtagtccggtacgcccgagtcggccgtgccgtcgtaccgccgtagtcggtcgccgaaccggcgaacggaccggacnccgaccgngtaccgcgtacgacggtgggacncggacgtccggactccgtacgcccgtacgacgggtcgaccggtggacgggaccgtcgggaaccaccgggtacccgaaccggtacccaccggtaccgtaccgcccgtacgttcccctcccgttaccccg

SEQ ID NO: 249921 - DNA, 730 bp, Homo sapiens
  misc_feature: GYAE6OF02IH9V3.13.4.A04.1.454.CMB.1.raw
  modified_base (374)..(374): a, c, t, g, unknown or other
  misc_feature (374)..(374): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagttgacccagtctccatccttcctgtctgcatctgtaggagacagagtcaccatcacttggccgggccagtcaggactaattaacagtttaattagtctaggtatcagacaaaaaaccgaggaaacgtccctaaagccttacctgatcttattggttcgctaacttcctaagttttcgaacgtaaaaggttcgggtaccccaattaccgaaaggttcaaggcggntaacggtggaattcgtagggactaagtaactttcgacttacctcaacaaacttcgaacggctaacggcccttgaccgacgtccgtaggtaaagtttacttttacggaacttaaaccgttttaatttaacccgtaggtaacctaaacgtacgttaaccgttttaaaacgttaaccggtttaccccgtatttaccgtaacgggttttccgggaaccggggttaacgggaaccgtaaggggttacggtaacgggtaaccttaaaaccggaaaaaccgggttaaccgttacgggttaacgggtaccccgtttaaggtaacccctaaacccggtttaactccggttttaacccgtttaccc

SEQ ID NO: 249922 - DNA, 719 bp, Homo sapiens
  misc_feature: GYAE6OF02H7IXL.13.4.A04.1.454.CMB.1.raw
  modified_base (700)..(700): a, c, t, g, unknown or other
  misc_feature (700)..(700): n is a, c, g, or t
tcagtcacgtactacacgaccggtgctcgatttagagtagtgatcagggggcagttggtagatgcccctctgggagagatccccagggggtgacagccatggaccctggaagggcctgggctagggacagggaccagagccagtccagggagaggacagagccaatgggactgggggtgtactggtaacagccctgctggcgagagggaccagggccaccgtcctccgagggacgccatgctgcaaggtccgggccaaggacggtcgccccgtagaacctggaacggccaaagtcgacgaacccaaaggaccgagggaccctaaagggttggggttagtacggaaccggtacccccgtaggacggacggccgttcggggcccccttcgggtaccccgagggccgtacgggccgccggtccgggcccccttgggcctgccgttcggcggttaccggggtcgtcgggaaccgtggttccgggtccgtaccccggtagtccgggtccgtcgtcccgtacggcccgtacccgtaagttccgggtcgaccgtaccggacgaaaccgggcccggaacccgaccggtaccgtcggacgtccgtcgtacggtcggaacgccgacggccgacgtccgacgccggtggaccggcgtcgacgggtcggagcggtaccgacgcccggaaccgtcccgaccgacgtccgaccncgttcccgtccgtcccccg

SEQ ID NO: 249923 - DNA, 631 bp, Homo sapiens
  misc_feature: GYAE6OF02JJ7G0.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaacttattaaattggtatcagacagaaaccaggtaaacgcccctaagctacctgactcctacgatgacactaccgtaagtttaggaaacctaggggtacccaattacgaaggtttcaggtacggtaaggtggtatacgtagggaactaaggtatttttaccgtcaacgtattacaagcaacggtcctagcctagcccgttaaggaacttattacgttacgactaaactacttaactttactacgtacaacggtactaaggttatagtaacttaacgttaccctacccgttataccccgttaccgtttaccgggacccggtaaaacggggtacctagggtaaccgtgggtaaataacgtttaaaccggaccgttagggtacggtaccgtagtaaccc

SEQ ID NO: 249924 - DNA, 635 bp, Homo sapiens
  misc_feature: GYAE6OF02JMC37.13.4.A04.1.454.CMB.1.raw
  modified_base (235)..(235): a, c, t, g, unknown or other
  misc_feature (235)..(235): n is a, c, g, or t
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
  modified_base (485)..(485): a, c, t, g, unknown or other
  misc_feature (485)..(485): n is a, c, g, or t
tcagtcacgtactacacgaccggtgctcgatttagagtagtgatcagggggcagttggtagatgcccctctgggagagatccccgaggggtgacagccatggaccctggaagggcctgggctagggacagggaccagagccagtccagggagaggacagagccaatggaactcggggtgtactgtaacagccctgctggcgagagggaccagggtcaccgtcctccgaggggacncccagtcgctgacaacgtcgggccaggacggtcgcccctgaacctgaacggccaagtgaacgaaccaagacgaaggcaagtgggtgtgacgaccctgaggngcgtcggcctggtcccaggcagccgcncggccctgctcgcgtgcgtggtctggcagtcggccgccgtagtccggcgtcggctacgccgaccgtaagtcggtcgccgaaccgtcgaaaccgggccggaacccgacggcccgtagggaccnccgttacggaccggttacggaacgccgaacgtccggacctacccgacgccgtcggaccggtacgcccgtcgggtacggaccgttaacggccgtacggaacccgaccggaccctacccgtacgccgtaccgacctcgttacccttccccgg

SEQ ID NO: 249925 - DNA, 744 bp, Homo sapiens
  misc_feature: GYAE6OF02GXVWT.13.4.A04.1.454.CMB.1.raw
tcagtcacgtactacacgaccggtgctcgatttagagtagtgatcaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccatcacttgccaggcgagtcaggactaattaacaacttaattttaaattggtatcagacaagaaaccaaggtaaacgcccctaaagcctcctagactccgtacgatcgactactacctaaagtttacggaaacgtacggggtaccctaatacgtaaacggtttacaaggttagggtaaggtacgggtacgttacggtaggggaactaagtttaacttttttaaccgtttacctaacctaagttaccgaaggtacccaacgggtccccttaggaccctaacgggtacccgttaaggaaaacggtaactttaacgtttacgaacctaaaacttaaatttaacgtttaaccgttaggtacctaacgtaccgtaaagttaacgttaacgtaaacgttaaccttcccgttaacccgtaacttacccgttaacccgtttaccgggacccgtaaacggggaacctaaacccggtagttaacggggtaaacttaaacggtttaaaaccgaacggtttcggtaccggtacgtaccgtacctaccgttaacg

SEQ ID NO: 249926 - DNA, 589 bp, Homo sapiens
  misc_feature: GYAE6OF02IIW3H.13.4.A04.1.454.CMB.1.raw
  modified_base (311)..(311): a, c, t, g, unknown or other
  misc_feature (311)..(311): n is a, c, g, or t
  modified_base (448)..(448): a, c, t, g, unknown or other
  misc_feature (448)..(448): n is a, c, g, or t
tcagtcacgtactacacgaccggtgctcgatttagagtagtgatcagggggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctagaacctgaaggccaaatgaagacccaaagacaggccaagtggtgtgngacccctgaggagctgggccctggtcccaggcagcgctggcccctgctgctgcgtgggtctggcatcggtcgccagtgcctgctcgcgcccgatggttcgcgaccgcgaacggcggggacccacggaccctggaccncgtcagttacggaagcgacgccgatccgacgtccgcgcgggacgccggtaggttcgggggctacggggcctaacgggaccccgaacgggacccaacccccgacgtaccggtcccaacccgttccgttcccgttaccccccg

SEQ ID NO: 249927 - DNA, 698 bp, Homo sapiens
  misc_feature: GYAE6OF02IBJHS.13.4.A04.1.454.CMB.1.raw
tcagtcacgtactacacgaccggtgctcgatttagagtagtgatcagggggcaggagtcagtcccaaccaggacacagcatggacatgagggtccctgctcagctccgtggggctcctgctgctctggctctcaggtgccagatgtgacatccagatgacccagtctccatcctcctgtctgctatctggtaggagacagacgtccaccatctacttcgccgaggcgagtcgaaggtactaattaactaaacttaatttaaattggtaatcagacaacgaaaccgaaggtaaaccaccccgtaaagtccttacctagacttactaacgatacgctaactaccgtaagtttacggaaacgaccggggtaccctaagttaccgaaggtttacaggtacggaaggtacggagttcggagggtaactacgttttactttttaccgtttaccgtaacctaattacgtacgaccgtaaggtcccgtgaccgtacggtaccgtaaggtaaacgttaagttacggttactaacgtaaacttaactttacgttaaaccgttcgttaaccgagtactaggttaactagttaaactacgttaccctaccgttaacttacccgtacggttaccgaaccggtaacggaaccgccggtaacgttagggaacgttaacgttaaacggacgttacgggtccaggtccctaaccg

SEQ ID NO: 249928 - DNA, 665 bp, Homo sapiens
  misc_feature: GYAE6OF02HBEUN.13.4.A04.1.454.CMB.1.raw
  modified_base (179)..(179): a, c, t, g, unknown or other
  misc_feature (179)..(179): n is a, c, g, or t
  modified_base (185)..(185): a, c, t, g, unknown or other
  misc_feature (185)..(185): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgnaccctntgtaggagacagagtcaccatcacttgccaggcgagtcaggacataacaactaattaaattagtatcagacagaaaccaggtaaacgaccctaagctcctgatactacgatgcatacctaagtttaggaaacgaggggtacccatacgtaagtacagtaggagtaggatcgtagggactagttaactttttacttactacctactactacgctaacgccgtcgacgacgtaccgtacgaagtaacttagttagaactaaacgtaatttaactttaacgtagttaccgtacgtacgtaacgttagttaacgtaattaaaccgttacccgtaaccccgtaacgtttaaccctaccccggtttaccggaacccggtaaacgggaacccgaaaccgggtaacggtaacgggtaaacggttaaaccgttaaaacggtaaccgttacgggttacggacccgtttacggaccctaacccgttaaccg

SEQ ID NO: 249929 - DNA, 690 bp, Homo sapiens
  misc_feature: GYAE6OF02JGIGL.13.4.A04.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagtcacgtactacacgaccggtgctcgatttagagtagtgatcagggggcagttggtagatgcccctctgggagagatccccagggggtgacagccatggaccctggaagggcctgggctagggacagggaccagagccagtccagggagaggacagagccaaatggactgggggtgtactgtaacagccctgctggcgagagggaccagggcaccgtccncaggganccatgctgcaaggtcggcagaggtcnccctgaacctgaaggccaatgagaccaagacagccaagtggtgtcgagacccctgagagacgtgggccctggtcccaggcacgacggctcggacccctgccgtgctgcgttcgggtcgtcggcctagtcggtccgaccctaacgttcgggcctggcgtcggacccgtcccgaaacgttcgggttgaccgtaacccgggaacgaaaaccggcccgggggaacccgaacggaccccgttacgggaaccgtacccgtcgaacgggtttacggaacggtaccgacggtacccgaacgtacccgacggccgtaggacccgggtagccccggtggtacggggtacgacgggttccaaccgggccccgaaaccgggtacccccaaaccccgtacccggtacgttacccgtaaccgtttccgttacccgtttaacccccccg

SEQ ID NO: 249930 - DNA, 526 bp, Homo sapiens
  misc_feature: GYAE6OF02F7E2O.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaattgtatcagcagaaccagtaaacgcccctaagctcctagatctacgatgcagtcctaattttaggaaacgacggggtcccagtacaaggtttcaggtggaagtggatcgtggacagtattttacttcgcctatcagcacgctgcacgccgtagaagtagttatcggacaacgtattattaccgtgtaccagtctagtatagtataactctcccatcctaccgttcggacctaagggaccacgacgtagaacgtaacttaacgacgttgtacggctgtaccg

SEQ ID NO: 249931 - DNA, 702 bp, Homo sapiens
  misc_feature: GYAE6OF02HA03D.13.4.A04.1.454.CMB.1.raw
  modified_base (196)..(196): a, c, t, g, unknown or other
  misc_feature (196)..(196): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccactcctccctgtctgcatctgtaggagacagngtacaccatcacttcgccaggcgagtcaggacattaacaacttatttaaagttgtatacagtacaacgaaaccgaacggtaaacgacccctaaagcctcctagactactacgatcgacattacctaaagtttacggaaacgtacggggtacccagtaccgtaaggttcaggtaggtaagtacggtagtcgtaggtactagttattttacctttacgacctagtacacggccacggtccgtgaccgacgtaccgtaggtaaacgatttaacgttcgtaaccttaaacgtacttaaacgtttacttaggtacctaacgttaccggtaaggttaacctagttaaacgttaacgttacccgttaacccgtaacgttaacccgtaacccgtttaccggggacccgtaaacgggaacccgtaaccgggtaaccgtaggggtaaaccctaaacgtttaaaaccggaaccggttcgggttaacgtaccggtaacgttaccccgtaacgttaccg

SEQ ID NO: 249932 - DNA, 591 bp, Homo sapiens
  misc_feature: GYAE6OF02GPPXH.13.4.A04.1.454.CMB.1.raw
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
tcagtcacgtactacacgaccggtgctcgatttagagtagtgatcagggggcagggagtcagtcccaaccaggacacagcatggacatgagggtccctgctcagctcctggggctcctgctgctctggctctcaggtgccagatgtgacatccagatgacccagtctccatccctcctgtctgcatctgtagganacagagtcaccatcacttcgccaggcgagtcaggacattaacaacttatttaaatggtatcagcaagaaaccaggtaacnccctaagctcngactctacgatcgcatacctaagtttaggaaaacgtcggggtacccaagtacgtaacggttcaaggtacgggaagttggatcgtagggactagttagtttttaccttcacattcagcagtcctgcagtcctagaaacgtattactagactaaatagttaacttaccgtgttacagtacctaagttatacgtaattaaccttcctacccgattccgtacccggtacgacccggaagggtacctaacggtaccgtagggtaacgttaaccgttaaccggtaattcgggtacgtccgtacgtaacccg

SEQ ID NO: 249933 - DNA, 556 bp, Homo sapiens
  misc_feature: GYAE6OF02JC7B4.13.4.A04.1.454.CMB.1.raw
  modified_base (196)..(196): a, c, t, g, unknown or other
  misc_feature (196)..(196): n is a, c, g, or t
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (456)..(456): a, c, t, g, unknown or other
  misc_feature (456)..(456): n is a, c, g, or t
  modified_base (479)..(479): a, c, t, g, unknown or other
  misc_feature (479)..(479): n is a, c, g, or t
  modified_base (505)..(505): a, c, t, g, unknown or other
  misc_feature (505)..(505): n is a, c, g, or t
  modified_base (550)..(550): a, c, t, g, unknown or other
  misc_feature (550)..(550): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctcccaggtgccagatgtgacatccagttgacccagtcctccatccttctgtctgcatctgtagagacngtacgtcaccatcgacttgccggcagtcaggacattaacagttattacgtntaggtatcaagaccaaaaaccgagaaacgcctaaagctctgactctatgttananactcactttgacgaaacggttgggtacccaataccgtaagttacgacggtacgacaggtagacgtcgtagggacaaggaactttcgaactcgtacaacaagttaccagacgacgtctggacctaggcctaggaattatttcgacttaatatacngaacagactataaagtctaccgnttgacggttcgaggtaccgagtaggngtaagactacgtaaacgaagttgaacggtctacgacaacccgttntacgtg

SEQ ID NO: 249934 - DNA, 628 bp, Homo sapiens
  misc_feature: GYAE6OF02HOTT1.13.4.A04.1.454.CMB.1.raw
  modified_base (293)..(293): a, c, t, g, unknown or other
  misc_feature (293)..(293): n is a, c, g, or t
  modified_base (599)..(599): a, c, t, g, unknown or other
  misc_feature (599)..(599): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacatccagatgacccagtcctccatccctccctgtctgactatcgtgtaggagacagagtccacctatcacttgccgaggcgagtcaaggaccaactaacaacttaatttaaagttggtatcgagacaacgaaaccgaaggtaaaccncccctaaagtcctaccgtagactcctaacgatcgactaactacctaagtttacggaaacgtcgggtaccagtacgtaaggttcaggtaggaggtagtagtacgtagggactaagttacttttaccttacactatcagctagctagaccagtacctagatatattacgactaatagttataccgtagtaccagtacgtagtaactgaacttacgtacccgtaccgtacttacccgtacccgttaaccgggaaccggtaaacggtacctaacccggaggttaaacggtactaaacggtttaaaccggngtttagggtaccgtccggtaaccgaaccc

SEQ ID NO: 249935 - DNA, 618 bp, Homo sapiens
  misc_feature: GYAE6OF02GDZ39.13.4.A04.1.454.CMB.1.raw
  modified_base (189)..(189): a, c, t, g, unknown or other
  misc_feature (189)..(189): n is a, c, g, or t
  modified_base (257)..(257): a, c, t, g, unknown or other
  misc_feature (257)..(257): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctcctgtctgcatctgtagganacagagtcacatcacttgccaggcgagtcaggacattaacagttattagtctgtatcagacaaaaacnggaaactccaagctactgatctatgtgctatccactttgactaaaggtcggggtacccagtactaaggttcagtcggctaggtggatcgtagggaactagaacttcactactaccaataactcgaacgtacacgtccttaggacacggtccttaggaacgtttacttttacggaacttaaacgtttacttaccgttgtaacctaacagttacctttaaaagttaccgttacccgtacttaccgtaacgggttttaccggacgggggtaacggtaaccggtaacgggttagggaaacgtaccgtaaacgtaaaacggtaacgttcggttacgggaccttcggaccctaccgtaatttcccgg

SEQ ID NO: 249936 - DNA, 647 bp, Homo sapiens
  misc_feature: GYAE6OF02FXBWY.13.4.A04.1.454.CMB.1.raw
  modified_base (299)..(299): a, c, t, g, unknown or other
  misc_feature (299)..(299): n is a, c, g, or t
  modified_base (401)..(401): a, c, t, g, unknown or other
  misc_feature (401)..(401): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctcccaggtgccagatgtgccatccagatgacccagtcctccatcctccctgtctgcatctgtaggagacagagtcaccatcacttggccggacaagtcagggcattagaaatgatttaggctggtatcagcaagaaaccgaggaaacgccctaagctcttgatctatggtncactacctaaggtttaaaagtcgggtaccagtacgtaacggttcaggccggacaggtggactcgtaggacacgtacgtactttactagtttcctacaacctntacagaccacgtccctagccacgtccgttagaacgttacgttttacgaaccttaactttacgttacgttacgtaccttaacgaaacgttacttaaccgtaaactttaactttaccgttacccggttacggggttaacccgtttaccgggaacccgtaaacggggtaacccgtaaagggtaccggtaaaacttaccggaaaacggtaccgttaggtaccgggtacctacggtaccctaacttaaccg

SEQ ID NO: 249937 - DNA, 673 bp, Homo sapiens
  misc_feature: GYAE6OF02IPRVD.13.4.A04.1.454.CMB.1.raw
  modified_base (467)..(467): a, c, t, g, unknown or other
  misc_feature (467)..(467): n is a, c, g, or t
  modified_base (512)..(512): a, c, t, g, unknown or other
  misc_feature (512)..(512): n is a, c, g, or t
  modified_base (664)..(664): a, c, t, g, unknown or other
  misc_feature (664)..(664): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgttacatccagtatcgacccagtctccatccctccctgtctgcatctggtaggagacagacgtcaccatccacttcgacccgaggcgaacgtccgaaggacctaattaaaccaactttaatttaaacgttggtaacttacgaacgacaacgtaaaaccccgtaggtaaaacgacccccgtaaagaccttacccgtagacttactaacgattcgactactacctaagtttacggaaacgtacggggtacccaagtacgtaacggttacaggtaggaaggtggactcggtaggacagtttactttacttaccactatcagccgagtccgngacagtctagaatattagtacactaacgtattacgttactcgtancgacgtattagtatacgttaacttccgtacccgttactacccgtaaccgttaccggtaaccggtaacggtacgtaaccgggtaacgtaacgggtaaacgttaaaccggttaaaccgaaggttaccggtcggtacctaccggacttacccgtnttaacccgg

SEQ ID NO: 249938 - DNA, 780 bp, Homo sapiens
  misc_feature: GYAE6OF02H4WKV.13.4.A04.1.454.CMB.1.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
tcagtcacgtactacacgaccggtgctcgatttagagtagtgatcagggggcagttggtagatgcccctctgggagagatcccaggggtgacagccatggaccctggaagggcctgggctagggacagggaccagagccagtccagggagaggacagagccaatggactggggtgtactgtaacagccctgctggcgagagggaccagggcaccgtccnccgagggacncccatcgctgacgaaggtcgggaccaggacgggtcgccccgtgaaccgtgaacggccaagtcgaacgaacccgaagacgacggaccgaaggtgggttgtacgacgtaccccgtagacggacgcggtcggccccgtgggaccccgagggcgacggccggtccgtccgggcccctggccgtcggcgttgggcgttcgggtcgtcggcgtacggtccggtaccgtcccgtacggtcggtcccgtcggccgtcggtccccgaccgttaagtccggttccgaccgtacccggaaccggaacgggaccccggggtaaccacccgggaacccgtacggtacccggaccgttacgggtaacgttcgggaaaccggcgtaccggaccgtaccgtaccgaccgtccggtacggaccgggtacccgtccgggtcgggtaccgggggtaccgtacggggttacccggaacccggtaaccccggtaacccgggaaccccgtaaccccggtacggtccccgttacccgtaccggttttacccccggtcccctttaacccccccgg

SEQ ID NO: 249939 - DNA, 610 bp, Homo sapiens
  misc_feature: GYAE6OF02GEO7R.13.4.A04.1.454.CMB.1.raw
  modified_base (177)..(177): a, c, t, g, unknown or other
  misc_feature (177)..(177): n is a, c, g, or t
  modified_base (228)..(228): a, c, t, g, unknown or other
  misc_feature (228)..(228): n is a, c, g, or t
  modified_base (386)..(386): a, c, t, g, unknown or other
  misc_feature (386)..(386): n is a, c, g, or t
  modified_base (423)..(423): a, c, t, g, unknown or other
  misc_feature (423)..(423): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactgggggtntactgtaacagccctgctggcgagagggaccagggcaccgtctccagggancccatgctgcaaggtcggccagaggtcgccctgacctgaaggccaatgagacccaagacagccaagtgggtgtgacgacccctggacggagcgtcgggcctcggtcccgaggcagccgcgtcggcccctgctgctgctgggtctcggcagtcggtccncccgtagtcggcctgcgtcgccgacctagtcggttcnccgtaccgacgaacggcccggggaaccacggcccgtggaccgtccgtcgaggttacggaacgccgacgccgacgtccgacgtccgcggtccggacgtccgtggtacggggccgtagggtaccgaccggcccgaaccggaccccaacccgtcgtaccgtacccgtcgttacccgtccgttaccccccg

SEQ ID NO: 249940 - DNA, 624 bp, Homo sapiens
  misc_feature: GYAE6OF02HWF56.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatccctccctgtctgcatctggtaggagacagagtcaccatcacttgccaggcgagtcgaggacaattaacaacttaatttaaattggtatcagcagaaaccaaggtaaacgcccctaagcctacctgatctacgatcgcaatcctaatttacggaaacgtacggggtacccaattacgaaggtttcgaaggtgggaagtcggaatcgtagggactagttatttttacctttccactatacgacgcacgcctagcaacgcctagaagtattatttgaactaaactattaactttactagtacaagacctaagttatagtaacttaactccgtaacccgtacttacccgtaccgttaccgggaaccgaaacggggaacccgtaaccggacggttaacgggaacgtaaacggtttaaaaccggaacggtttaacgggtcggtacgtacggtaaccccg

SEQ ID NO: 249941 - DNA, 642 bp, Homo sapiens
  misc_feature: GYAE6OF02IUYAL.13.4.A04.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (536)..(536): a, c, t, g, unknown or other
  misc_feature (536)..(536): n is a, c, g, or t
tcagtcacgtactacacgaccggtgctcgatttagagtagtgatcaggggggcaggagtcagtcccaaccaggacacagcatggacatgagggtccctgctcagctcctggggctcctgctgctctggctctcgaggtgccagatgtgacatccagatcgacccagtcctccatccctcctgtctcgctatcgtggtacgganacngatccaccatccacgtcgccgaggcgagtacgacggactattaaactaattaaattttaacgttagtactcgacgacaacgaaaccgtaaggtaaacgacccctacgccgttcctagacttactaccgatcgacactacttaagttcggaacgcggtaccacgtacgtacggttacgaggtacggtagtcggtatcggtaggtaacgagttttacttttaccgtactactacgtacacgtacncgtcgtanacacgactagaactnttactacggactaacacgtttaacgttagcgtaactacgtagtagtacctaagaactttacccncgtttacccgacgttacccgttacgtacccgggtaccggaacggtaacccgacggtacggtacgaaccgttaacggttaacctaggtcggtcggtacctcggaccc

SEQ ID NO: 249942 - DNA, 659 bp, Homo sapiens
  misc_feature: GYAE6OF02I2OBL.13.4.A04.1.454.CMB.1.raw
  modified_base (203)..(203): a, c, t, g, unknown or other
  misc_feature (203)..(203): n is a, c, g, or t
  modified_base (496)..(496): a, c, t, g, unknown or other
  misc_feature (496)..(496): n is a, c, g, or t
  modified_base (518)..(518): a, c, t, g, unknown or other
  misc_feature (518)..(518): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccntcacttgccaggccgagtcgaaggacattaaccaacgttatttaaattaggtatctagaccgtaacgaaaacctaggtaaaacgacccccgttaaaggccttacccgtaggtaaccttaccgtaaccgtaattcggaccgtaaattacccgtaaagttttaacggaaaacggtcggggttacccaagttaccgaagggtttcaagggtacggtaaaggtggtactcgtagggactagttacttttacttcgacaactcagcagccgttagcaccgtgtcgaagtatacggttnaacactattactacttcgacgnaacctagttatagtactactacccttaccgtatcccgttaacttcccgggacgacgggtaccaacggtacggttaaccgggatttaaaccggttaacgtaacccttggggtacggtccttacggaacccgttacgttaccg

SEQ ID NO: 249943 - DNA, 789 bp, Homo sapiens
  misc_feature: GYAE6OF02IZ2MZ.13.4.A04.1.454.CMB.1.raw
  modified_base (446)..(446): a, c, t, g, unknown or other
  misc_feature (446)..(446): n is a, c, g, or t
  modified_base (621)..(621): a, c, t, g, unknown or other
  misc_feature (621)..(621): n is a, c, g, or t
tcagtcacgtactacacgaccggtgctcgatttagagtagtgatcaggggtctgagagaggagcccagccctgggattttcaggtgttttcatttggtgatcaggactgaacagagagaactcaccatggaatttgggctgagctggtctttttcttgtggctattttaaaaggtgtccagtgtgaagtgcagctggtggagtcgtggggggaggtcttggtacagccgtggggacggttcccgtaggacgaccttccgtcctggtcgcacgcccttcgtggtacttcctaacccgttttaagacctaaacttagtcggccctaagtggaacgtccggttccggggtaccccgacccggaacggggtccgttaccccggaaggggggaacgggggtccgttaggggaggtttcggggtaccttaacgtaaacctttagtttacggnggtaccgttaagggttcggtacggacccctaacccgtaacaacttaaccgtacgaccgtaacggacccgttcccgggtaagggaacgggtacccgtactttacccgaaccctagttcccgtaaccgaagacgtaaccaaaccggaccaaaagtaccctactaaccgttagtaccncgttacgacgtaagtagtcggacgaccgaacggtccgtaaggaacgggacggaccggaaacggggaaccgtccgggtacttaaggttaacttacggttaaccgtgggtacggagggttaaagggttaactttaagttttccgacggtagttaggttacgtttaacggg

SEQ ID NO: 249944 - DNA, 821 bp, Homo sapiens
  misc_feature: GYAE6OF02JHAWO.13.4.A04.1.454.CMB.1.raw
  modified_base (194)..(194): a, c, t, g, unknown or other
  misc_feature (194)..(194): n is a, c, g, or t
  modified_base (257)..(257): a, c, t, g, unknown or other
  misc_feature (257)..(257): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatcgacccagtctccatcctcctgtctgcatctgtagganacagacgtcaccagtacacttgccaggcgagtcagactattaacaacttatttaattggtatnagcaagaaccaggtaacgcccctaagctacctgactctacgatcgctaactaccgtaagttttacggaaaacgtacggggttacccaagttaccgtaaacggtttaccgtaagggttacgggtaaaacggtgggttaacgtacgggttacggggaacgttaaggttttaacctttttttaaccgttttacccgaaacccttaacgtttacccgaaacggtcctaaaccggtcccttaggaccgtacggtacctaagggtaaacgtaacgtttaagttaccggtaacctaaaacgttagtttaaccgttttaaccgttacgggtttaaccaaacgggtaccgttaaaagggtttaacgttaacggttaaacttttaaccgttacccccggtttaaacccgttaccgtttacccccgttaccccggttttaacccggggaacccggtaaaaacccggggtaccggttaaaccggtaaaccgggttacgggtaaaacggtttaaaccccggtttaaaacggttaaacccggtttaccgggttaccgggtacccgtaccgtaaacccg

SEQ ID NO: 249945 - DNA, 623 bp, Homo sapiens
  misc_feature: GYAE6OF02IZ1DL.13.4.A04.1.454.CMB.1.raw
  modified_base (405)..(405): a, c, t, g, unknown or other
  misc_feature (405)..(405): n is a, c, g, or t
tcagtcacgtactacacgaccggtgctcgatttagagtagtgatcagggggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagaccccgtgaggagcgtgggccctggtcccaggcagcgctcggcccctgctgctggctgggtcctggccagtcggtcgcccagtcgggctgcgtcgcncccgtaagtggttcgcaccgcgaaacggccggggacccacggaccctacggacgccgtacgacggttagggaacgtcgaacggccgacgtaccgaccgaccgtcgccgggaccgccgtcgggtcggggtaccgaacggggtccgaacgggaccccgaacggaacccccgaaccccgtaccgtacggtccaacccgttccgtcccgtttaacccccccg

SEQ ID NO: 249946 - DNA, 794 bp, Homo sapiens
  misc_feature: GYAE6OF02JL0GV.13.4.A04.1.454.CMB.1.raw
  modified_base (205)..(205): a, c, t, g, unknown or other
  misc_feature (205)..(205): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgccatccagatgacccagtcctccatcctccctgtcctgctatctaggtaggagacgagngtaccacctatctacgttcggaccgggacaaacggtcgagggtacctaagttaacgaaaagttgtaagttttaggaccgttggtagtcaagacgaaggtaaaacccgaaggggtaaacccgacccgtaaacgtccgttaccgtagtacttactaacggtggtacgtacctaacgttaacccggttaaaaggttttaaaaacggggttccggggttaacccctaacggtttaacccggtaaaacggggttttccgaacgggtaccgggttaacgaacgggttacgggtaacgtaccgttacgggaaccgtaacgttaacggtaaccgttacgttaacgttccctaaccgtaactacttaccgacgtaaccgtaccggtacttaccggccgtaacggtccttaaagggtaactttacgttcgtaaaccgttacttaacgtttaccgagtttaaccctagttaaacgtaccttacgtaaaccttaaattaacccggttacgttacgggtaccggttacggaccggtaaaacgggtaaccgtaagggtaacgtaacgtaacgaacgtcgtacggtcgtacgtacgactaaccg

SEQ ID NO: 249947 - DNA, 745 bp, Homo sapiens
  misc_feature: GYAE6OF02FURMJ.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatctggtaggagacagagtcaccatcacttgccgaggcgagtcaggacattaacaactatttaaagttggtatacagcaagaaaccaggtaaacgacccctaagcctcctgactctacgatgcatccctaagttttacggaaacgtacggggtacccatacgtaaaggtttccagtacgggaagtgggacttcgtagggggacctaggttaacttttttaccgtttacgtaaccctaagttccgaagtaccgtaacgtcccgttaggacctaacggtaccccgttaaggaaacgggtatttaaacgtttaccggtaactaacccgtaaatttacgggtttaaccttacgttaaccgaacggtacctaaggttaacgttaggttaaacttaaacgtttacccgttacccgggtaaccttaaccggttacccgttttcccgggaaccgggttaaaccggggaacccgtaaccgggtaaaccgttacggggttaaaacgttaaacggttttaaaacccgggtaaccggttacgggttaccgggttacccgtaccggttaaaccccg

SEQ ID NO: 249948 - DNA, 648 bp, Homo sapiens
  misc_feature: GYAE6OF02HX9PV.13.4.A04.1.454.CMB.1.raw
tcagtcacgtactacacgaccggtgctcgattttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatcgctgcaagtccgggccaggacggtcgcccccgtgaacccgtggaacggccaaatcgaacgacccaagacgacggaccaaaggtgggttgtagacgaccccgtggacggagcgtgggcccctcggtcccgaggcgagcgctcggccctgcctgcgtgcgtgggtcgtggcctagtcggtcgccgagtcggctcgctcgccgaccctaagtcggttcgccgtaccgacgaaacggccgggaacccacggacccgtcggacgccgtacgacgggttcggaacgtccgacggccgacgtccgacgtcccgtcggaccgggtcgccggtgggtcggggaccgagggttcccgaacggacccgaaccggaccccgaacccgtacgtacgtacctaccgttccgtaccgttacccccg

SEQ ID NO: 249949 - DNA, 644 bp, Homo sapiens
  misc_feature: GYAE6OF02F50VY.13.4.A04.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
tcagtcacgtactacacgaccggtgctcgatttagagtagtgatcagggggcaggttgggtagatgcccctctgggagagatccccaggggtgacacgccatggaccctggaagggcctgggctagggacagggaccagagccagtccagggagaggacaggagccaatggactggggtgtactgtaacagccctgctggcgagagggaccagggcaccgtcctccagggacncccatgctgcaagtccgggccaggaggtcgcccctagaaccgtggaacggccaactgacgacccaagacaggccaagtgggttgngacgaccccgtgacggagcgtcgggcctggtcccaggcagcgcgtcggccctgctgcgtcgcgtcgggtctcggcctagtcggtcgccgagtcgggctgcctgccgaccgacgtggttacgctaccgacgaacggccgggaccgcgaccgtcggacgccgtcgtaggtgaacgcgacgacctacgtcccgacgtccgtacggccgggtaccgtcgtacggggtcgggaccgtcgggtacccaaccggtaccccggaaaccggtaccccaaacccggtccggtaccgttacccggaaccctttccgggtaccccgtttccccccggg

SEQ ID NO: 249950 - DNA, 628 bp, Homo sapiens
  misc_feature: GYAE6OF02IWERA.13.4.A04.1.454.CMB.1.raw
  modified_base (198)..(198): a, c, t, g, unknown or other
  misc_feature (198)..(198): n is a, c, g, or t
  modified_base (372)..(372): a, c, t, g, unknown or other
  misc_feature (372)..(372): n is a, c, g, or t
  modified_base (512)..(512): a, c, t, g, unknown or other
  misc_feature (512)..(512): n is a, c, g, or t
tcagtcacgtactacacgaccggtgctcgatttagagtagtgatcagggggcagttggtagatgcccctctgggagagatccccagggggtgacagccatggaccctggaagggcctgggctagggacagggaccagagccagtccagggagaggacagagccaatggactggggtgtactgtaacagccctgctggngagagggaccagggcaccgtcctccagggacgcccatgctgcgaagtccgggccaggaggtcgcccctgaacctgaagaccaatgacgaccccaagaccaggccaaggtgggttgtgacgacccctaggaggacgcgtcggcccgtcggtccgacggcagaccgcgtccgcccngcgtcgcgtgcgtgggtcgtcggaccgtatcggtccgaccgagtcggccgtgccgtcgccgtccgaagttcggtacgccgaaccgacgaaacggccgggacccaacggaccgtacggacgcctacgaggtagaacggacncgccgtactccgacgtcctcgggcgacggtcccggtaggtcgggacgtacgggacctaggaaccccgtacggaaccccaacccgtccacgtaccacccgttcgtacccgtaccccg

SEQ ID NO: 249951 - DNA, 717 bp, Homo sapiens
  misc_feature: GYAE6OF02IHS4S.13.4.A04.1.454.CMB.1.raw
  modified_base (301)..(301): a, c, t, g, unknown or other
  misc_feature (301)..(301): n is a, c, g, or t
tcagtcacgtactacacgaccggtgctcgatttagagtagtgatcaggggggagtcagtcccaaccaggacacagcatggacatgagggtccctgctcagctcctggggctcctgctgctctggctctcaggtgccagatgtgacatccagatgacccagtcctccatcctccctgtctgcatctgtaggagacagagtcaccatcacttgccaggcgagtcaggatattaacaactaatttaaattggtatcagcaagaaaaccaggtaaagcccctaagctacctgatacgtacgatcnctaatacctaaattttacgggaaaaccgtacgggggtacccaagttactaacgggtttcaaacggtagggtaaggtacgggtattccggtacggggactaagtttagtttttaaccctttaccgtaaccgtattaccagtaccgaacggtacccttacgacgtaacgtaccgtacggtaaagaactttaacgtttacggaacctaaactaagttaacgttttactagtaacccgaagtaccgtaagttaactaggtaaattaaaccttccgtaacccgttagttaccccgtaacccgtttacccgggacccgtaaaaccggggtaccgtaaaccggtaccgttaaggggtaacgttaaacccgttaaaaccgttaccggttagttacccgggatttaccggacctaacccgttacg

SEQ ID NO: 249952 - DNA, 668 bp, Homo sapiens
  misc_feature: GYAE6OF02IJGBG.13.4.A04.1.454.CMB.1.raw
  modified_base (193)..(193): a, c, t, g, unknown or other
  misc_feature (193)..(193): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatctgtagganacagatccaccatccacttcgccagggcagtcgaggtacattaacacttattaaagtgtatcagnaacgaacgagtaacacccgtaancctacgtgtatcgtacgatgactactactaagttacgaacgtacggtacccataccgtaaggttacgaggttaggtaaacgtggtactaccggtaggtaactaacggtttaacttttttacgttacctaaccgtactacgtaacgacctacgtccttagaccgtacgtaccgttagaaacgtattaacgtacgaactaaacgttactttaagttacgtacgtacgaacgtcgtaagttaagttagtaacgttaaaccgtcccgttaacccgtagttacccctaccgttacccgggaaccggtaacgggtacctaaacggttccgtaaacgggtaacttaacggttaaaaccgttaccgggaggttacggttacccaggttaaccccg

SEQ ID NO: 249953 - DNA, 688 bp, Homo sapiens
  misc_feature: GYAE6OF02F27J8.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaagtggactggggtgtactgtaacagccctgctggcgaggagggaccagggcaccgtcctccgagggacgcccatcgctgacgaaggtccgggccaggacggtccgacccctaggaaccgtgaacggaccaatggacgaacccaagacgacggaccaaggtgggttgtggaacgtacccccgtaggacggacgcgtcgggccccgtcgggtccccgagggccgaggccggccgtcggccccgtcgcgtcgctcggcgtcgggtcgtcggccgtacgtcggtccgccgtacgtcggccgtcggcgtcggcccgaccgtaagtcggtcgccgaccgacgaacggccgggacccacggacccgtcggaccgaccgtcgtacggttacggaacgacgtacgccgacgtcccgacgtccgtcggacggtacgtccggtaggtcgggacgtacggtacgaccggaccccgaaccggacccgaacccgtaccgtaccgaccgttacccgttacccgttcccggttaccccccg

SEQ ID NO: 249954 - DNA, 635 bp, Homo sapiens
  misc_feature: GYAE6OF02IIPRU.13.4.A04.1.454.CMB.1.raw
  modified_base (176)..(176): a, c, t, g, unknown or other
  misc_feature (176)..(176): n is a, c, g, or t
  modified_base (229)..(229): a, c, t, g, unknown or other
  misc_feature (229)..(229): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacnccatgctgacaagtcggccaggacggtcgcccctagaacctgaacgccaagtgacgaccaagacaggccaaggtgggttgtagacgaccccgtggaggagcgtcgggccctcggtcccgaggcagccgcgtcggccctgctgctggcgtggtctcggctagtcggccgcccagtcgggccctgtccgtcgaccgcccgtaagtcgggttcgaccgaaccggacgaaaccgggccggggaaaccccacggtaccccgtagggaccgtacccgtacgtacggttaggaacgacgacgaccgactaccgacgtccgtcggccggacgccggtgggcgggcgaaggtccgaccggacccgaaccgaccccaacccgtcgttaccaccgtacttccgtcccgttacccccg

SEQ ID NO: 249955 - DNA, 607 bp, Homo sapiens
  misc_feature: GYAE6OF02GJ6TA.13.4.A04.1.454.CMB.1.raw
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
  modified_base (508)..(508): a, c, t, g, unknown or other
  misc_feature (508)..(508): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgacccagtctccatccctcctgtctgctatcgtgtaggagacagacgtaccaccactctacgttcgaccgacggtcgagtcgaaggactaattaacaacttaatttaaattggtatacagacaacgaaaccgaaggtaaaccgacccctaagccttacctagtactaccgtaacgatacgactactacctaagttacggaacgtacggggtaccagtacgtaaggtcgagtaggaagtagtagtcggtaggactagtttacttttacgtacactacgtacacgtcgactcgtcgacgcgtacgtagaatatacgttacgactaaactnttaattacgngtacagttacagtttanagttaactacttccgccgtataccctagtacccgacgtaggaccgacgtaagtccgaagtaaccgttaagacggttggtaccgatacgtacctactacg

SEQ ID NO: 249956 - DNA, 611 bp, Homo sapiens
  misc_feature: GYAE6OF02IPCCR.13.4.A04.1.454.CMB.1.raw
  modified_base (213)..(213): a, c, t, g, unknown or other
  misc_feature (213)..(213): n is a, c, g, or t
  modified_base (281)..(281): a, c, t, g, unknown or other
  misc_feature (281)..(281): n is a, c, g, or t
  modified_base (445)..(445): a, c, t, g, unknown or other
  misc_feature (445)..(445): n is a, c, g, or t
  modified_base (489)..(489): a, c, t, g, unknown or other
  misc_feature (489)..(489): n is a, c, g, or t
  modified_base (549)..(549): a, c, t, g, unknown or other
  misc_feature (549)..(549): n is a, c, g, or t
  modified_base (585)..(585): a, c, t, g, unknown or other
  misc_feature (585)..(585): n is a, c, g, or t
  modified_base (607)..(607): a, c, t, g, unknown or other
  misc_feature (607)..(607): n is a, c, g, or t
tcagtcacgtactacacgaccggtgctcgatttagagtagtgatcagggggcaggagtcagtcccaaccaggacacagcatggacatgacgggtccctgctcagctccgtggggctcctgctgctctggctctcaggtcgccagatgtgacactccagatcgacccatcctccactccctccctgtctcgctatcgttggaggagacaaggtntaccactatctacttcgccgaggcgtagtacgagaactacttaaacaacttaatttaagttgtactanagacaaacgtaaacgtaacggtaaacggcccctaagccttacgtactatacctacgagtcacacttaacgtaaggttacggaacgacggtactaacgtacgtaggtacgaaggtaggaagttggacttcgtaagggtactaggttaacttttacctactactanacctagaccacgctacgcaggtacctaagtaacgattaccgtanaacgtaactgtaaccttgtacgtactagtacgtaagtactagacttaacgtcaacccgtntaccacgtacgacggacgacgagtaacgtaggtaanaacgttacgcgttgggactcgntacc

SEQ ID NO: 249957 - DNA, 562 bp, Homo sapiens
  misc_feature: GYAE6OF02GEF3J.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacagttaaacaactatttaaaattggtatctagctagaaaccaggtaaacgacccctaagctcctgatctacgatgcatccaatttggaaacacggggtccaatcaaggttcagtcggcagtggatcgtaggacaggaacttcgactctacacaatcagcagctgcagcctagagtacttttcaactttattactcgtacaacgtagtacttaacttacgttaacccgtcttaccgtagttttaccgggcggtacgggtaccgtaaggggtcggaagtaacgtacgtaaaacgtaccgttaggtacggtaccgtacggtctaaccgatttacccg

SEQ ID NO: 249958 - DNA, 749 bp, Homo sapiens
  misc_feature: GYAE6OF02GKEFE.13.4.A04.1.454.CMB.1.raw
  modified_base (253)..(253): a, c, t, g, unknown or other
  misc_feature (253)..(253): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
  modified_base (492)..(492): a, c, t, g, unknown or other
  misc_feature (492)..(492): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacgacgccctcgcgtggcggagagggaccgacgggcgaccgtccgtccgacgggacggcccactgtccgngtacgaacggtccggggccgacggaagggtcggcccccgtacggaaccttggaacgggacccaaagtaggacgaacccccaaagtaacgacgggtacccgaaaggttggggtttacgcggtaacggacccccgtagagggaacgcgttcgggcccgtcggtccgacgcgacgcgcgcggccccgtcgntcggntcgggtcttcggggtacgtcggtaccngtcgggtccctaccccggngtccggtcctcggcgtcgccgccgtaacgtggttaccgccgtacgaccgtaacggaccgggacccgtacgacccgtacggcgacccgtcgtaggtccggtaacgccgtacggcccgacgtaccgcggttaccgcggtaccgacgccggtcgggttacggggacgtaccgggtacggaacccggtacccggaacccgggttacccgaaacccctccggttaccgtacccgtaccgttcccgttaccccgtacccccgg

SEQ ID NO: 249959 - DNA, 570 bp, Homo sapiens
  misc_feature: GYAE6OF02HOZRV.13.4.A04.1.454.CMB.1.raw
  modified_base (455)..(455): a, c, t, g, unknown or other
  misc_feature (455)..(455): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtcctccatcctccctgtcctgctatcgtagtaggagacagagtccaccatccacttcggaccaggcgagtcgaggactattaacaacttattaattggtatcgagacaagaaacaggtaactaccctaagccttccagactactaccgatcgactactaccgtaagtttacggaaacgtacgggtcccaagtaccgtaagttcaggtgggaagtggactcggtaggtactaggttacttttacttcactatccgagtcacgctcgcgtacgctaagatatagtcagtacatntactgtacagctagtntagactaccgtcacctacncctaccgtacggacccgtaaggcctaacggtacgtacgggaattaacggttaacgagttacggtacggtacctgaacccg

SEQ ID NO: 249960 - DNA, 734 bp, Homo sapiens
  misc_feature: GYAE6OF02FOMP4.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacaggagccaatggactggggtgtactgtaacagccctgctggcgagagggaccagggcaccgtcctccgagggacgcccagtgctgcgaagtcgggccgagaggtcggcccctacgaaccgtagaaggacccaataggacgaccccaaacggaacgtacggcccaaaggtcggggttggtagaacggacccctggaacgggaggccttggggacccgtcgggttccccgagggcgacggcggccgttacggccccgtcgtcgtagccgtgggtacgttcggggtctcgggtcctacggtcgggtaccgtccccgagttcgggccgtttggccttacgggacccgtcccgaaagtcgggttacgccgtaccgaaccggtaaacgggcccgggaacccggaacggtaccccggtacggaccgtacccgttaccgtcgggtaggaaccggagccgaccgtacgtcccgaacgccggttcggcggacggtccgtggtaccggggcgaacggtccggacgaaccccgtaaggacccgtaaccccgcgttaccgtaacctcccggttaccttacccggttccccg

SEQ ID NO: 249961 - DNA, 716 bp, Homo sapiens
  misc_feature: GYAE6OF02HYEYA.13.4.A04.1.454.CMB.1.raw
tcagtcacgtactacacgaccggtgctcgatttagagtagtgatcagggggcagttggtagatgcccctctgggagagactccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatcgctgcaaggtccgggccagacggtcgccccctggaacctgaaacggccaagtgacgaccaagacaggccaaggtggttgacgacgacccctaggagggagccgtcgggccctgggtaccccgaggcacggtccgcgtcggcccccttggacctgccgtcggcgttgggtcctagggccctagtcggtccgaccccgtagttcgggcccctttcggccgttcggacccgtaccccgtaagtttcggggttacgaccgaacccggaaccggtaaacgggacccgggggaaaccccaagggtaacccccgtagggaccctacccgttcgaacggttacgggaaccggaccgacgggaccgtaacgtacccgaacgtcccgtacggccggacgtccggtagggtcggggtcgacgggtcgaacccggcccgaaaccggccccaaacccgtccgtcgtacctaccgttcccgtccctacccccg

SEQ ID NO: 249962 - DNA, 628 bp, Homo sapiens
  misc_feature: GYAE6OF02HJ402.13.4.A04.1.454.CMB.1.raw
  modified_base (191)..(191): a, c, t, g, unknown or other
  misc_feature (191)..(191): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccgagatgacccagtctccatcctccctgtctgctatctgagganacagagtcaccatcacttcgaccaggtcagtcagactaattaacaacttaatttaaattggtatacgagacaaacgtaaaaccgtaagggtaaaccgtacccctaaagtccctaccgtagtaactaccgttaacgactcgactacttacctaaagtttacggaaaccgtcgggtacccagttacgaagttcgagtaggataggatcggagactagttattttacctcactataccgagtcagtccgtgcgtaacgctagaagtgtaatagtacaaattgttaactactcgtagactataagttactagtaaataccgttaccgtaccgttactcccgtaaccgtccggtaacccggtaaggaccgtaacggtcggttaaggaaccgttaaataaaccccggttatcggttaccggactaccgtacccgtacgtaccg

SEQ ID NO: 249963 - DNA, 618 bp, Homo sapiens
  misc_feature: GYAE6OF02HYPA7.13.4.A04.1.454.CMB.1.raw
  modified_base (469)..(469): a, c, t, g, unknown or other
  misc_feature (469)..(469): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatcgacccagtcctccatccctccctgtctgcatcgtggtaggagacagacgtccaaccatcctaccgttgccaagggccgtagtcgaaggtaacctaattaaactaacttaatttaaagtttggtatcgagactaagaaaccgtaaggtaaaccgacccctaagccttacctagactaccgtagactcgactactacctaagtttacggaacgtacgggtaccaagtcgtaaggttcaggtaggtaagtcggatcggtaggactagttacttttacgttacactatcagccacgtcctgcctagcctagaaatnttaagtagactaattactattactgtacagtactagtatagtatacgtccctacctataccgtaccgtacggaccgtaaacgggtaccaacggtacgttacggtaacgttaacgttaaccggtacgttagggccgtacgtcgtaacccg

SEQ ID NO: 249964 - DNA, 726 bp, Homo sapiens
  misc_feature: GYAE6OF02FSKJR.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacatccagatgacccagtctccatccctccctgtctgcatctggtaggagacagacgtcaccatcacttcgccaggcgagtcaggacattaacaatatttaatgtatcgagcaagaaccaggtaaacgcccctaagcctcctgactctacgatgactactcctaaagtttacggaaacgtacggggtaccctagtaccgtaaggtttaccgaaggttaggaaggttgggaaacttccggtaggggtaactaagttaacgttttttaccgttacgaccttaagttaccaaggtaccacgtcccgtacgacacggtcccgtaggtaaacgtacgtttaacgttacgaacccgtaaacttaacgtttaactttacgttaacgtaccgttaagtaccggtaacgttaagtacggtttaaacttaaccgttacccgttaccccgttaacttaccccgttacccggtttcccgggtaaaccgggtaaaccgggtaacccgtaaccggtaaccggttaaggggtaaccgtttaaacggttaaaacccgttaacggtttaccggggtacgttacccggtacgtaacccg

SEQ ID NO: 249965 - DNA, 716 bp, Homo sapiens
  misc_feature: GYAE6OF02GAAAN.13.4.A04.1.454.CMB.1.raw
  modified_base (502)..(502): a, c, t, g, unknown or other
  misc_feature (502)..(502): n is a, c, g, or t
tcagtcacgtactacacgaccggtgctcgatttagagtagtgatcaggggggcagggagtcagtcccaaccaggacacagcatggacatgagggtccctgctcagctcctggggctcctgctgctctggctctcaggtgccagatgtgacataccagatcgacccagtcctccacttcccgtccctgtctgctacgtctggtaggacgacagacgtcacctatcctactcgccgaggccgagtaccaaggaccaagttaaacctaactttaatttaaaggttgtaactcgaacgtacgaacggaaaccgtaaacggtaaaccgaccccgttaaagccctaccgtgtaacgttcgtaacgtactcgacttacgttaacttaacggtttaaaccggggaaactaccggggttaccctaaaggtacgtaacggttacgtaacgggtagggtaaacggtggtacgtacggtacggtaacgtatttacctttactacgtacagtacncggtactcgtacgtcgagtacactaggatattagtacactaatacttacgttctacggtctaaggtctaagtacgtaattaacttacccggtcccttaacgtaccaccggtttaccgtcccggaaggtaacggaaccgtttaccggaaggttaacgggtaacgtaaaaccggtttacggtaacggtaccgggttcgtacccgttcggtaacccg

SEQ ID NO: 249966 - DNA, 569 bp, Homo sapiens
  misc_feature: GYAE6OF02HZZDZ.13.4.A04.1.454.CMB.1.raw
  modified_base (359)..(359): a, c, t, g, unknown or other
  misc_feature (359)..(359): n is a, c, g, or t
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacatccagatgacccagtcctccatccctccctgtcctgcatctgtacggagacagagtccaccatcacttgccaggcagtcaggacattaacaacttattaatggtatcagacagaaaccgtagtaaacgcccctaagcctcctgatctacgatcgcatcctaagtttaggaaacgtacggggtaccataccgtaaggttcaggtaggtaagnggtaatcgtaggactaggttacttttacgttcacctatcagcacgcctgacctagtaccctgtaaagtacttagtttacataaccgtattacttactgttacacgtctaatatagtaattaaccgtctacccgtattccaccgtttaccggaccaaagggtacctacgaacgttacgaagtacgttaaacacggtcggtgaccttgaacc

SEQ ID NO: 249967 - DNA, 686 bp, Homo sapiens
  misc_feature: GYAE6OF02F6J76.13.4.A04.1.454.CMB.1.raw
  modified_base (176)..(176): a, c, t, g, unknown or other
  misc_feature (176)..(176): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcacccgtcccccagggacgcccactgctgcaagtcgggccaggagggtgcccctagaacctgaacggccaatgagacccaagacaggcctaaggtgggttgtgacggacccctggaggacgcgtgggccctcgggtcccagggcacggcgctggcccctgctcgctggctgggtcctggccagtcgggtcgccctgtcggcctgcgtcgcgcccgtaacgtcggtcgccgtaccggacgaacggccggggacccgacggacccgtgggaacgtccgtacgtacggttcgggtaacgccgaccggaccggaccgtacccggacgtcccgacggccgggtacgtcccgtgggttaccggggcggcgggttaccggaaccggtaaccccggaaacccgggtacccccgaacccccgtaacgttacccgggttaccctaaccccgttcccgttacccgttaccccccgttaaccccccg

SEQ ID NO: 249968 - DNA, 564 bp, Homo sapiens
  misc_feature: GYAE6OF02F91WI.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggcgccagatgtgacatccagatgacccagtctccatcctccctgtctgcatctgtaggagacagagtcaccatcacttgccaggcgagtcagacattaacaactatttaaatggtatcagcagaaaccaggtaaacgcccctaagctcctgatctacgatgcatccaatttaggaaacaggggtacccatacgaaggtttcaggtaggaagtggatcgtgggactagtattttactttcacctatcagcagcctgcacgccagaagattaagttcactaacattaactttactgtccagtcaagttataggtaataacttcctacccgtacttcccgtacccgtttccggaccgtaaacgggaccaacggaaccgttaggaacgtaacgtttaaacggaaccgttagggtacggtaccgtacgtaacccg

SEQ ID NO: 249969 - DNA, 623 bp, Homo sapiens
  misc_feature: GYAE6OF02HFNRV.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgcccctgaacctgaaggccaatgagaccaagacaggccaagtggtgtgagcccctgagagctgggccctggtcccaggcagcgctggccctgctgctgcgtgggtactcggccagtcggtccgcccagtcggcctggcctcggccgcccgtaagtcggttacgccaaccggcgaaacggcggggacccaggaccccgtgggacgccgtcgacgttggaacgtaccgacggtaccgagttcccgaacgtcccgtacggccggaacggtcccgtgggtccgggggctaacggggtcccaagggtaccccgaaacgggcccccaaaccccggtacgttacggtacccctaccgttaccgtccgtttaaccccc

SEQ ID NO: 249970 - DNA, 750 bp, Homo sapiens
  misc_feature: GYAE6OF02HECB1.13.4.A04.1.454.CMB.1.raw
tcagtcacgtactacacgaccggtgctcgatttagagtagtgatcagggggcagttggtagatgcccctctgggagagatcccccagggggtgacagccatggaccctggaagggcctgggctagggacagggaccagagccagtccagggagaggacagagccaatggactggggtgtactgtaacagccctgctggcgagagggaccagggcaccgtcctccgagggacgcccatcgctgcaaaggtccgggacctaggaggtcgcccctgaacctgaacggccaactggaacgacccaagaccaggacccaaggtgggttagtaggacgaccccgtgaggtagcgtcgggcccgtcgggtcccgaaggcgagcggccgtcggcccctgcgtcgctcggcgttcgggtcgtcgggtccgtagtcgggtcccgccccggtagtccgggtccgttcggtccgtcgggcccgacccgtaacggtcgggttcggaccgaccgggtaaccggaaaccgggcccgggggaaccccgaaccgggtacccgtaccggggaccgtacccggtaccgtacgggttacgggaaccggtaccgtaccggaccgaccgttaaccgacggtccgacggacggtccggccggtacgggccgggtaccggacggttccggaaccggtaccccggaaacccggaccccgaacccccggtacgtacccgttaccgtaacccgttcccgttaccccggttccccccg

SEQ ID NO: 249971 - DNA, 892 bp, Homo sapiens
  misc_feature: GYAE6OF02IQ94S.13.4.A04.1.454.CMB.1.raw
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaagtggactgggggtntactgtaacngccctgctggcgagagggaccagggcaccgtcctccgagggacgcccagtcgcctagccgaaaggtccgggaccagggtacgggtccgccccgtagaaccgtcggaacggaccctaaagtcggaacgaaccccaaagaaccgaggaccctaaaggttcggggttgtaacggaccggtaacccccgttggaacgggtacgtaccgtcgggtaccccgttcgggtaccccgagggtaccacggcccggtccgtccggggtcccctggtccgttcgggccgttcgggtccggttacggggtccctccgggacccgtaggtttcccgggcccgtaaccccggtaggttccgggcccttacggtacccgtccgggtacccgtacccgttaacgggtcggttacccggccggaacccgggtaccggaaaaccggggcccggggaaacccgtaccgggtaaccccgtcgggtaaccgtcccgttaacgggtaccggggttaacgggaaacccggtaccggtaacccggtaccccggtaacgtacccccgggtaacggtacccgggacggtaacccggggacggtttcccgggacggggtaacgggtcccggtaacgggtaccggtacccggaccccggttaaccggaacccccgtaccccggttatacccggtacccttaaccggttccccgttaccccgttaaccccccg

SEQ ID NO: 249972 - DNA, 514 bp, Homo sapiens
  misc_feature: GYAE6OF02FSKNZ.13.4.A04.1.454.CMB.1.raw
  modified_base (309)..(309): a, c, t, g, unknown or other
  misc_feature (309)..(309): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcgagtcaggacattaacaactattaaatgtatcagcagaaaccaggtaaagcccctaagctcctgatctacgatgcatccaatttggaaacngggtcccatcaagttcagtgaagtggatctagggactagtattttacttcactatcagcagcctagcagcctagaagattattcgactaacattacttactgtacagctagttaatgaataactcctaccgtatacctaccgttcggaccgtaagggacctacggactaggaagtaacttaaacgacgttggtacgctagtaccc

SEQ ID NO: 249973 - DNA, 770 bp, Homo sapiens
  misc_feature: GYAE6OF02JBQHF.13.4.A04.1.454.CMB.1.raw
  modified_base (178)..(178): a, c, t, g, unknown or other
  misc_feature (178)..(178): n is a, c, g, or t
  modified_base (244)..(244): a, c, t, g, unknown or other
  misc_feature (244)..(244): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
tcagtcacgtactacacgaccggtgctcgatttagagtagtgatcgaggggggcagggagtcagtcccaaccaggacacagcatggacatgacgggtccctgctcagctccgtgggcctctgctgctcgtggctctcgaggtcgccagtatggtcgaacatccagactcgaaccccgngtccctcccacttccccttcccgtgtcctagctactcgtaggtaggaagacgaagtctaccacgtntcctacgtcgcccgaaggcgacgtacgaaggactaacttaaacctaactttaatttaagtgtaatacgtacgaacgaacgaaacgtacggaacctaccctagctaccgtntactactacgntacgacacttacgtaaggtacggaaccggacggtacccagtacgtaaacggtntacggtaaggtaggtcgtaacggtacggtagtacgttaacgtttacgttttactacctaactacgtacgtaacggtaccgacggtcccttaggccgtacggttacgtaacggtaacgttacttaggtaaccgtaactaaacctttagtttaaccgttcgttacggtacgtaacgtacgttagttacggttaacgtttaactaaaacccggttccgttaacccggttacacccgggttttacccggaacccgggaaaccgggtaccgtaaccggtaacgggtttaacggaaacggtttaaaccggtaaaccggttaacggtacggtaccgggtacggttaccgtaccctacgg

SEQ ID NO: 249974 - DNA, 667 bp, Homo sapiens
  misc_feature: GYAE6OF02HO1BY.13.4.A04.1.454.CMB.1.raw
  modified_base (378)..(378): a, c, t, g, unknown or other
  misc_feature (378)..(378): n is a, c, g, or t
  modified_base (438)..(438): a, c, t, g, unknown or other
  misc_feature (438)..(438): n is a, c, g, or t
  modified_base (476)..(476): a, c, t, g, unknown or other
  misc_feature (476)..(476): n is a, c, g, or t
  modified_base (493)..(493): a, c, t, g, unknown or other
  misc_feature (493)..(493): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatacgacccagtctccactcctcctgtctgctatctggtaggagacagacgtcaccatcacttcgccaggcgagtcgagactaattaactaactttaatttaaacgtttaggtactacagacaacgaaacgaacggtaaacgaccctaagtccttacctagacttctacgagtcactactactaagtttacggaacgtacgggtacctagtacgtaacgtacgnggtagagtgactcgtagactagttacttttctttacgacctagtacagacacgtccgtanacgtacgtccgtaagaatagttactagaacctaaactnttaagttccgtacgtanaccgtatacgttataacgtaacttaccgtacccttaaccgtcgttaacccttacccgggtaacggaacccggtaaacgggaacccttaacccgggtaaacggttaacggttaaacgaaaccggtttaaacggtaacccggttagggttaaccgggttaccttaccggtaacccg

SEQ ID NO: 249975 - DNA, 545 bp, Homo sapiens
  misc_feature: GYAE6OF02JDOLF.13.4.A04.1.454.CMB.1.raw
  modified_base (151)..(151): a, c, t, g, unknown or other
  misc_feature (151)..(151): n is a, c, g, or t
  modified_base (176)..(176): a, c, t, g, unknown or other
  misc_feature (176)..(176): n is a, c, g, or t
  modified_base (226)..(226): a, c, t, g, unknown or other
  misc_feature (226)..(226): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (455)..(455): a, c, t, g, unknown or other
  misc_feature (455)..(455): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccaggganaggacagagccaatggactggggtntactgtaacagccctgctggcgagaggaccagggcaccgtctccaagggnccatgctgcaagtcgggccagaggtgccctgaacctgaagccaaatgaacgaccaagacaggaccctaaagtgggttgagtagaacccctggaggagcgtaggccctacggcccaagggcaagcgactcggccccngctgctgctgggtctggccagtcggcnccagcggcctgcncgtccgccgtaagtcgtgcaccgtacgaacggcggtaccacggacctacggcnctcgagtagacgcagcactcgacgctgacgngtccgnggtggacgagaccaggcccaagacccacccgacgcgtacactctaccgtaccc

SEQ ID NO: 249976 - DNA, 750 bp, Homo sapiens
  misc_feature: GYAE6OF02IVUVN.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacatccagatcgacccagtcctccacttccctcccttgtctcgactacttctaggtaggacgacagtacgtcacctatcgtacgttcgaccgagggcgacgtacgaggaacctaaattaaacctaaactttaattttaaagttggtaactacgaacggtaccgaaacgaaaaccggtaacgggttaaaacccgaccccgttaacgcctttaccgagtaaccttacgtacgatcgactacttacgtaagttacggaacggtcggtaccatacggtagtacgaggtaggtacggtgacgtacggtagggtacttaacgtttacttttaccttcacctagtaccgacgactacggtccaggaccgtagtaccgtaagaacgttacttacggtaactaacgtaacttacgtttaacttacggacgttaacgaaggtaccgtaagttattacgtaaacttaccctttacccggaacctttaacgtccccggtttaccggaccgggtaaccgggaaacggtaaccccggtacgtaaacgggttaaggttaaaacgttaaacccggtttaaacggtaccgggttcggttaccggtacctcccggttaacccg

SEQ ID NO: 249977 - DNA, 821 bp, Homo sapiens
  misc_feature: GYAE6OF02HVQVX.13.4.A04.1.454.CMB.1.raw
tcagtcacgtactacacgaccggtgctcgatttagagtagtgatcaggggggagtcagtcccaaccaggacacagcatggacatgagggtccctgctcagctcctggggctcctgctgctctggtctctcgaggtcgccagatgtgactactccagactcgacccagttcctcctactccctcccgtgtcctgctatcgtggtaaggacgacgagtacaccactctctacgtcggcgaggacgtacgtacgaacggtaactaacttaaactaaacttaaatttaagtcggttactacgaacgtaacgaaaaccgtaaacggtaacggttaacctaccctacgtacctactaggttaccgtactacgactacgtacctaccgttaacgttaacggtacgggaacccggtcggtacacggttaacggtaaggtcgtaggggtaggtaacggtcgggtagttaccgggaacttacgtttaacgtttttaacctttaccctaccggaacctttagaaccggtacgtaccgtaccggttccgtaacgtacccgtacgtaaacccgttaaagggtaccgtttaacttaaaccgactaaaccgtttaaacgttaactttaaaaccggtttcttaacccgggaacgttaaccgtaacgttaaacggttaaacctacgttaaacgtacctttaccccgtaaacgttacccgtaaccgtttacccgggaaacggttacccggaaccgggtaacgtaccggttaacgggtacggtaaaccgtttaacgtaacggtccggtaggtcccggttacaccggtacgtaccttaccg

SEQ ID NO: 249978 - DNA, 683 bp, Homo sapiens
  misc_feature: GYAE6OF02H38JE.13.4.A04.1.454.CMB.1.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
tcagtcacgtactacacgaccggtgctcgatttagagtagtgatcagggggcaggagtcagtcccaaccaggacacagcatggacatgagggtccctgctcagctcctggggctctgctgctctggctctcaggtgccagatgtgacatccagatcgacccagtctccatccctccctgtcctgcatcgtgtagganacagacgtcaccatccattcgccaggcagtcagactaattaacaacttatttaagttgatcagcaagaaccaggtaaacncccctaagccttccgtagtacttcgtaagacttcgactactacccgttaagtttacgggaaaccgtacgggttcctagtaccgtaaggtttccaagggtagggtaaaggtcggtattacgggtacgggtaacttaagtttaacgtttttacctttacgaaccctagtaccgtaagtccgtaacgtcgttacgacgtacgtaccgtaggtaaacgttattacgttacgaacaacttaagttactaacgttacgtacgtaacgtacgtaagtttaacagttaaacttaccgtacgttaacccggtacttaccgtacccggttacgaaccggaacggttaccaagggtaaccgtaggaaccgtttaaacgttaaacccggagttaccgggtacggttccgttacaaccg

SEQ ID NO: 249979 - DNA, 589 bp, Homo sapiens
  misc_feature: GYAE6OF02G4I9E.13.4.A04.1.454.CMB.1.raw
  modified_base (152)..(152): a, c, t, g, unknown or other
  misc_feature (152)..(152): n is a, c, g, or t
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggatcagagccagtccagggagnggacagagccaatggactggggtgtactgtaacagccctgctggcgagagggaccagggcaccggtcctccgagggancccatgctgcaagtcgggccagaggtgcccctgaacctggagcctaatganacccgaagacaggccaagtggttgtgagaccctgacggagctgggccctggtcccaggcacgcgctcggccctgctgctgctggctcggcagtggtccgccgagtcggcctgcctcgccggaccagtcggttcgactacccggacgaaacggtccggggaacccacggacccgtgggacgccgtacacggttaggacggcgacggccgacgtcccgagcccgtggcggaccgaccgtgcggggtcgagggtccaacgggcccaacgggtcccaacccggtaccacggtccctacgtcccttaccccgg

SEQ ID NO: 249980 - DNA, 554 bp, Homo sapiens
  misc_feature: GYAE6OF02F57K4.13.4.A04.1.454.CMB.1.raw
  modified_base (343)..(343): a, c, t, g, unknown or other
  misc_feature (343)..(343): n is a, c, g, or t
tcagtcacgtactacacgaccggtgctcgatttagagtagtgatcaggggggcagttggtagatgcccctctgggagagatccccaggggtgacagccatggaccctggaagggcctgggctagggacagggaccagagccagtccagggagaggacagagccaatggactgggggtgtactgtaacagccctgctggcgagagggaccaggggcaccgtctccagggagcccatgctgccaagtcgggccaggaggtgcccctgaacctgaaggccaatgagacccaagacaggccaagtgggttgtgagacccctgaggagctggcctggtcccaggcagngcctggcccctgcctgctgctgggtctggccagtcggtccgcccagtcggcctgctcgcgcccaatggttcgcctacgcaacggccgggacccagtaccctggacgccgcagttcggaagcagccgatccgagcctggcgtagcctggagggcgagggtccacggccccgaacggcccaaccccgctcgtccaactccttcggtacccccc

SEQ ID NO: 249981 - DNA, 832 bp, Homo sapiens
  misc_feature: GYAE6OF02I7Y0J.13.4.A04.1.454.CMB.1.raw
tcagtcacgtactacacgaccggtgctcgatttagagtagtgatcagggggagtcagtcccaaccaggacacagcatggacatgagggtccctgctcagctccgtggggctcctgctgctctggctctcaggtcgccagatcgtgacatccagatcgacccagtctccatccctccctgtctgctatctaggtacggagtacgagacgtacacctatcctacttcggaccgacgggaccgtaggtacgaacggtaacctaatttaaaacctaaacgttttaaagttttaaaacgtttacgggttaacttacgaacggtaaccgtaaaaccggaaaaaccggtaaacgggttaaaaaccgtacccccgttaaaaccggtacttaccccggttaacgtaacgtttaccttaaccggtacgtacgtaccgtaacttaaccgttaaacggtttaacgggtaaaccggtaccgggggttacccaaaggttacgtaacggttacggaacgggttaagggaacggttaggtaacgtacggacgggttaaacgtaagttttacctttttaaccgtaccgtaaacctacgtactaacgccgtacgtaccgtagaccgtacgtaccgtaaggtaattacgtaacgtcgtaacgtaacgtactttaacgtaactttacggactacgttaacgtaacgttactaagttaacgttaaccttaccgaccgttaccgtaccgttaccgggttaaccgggaccgtaaacgggtaccgtaacggtaagtaacggtaagttaaccgttaaacgtcgttacgggtaccgtcgaccgttaccgagtttcccg

SEQ ID NO: 249982 - DNA, 710 bp, Homo sapiens
  misc_feature: GYAE6OF02HCBD3.13.4.A04.1.454.CMB.1.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagcctgctggcgagagggaccagggcaccgtcctccagggncccatgctgcaagtcggcagnggtccncctacgactaggacgactagtagacgaaccaagacgacggaccaaggttcgggtagtaggacccgtaccccgtagggaacggaccggtcggtccgggtacccgttccgggtaacccgacgggacgcggccggtccggtccgggtccccgtggtaccggtgtccgtcggtacggtcggtacgtcgtaccgtcggtcgtcccgaccgtgttccggcgtgccgtccgacccgtaccgtaaggttcgggtccgaccgaccggaacggaaccgggacccgggaccgaaccgtccggtacggaccgtcctacgggtacggtaaggaccggtacaccggtaccgccgtaacgcgccggtacgccggacgtcggtacgggcgggtaccgtacgggtaccgacgaacccgggaaccgccccgacccgtacgtccctacgtacccgttccgttccccgttaaccccg

SEQ ID NO: 249983 - DNA, 666 bp, Homo sapiens
  misc_feature: GYAE6OF02F3VVU.13.4.A04.1.454.CMB.1.raw
  modified_base (577)..(577): a, c, t, g, unknown or other
  misc_feature (577)..(577): n is a, c, g, or t
tcagtcacgtactacacgaccggtgctcgatttagagtagtgatcagggggcagttggtagatgccccctctgggagagatccccaggggtgacagccatgggaccctggaagggcctgggctagggacagggaccagagccagtccagggagaggacagagccaatggactgggggtgtactgtaacagccctgcgtggcgagagggaccagggcacccgtcctccgagggacgcccatgctgcaaggtcggaccaggaggtccgcccctagacctggaacgccaatgacgacccaagacaggccaaggtggttgtgacgaccccgtggaggcgcgtcgggccccgtggtcccgaggccgaggccgcgttcggccccttggcctgccgttcggacgttcgggcctcggacctgttcgggtcccacccggtgtcccgggtcctacgtccgaccgtaccctaaggttcggttcgaccgaaccgacggaaacccggcccggggaacccgtaccggtacccggcggacctccgtcgtacgtacggacgcgacgccgtactccgcgtaccgtcggaccggngccgtcggtcgggacgtcgggcacccggtaccggaccgaaccccgaacccgtcgtaccgccgtcctacccggttcctaccccgtacccg

SEQ ID NO: 249984 - DNA, 873 bp, Homo sapiens
  misc_feature: GYAE6OF02H88L2.13.4.A04.1.454.CMB.1.raw
  modified_base (217)..(217): a, c, t, g, unknown or other
  misc_feature (217)..(217): n is a, c, g, or t
tcagtcacgtactacacgaccggtgctcgatttagagtagtgatcgagggggagtcagtcccaaccaggacacagcatggacatgagggtccctgctcagcctccgtggggctcctgctgctctggctctcgaggtcgccagtatggtgacactccgagatcgaacccctagtcctcctactcccttcccgtggtctgcctattccgtaggtagganacgtaggtacgtaccaaccgtactccgtactcggaccgacggtcgtaacgtaccgaacggtaacttaaacgtttaaaacctaacgttttaaaagtttttaaacgttagggtacttacgtaacggtaacccgaaaacggtaaaaaccccggtaaggtaaaacccggtacccccgttaagaccccgtttccttaggtaaccttccgaaaggtactcgacctaaacgttacgtaaaggtttaacggaacggttaccgggacctaagtacgtaggtttaacgaggtttagggaccgttagggtacttacggacgggtaacttactttaaccgtttttacccgtaacacgttaacgtcacggtaactaccgtcgttcgaacgttcgtactaaggtaacgtaacgttctaacggtaactaaattacgttaactaccgtagtaccgagtaacgtaatttcgaaacgttacgttaaccgttccgtaacccgtacgttaaacccggtccgtttaaaccgggaaccggttaaccgggttaaaccgtaacccggggtttaaggtaaaacccgggttaaacggttaaaaaaccccgttttaaccgggaaccgtttaccgggttaaccggttaacccggttacggtaaaccccggtttcctaaacccgg

SEQ ID NO: 249985 - DNA, 612 bp, Homo sapiens
  misc_feature: GYAE6OF02FGPH6.13.4.A04.1.454.CMB.1.raw
  modified_base (227)..(227): a, c, t, g, unknown or other
  misc_feature (227)..(227): n is a, c, g, or t
  modified_base (361)..(361): a, c, t, g, unknown or other
  misc_feature (361)..(361): n is a, c, g, or t
tcagtcacgtactacacgaccggtgctcgatttagagtagtgatcagggggcagttggtagatgcccctctgggagagatccccagggtgacagccatggaccctggaagggcctgggctaggacagggaccagagccagtccagggagaggacagagccaatggactggggtgtactgtaacagccctgctggcgagagggaccagggcaccggtcctccagggancccatgctgcaagtcggcagaggtgcccctgaacctgaagccaatgagacccagacaggaccaagtgggttgtgagaccccgtgaggagctgggccctggtcccgaggcagcgctcgccctgctgctgctggcngcagtcgtcgccagtcggcctgcctgaccgcccctaagtcggttcgcctacccggacgaaaacggccgggtaacccacgacccgtggaaccgcctacacggttacgaacgcgagcccgtaacgttaccgacgtcccgtaggtaccgggacgtccgtgggtcggggaccgtacgggtccaacggtacccgaaccggaaccccgaaccccgtacgtaccggttacccaccgtttcctacccggtttaaccccc

SEQ ID NO: 249986 - DNA, 663 bp, Homo sapiens
  misc_feature: GYAE6OF02HWZXL.13.4.A04.1.454.CMB.1.raw
  modified_base (473)..(473): a, c, t, g, unknown or other
  misc_feature (473)..(473): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatccctccctgtctcgcatcgtgtaggagtacgagagtccaaccatcctacttcgaccgacggcgagtcgaggaactattaaacctaattaattttaaatgttatacgagacgtaacgaaaccgtacggtaaaccgtaccccgtaaacgccttaccgtgtaactaccgtaacgtatcgactacttaccgtaacgttaagggaaccgtacggtacctagtaccgtaaggttacgaggtagggagttagacgtcgtacgggtagtagtttacttttactacgacctatacgtacgcgtacgaccgtcgacncgtacgtagtaacgtattacgtgtaactaacgttaattacgttacgttagaccgtagtaagtacgttagtaacgtaattaccgtaccgtcccgtactaaccccgttacgtccggaacccgtaacgggacctaacggacgtaccggtaagttaaccgaagttcgtacggtcggtctacgtaccaccttacg

SEQ ID NO: 249987 - DNA, 785 bp, Homo sapiens
  misc_feature: GYAE6OF02H6BWQ.13.4.A04.1.454.CMB.1.raw
  modified_base (182)..(182): a, c, t, g, unknown or other
  misc_feature (182)..(182): n is a, c, g, or t
  modified_base (208)..(208): a, c, t, g, unknown or other
  misc_feature (208)..(208): n is a, c, g, or t
  modified_base (394)..(394): a, c, t, g, unknown or other
  misc_feature (394)..(394): n is a, c, g, or t
  modified_base (586)..(586): a, c, t, g, unknown or other
  misc_feature (586)..(586): n is a, c, g, or t
tcagtcacgtactacacgaccggtgctcgatttagagtagtgatcagggggcagttggtagatgcccctctgggagagactccccgaggggtgacagccatggaccctggaagggcctgggctagggacagggaccagacgccagtccgagggagaggacagagccaagtggacgtggggtntactgtaacacgccctgctggcgagnggccaggcaccgtcctaccgagggcgccctagtcgcctgacgaacggtccggggacctaggacggtcgaccccctaggaacctggaacggcaaagtcgaccgaacccaaggaccgacggtaccgaaggttgggttagtagacccgtcccgtaggacggaggccgtcggggccctacgggtacccgnggtacgcgtcggccgtaccgggccctcggctacggtctggtccggttggggtttccgtacgggtaccgtcggttccgggtccgtaccccggtggtccggggtcccgttcgggaccgttaccggcccggtacccgtttaacggttccgggttccgacccgaccggaacggaaccggggaacccgggtaacccnccgggttaacccgcgggacccaccggttagggtaccgttacgggaacgtaccgaacgtccgacgttacccgcgtacggcggtacgccggtacggttcgggacgggtaccggtcggaccgtaaccgggaaccccggaacccgaccccgacccgttaccggtacctccccgttaaggttcccccctaaccgtttccccccg

SEQ ID NO: 249988 - DNA, 833 bp, Homo sapiens
  misc_feature: GYAE6OF02JY0BP.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatcgctgcgaaggtccgggccaggacggtcgccccgtagaaccgtagaacggaccctaagacggaacgaacccgaaacggaccgaacggaccgtaaacgggttgggggttagtacggtaccggtaacccccgtaggaacggggacgaccggtaccggggtaccccgtccgggtaccccgagggaccgacggccgcggttccggccccgtcggccgtcggtccggttacggtccggtttaggggtccgtacggggtacccgtcgggttccggtcccggtacccggtacggtccgggtcccggttcgggtcccgtcgggtaccccgtacgttacgggtttacccggtcggtacccgtaacccgggaaccggtaaacccgggcccgggggaaaaccctccgggtaaaccccggtcgggtaacccgtacccggttaccgggtaacggttacgggaaacccgtacgtcgggtaacccgtacgtaccggaccgtccgtaccggacgggtaccgtccggtacgggtcgggcggttaacggacccggacggtaacccgaccggtaccacccgtacggtcccgtaactcgttacccggcccttccccgg

SEQ ID NO: 249989 - DNA, 660 bp, Homo sapiens
  misc_feature: GYAE6OF02FLY0A.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatcgacccagtcctaccacttcctccctgtctgcattctggtacggagaccaggacgtcaaccatcacttacgcccgaggcgatacgacgtacgtattaactaacttaagttttaaattacggtatactagacaacgaaaccgaaggtaaacgacccctaagcctactgactctacgatgactactactaagttaggaacgtacgggtaccagtacgtagttacaggtaggacgtgtagtcgtggaactaggttaattttacctactacactcgacgactacgtctacgcgtacgtcgtagaacgtgttaatcgaactaaacttacgttaacttacgtacgttacaacgttcgtaagttaagttacgtaacttaaacctccgttaacccgaccttccgtacccgtccgggaaccggtaaaccggtaccgtaaccggtaacggttacggtaaaccggttaacgttaaaaccgggtactttacgggtaaccggtcgtaccggttaccc

SEQ ID NO: 249990 - DNA, 599 bp, Homo sapiens
  misc_feature: GYAE6OF02GNCY0.13.4.A04.1.454.CMB.1.raw
  modified_base (304)..(304): a, c, t, g, unknown or other
  misc_feature (304)..(304): n is a, c, g, or t
tcagtcacgtactacacgaccggtgctcgatttagagtagtgatcagggggcagggagtcagtcccaaccaggacacagcatggacatgagggtccctgctcagctcctggggctcctgctgctctggctctcaggtgccagatgtgccatccagatgacccagtctccatccctccctgtctgcatctgtaggagacagagtcaccatcacttgccgggcaagtcagggcattagaaatgtattaggctggtatcagcaagaaaccgagggaaacgtcccgtaagctcttagatctagtggtncatacctaaggtttaaaaggtcgggtaccagtacgaaggttcaggcggcgtaggtggactcgtaggacacgtacgtacttcgtacttcctacacctatacgacgtacacgtcctacgacacgtccgtagtaacgttagttttacgacttaactttacttacttacgttactaacgtaagtactacaacttaattacgtccgttacgggtacgttcggaaccggtaacgggtaaccgtaagggtaacggtaaactaaccgaaacgtaacgtacggtacgtacgtacgactaacccg

SEQ ID NO: 249991 - DNA, 618 bp, Homo sapiens
  misc_feature: GYAE6OF02HWXY1.13.4.A04.1.454.CMB.1.raw
  modified_base (149)..(149): a, c, t, g, unknown or other
  misc_feature (149)..(149): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (518)..(518): a, c, t, g, unknown or other
  misc_feature (518)..(518): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagcagtccagggngaggacagagccaatggactggggtgtactgtaacagccctgctggcgagaggaccagggcaccgccctccagggancccatgctgcagtcgggccagaggtcncccctgaacctgaaggccaatgagaccaagaccaggaccaagtggttgngacgacccctggaggagcgtggccctaggtcccgnggccagcgcgtcggcccctgctgctgcgtgggtcgtcggcagtcggtcctccgactcgggcctggtcctcgccgacccgtaagtcgggttcgccgtaaccgacggaaaccgggtccgggaacccacggacccgtacgggacctccgtacgtacggttacggacggtctaacggcccgtacncccgacgtccgtacggccgtggccgtgggtgggccgaggtcccacgggtacccaacgacccgaacccgcttacggcctaccgttccgtccgttacccccg

SEQ ID NO: 249992 - DNA, 654 bp, Homo sapiens
  misc_feature: GYAE6OF02JMGX0.13.4.A04.1.454.CMB.1.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (599)..(599): a, c, t, g, unknown or other
  misc_feature (599)..(599): n is a, c, g, or t
  modified_base (604)..(604): a, c, t, g, unknown or other
  misc_feature (604)..(604): n is a, c, g, or t
tcagtcacgtactacacgaccggtgctcgatttagagtagtgatcaggggagtcagtcccaaccaggacacagcatggacatgagggtccctgctcagctcctggggctcctgctgctctggctctcaggtgccagatgtgacatccagatgacccagtctccatcctacctgtctgctatctcttggacgtacaggatccgaaccgtcaccttggacccgggtnacggttccacggacatttaaaccncttatttagaccttggtaatctagcagaagtccagggtacacgtaccctaaagttacttgtaatctcgtgtcgtgtccgtccgtacctgactaacggtccgggggtacctagtccgttcgttaccgtaaggtcggttaccgggtaggtacttcgttaaggaaccgtaggtaaacgtttccgaaaccgtttccgttaccaccgtacttacgtaaaccccgtaacctccggtaccctaaccgtacgtaaccgtagttacggttaacggtaagtttaacttacgttacgtactacggtaacctagtacggttcgtacgccgtctcgttaagtttccggaggacggactaggtntacgngaactacaacgtaacgtcgttacgacttcgcgtacgacttcgtacttacg

SEQ ID NO: 249993 - DNA, 633 bp, Homo sapiens
  misc_feature: GYAE6OF02HECXT.13.4.A04.1.454.CMB.1.raw
  modified_base (306)..(306): a, c, t, g, unknown or other
  misc_feature (306)..(306): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaaacagccctgctggcgagagggaccagggcaccgtcctaccgagggcgcccatcgctgcaagtcgggccaggagtcgccctgaacctgacgcaatcgagaccagacacggaccaagtgggtgngacgacccctggaggacgcgtcgggccgtcggtcccgaggccgagccgtcgtcggccctgccgtgcgtgtcgtgggtctcggcgtacgtcggtccgccgtacgtcggctcggccgtcgccgtaccgtaagtcggttcgaccgaccgacgtaacggaccgggtacccacggacccgtggacctcgtacgtacggtaggacgacgtacgccgactccgtacgaccgtggaccgtcgcggtggtcgggagtcgggtacccgaccggaaccgaacccggaccctaaccccggtactaccggtacctaccggttacgtccccgttacccccg

SEQ ID NO: 249994 - DNA, 676 bp, Homo sapiens
  misc_feature: GYAE6OF02FG4JG.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtcctccatcctccctgtctgcatctgtaggagacagagtcaccatcacttgccaggcgagtcaggacataacacttatttaatgtatcagacgaagaaccgtaggtaaaccacccgtaagcctacctgacgtctacgtactcgcgtactaccgtaagtttaacgggaaacgtacgggttaccacgttacgtaacgggttactaggtacggaaggttacgggtatcggtaagggtacttaagttaacttttttaaccgttactaaccgtagtacgaacgtcgaaccggtacctcaccgtaacggtccctaaaggtaaacgtagttaacgttaggtaaaccctaacgttaattaactttaccgtagttaaccgaggtacttaacggttagtacgttaataacgtttccgacccgtattacctaccgttaccggaacccggtaaacgggccaaacggttacggacgtaacggttaacttaaaccggtaacgttacggtcgtaccggtagtaacccg

SEQ ID NO: 249995 - DNA, 699 bp, Homo sapiens
  misc_feature: GYAE6OF02GE3OB.13.4.A04.1.454.CMB.1.raw
  modified_base (409)..(409): a, c, t, g, unknown or other
  misc_feature (409)..(409): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccacttcctccctgtctgcatctggtaggagacagacgtccacctatccgtacgttggaccggggtacaaggtcgaagggacaagtttaagaaatgtaagttaggcttaggtatacgagacaagaaacgacggaacgacccgtaagtcctagttacgactactagtggtagctacgtacgtaaaggtttaaaacggtcgggttacccaagttacgaaggttacgaaggtcgacgaggtcgaactcgnggtacaacgtacgtattaccgattcctaaccacccgtatacaacgctaacgtcctacgaccgacgtaccgttaagtaaacgtttagtttaccaacgttaacttacgttcctttaagttacccttaaaggaacctagtaaccgttaactaaagtttaccgtaccggtcgggtttaaccggttccggaaccgggtaacggtaaccggtaaaggggtaactaaaacccggttaacgaaaccggttaacgtcgggttaccgtacgtaaccttaccggtaccttacggttacccg

SEQ ID NO: 249996 - DNA, 767 bp, Homo sapiens
  misc_feature: GYAE6OF02HRIEO.13.4.A04.1.454.CMB.1.raw
tcagtcacgtactacacgaccggtgctcgatttagagtagtgatcaggggggcaggagtcagtcccaaccaggacacagcatggacatgagggtccctgctcagctcctggggctcctgctgctctggctctcaggtgccagatgtgacatccagatcgacccacgtcctccactccctcctgtctgcatcgtaggtaggagacagagtaccacctactctactcgccgaggcgagtacgagtactaactaacctaacttaatttaagttgtactcgacgtaccgaagtaaaccgaacggtaaacctacccctaagtacccttacctagtacctaccgtaacgtacgtacgtacctaacttccgttaaacggtttaaccgggaaaccgggtaccgggtaccctacgttaaccggtacgggtttacgagggttaagggtaacggtagggtacgttacggtacggggtaacttaacggtttacctttttaccgttaccaaccttagtacggaactacccggtagtcccttacggactacgtaccgtaagtactaagttacgtacgaacttaacgtaatttaccgtttacgacgttacgagttactaggtaacttagtaaaccgttaaccttcccggtacctaacgttccccgtaaccgggttcccgaaaccggggtaacgggtaccctaacgggttacggtaaacgggttaactttaaaaccgggtaaccgttaacggttacgggtaccgggttgtacccgtaaccccg

SEQ ID NO: 249997 - DNA, 822 bp, Homo sapiens
  misc_feature: GYAE6OF02JOP85.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctgggctcctgctgctcgtggctctcaggtgccagtatgtgactacttaccgagtactacgaaccctagttccctaccctacttccccttccccttgtcgtacgtcctacttccgttaggtaacgggagaaccgaggtactaccaacctatacctaacgttcgacccgtaggcggtaacgtacgaacggtaactaacttaaaacctaaactttaattttaaacgttggttaactacgaagtaacgtaaaacggtaaaaccgtaacgggtaaaacccgtaaccccgttaaacggtcccttaccgtaacgtaaccgttaaccgaacgtacttacaccttaacgttaccgttaaaggtttaacgggaaaaccggttacggttaccaacgttaacggtaacggtttacgaaacggttagggtaaacggtacggtaacgtcggggtaacgttacggttaagtttacttttaaccgtttaactaccgtactacgacgtactacgtactgtacgacgtacgaacgtaatacgttactacggttaactaacgttacgttaacgtttacgtcgttaaccgaacgttgtaaacgttagtaaccgttaacgtaacccttacgttaacccgttaccttacggttacccggacgtaaccggaaccggtactaacggtacgtaacggttaacgaacgttaacggtaaccgtgggtaccttcgagtacccg

SEQ ID NO: 249998 - DNA, 835 bp, Homo sapiens
  misc_feature: GYAE6OF02GSWFL.13.4.A04.1.454.CMB.1.raw
  modified_base (711)..(711): a, c, t, g, unknown or other
  misc_feature (711)..(711): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtcgccaggatgtgacatccagatcgacccagtcctaccactccctccctgtctgccattcgtaggtaaggagaccgagtacgtaccaccaactctaacgttcgaccgaggcgagtacgaacggtaacctaattaaaacctaaattttaaagtttaaaagttcggtaattaccgaagtaaccgaaaacggtaaaaccgtaagggtaaaccccgtaccccttaaaggtcccctaccgttgtaaacgtaccgtaacgtagtccggtaacttacgttaaacccgttaaagggtttaaccggggaaaaacccgggttccggggttaacccctaaggtttaccggttaaaaccggggtttaccgaaaggggtttaaggggtaacgggttacgggttaaacttacgggggttaaaccgggttaactttaaagggttttttaaacccttttttacccggttaacccgaaacgttaacgtaccgaacggtacccttaacggtccccggtcgaacgtaccgggtactaaggtaaaacgtattttaccggacgttaactaaactttggttaaaccttcgtagtaaacccgnggtaactagtacgacgttaactccctaccgtcgtactacccgtacgaccggacgaacggtaccgtaacgacgtaaggtaaacgtaaacgttacgtagtcggtaaccgctaccgttaccattacg

SEQ ID NO: 249999 - DNA, 796 bp, Homo sapiens
  misc_feature: GYAE6OF02JCFXE.13.4.A04.1.454.CMB.1.raw
  modified_base (309)..(309): a, c, t, g, unknown or other
  misc_feature (309)..(309): n is a, c, g, or t
tcagtcacgtactacacgaccggtgctcgatttagagtagtgatcagggggcaggagtcagtcccaaccaggacacagcatggacatgagggtccctgctcagctccgtgggctcctgctgctctggctctcgaggtcgccagagtgtgacagtccaagactcgaccctagtcctacctactccctcctgtctagctacttcgtggtaaggacgacgaaggtacttaccacctactacctaacgttccggaccgtaggaccgtacgtacgacggtaactaagtaacctaacttaatttaagttacggtntacgatacgtaagaaaccgtaacggtaacccgttaacccgtaaccgtaccttaccgtacgtaccgttacgaacggtacttacggacctaacgttaaccgttaacgtttaacggggaaaccgtaaccgggttacctaaagtaaccggttaacgtacggtaacgttaagggtacgagtaccgttaggaacggtaacgtacgtttaactttttaccgtacctacggtaactaccgtaagtacccgtctacccggtgtaccgaaacgtccgtaaacggtaaacgtaacgttaggttacctaaaccgtaacttaaacttacgttaagtaccgtacggtaacgtaaccgtagttaacgttacgtaaacctaccgtaccgttacccgttaacaccgttacccgtacgggtacccgaaagggtccaaaggggtacccttaaggaaccggttaacctaacgggttaccgtacgggttccgtaccgtacgtaacccg

SEQ ID NO: 250000 - DNA, 747 bp, Homo sapiens
  misc_feature: GYAE6OF02HQLZP.13.4.A04.1.454.CMB.1.raw
  modified_base (182)..(182): a, c, t, g, unknown or other
  misc_feature (182)..(182): n is a, c, g, or t
  modified_base (193)..(193): a, c, t, g, unknown or other
  misc_feature (193)..(193): n is a, c, g, or t
tcagtcacgtactacacgaccggtgctcgattttagagtagtgatcagggggcagttggtagatgcccctctgggagagatccccaggggtgacagccatggaccctggaagggcctgggctagggacagggaccagagccagtccgagggagaggacagagtaccaagtggacgtggggtntactagtaacncgtccctgcgtggacgtaggagggaccctagggcctacccgtcccgtccggagggtaccgacccgtagtcggccttcggaccgtaacgggtcccgggaccgaggtaaccgggtccgacccccgttaagtaaccgtacgggaacggacgtaacgtacgaaccggtaaacccaagaccgaacggtacgtaaggtgggttcaggaacccgtcccgtaggtacggacgcggtaccgggccctacgggtccgaccggtcgaggtcccggacttcccggcccgtgcgtcgtcgtcggtccgtggtcgtccgggtactcggttccgaccgtaccgtcgtcggccgttacgccgtccgtacccgtacgtacggtcgtccgaaccgacggaccgaaccgggccggaaccgacgccgtaacggccgtacgtaccggtagtaccggtactccgtaacgccgtacgtcgacgtccgaggtccgtacggcgcgggtacggtcgcgtacccggaaccgcccgtaaccgcccgtaacgtccgtacgccgtactcccgtccggttacccc

SEQ ID NO: 250001 - DNA, 740 bp, Homo sapiens
  misc_feature: GYAE6OF02JLYM9.13.4.A04.1.454.CMB.1.raw
  modified_base (618)..(618): a, c, t, g, unknown or other
  misc_feature (618)..(618): n is a, c, g, or t
  modified_base (653)..(653): a, c, t, g, unknown or other
  misc_feature (653)..(653): n is a, c, g, or t
  modified_base (662)..(662): a, c, t, g, unknown or other
  misc_feature (662)..(662): n is a, c, g, or t
tcagtcacgtactacacgaccggtgctcgattttagagtagtgatcagggggcagttggtagatgcccctctgggagagatccccaggggtgacagccatggaccctggaagggcctgggctagggacagggaccagagccagtccgagggagacggacgagaggccaagtgggacgtggggtgtacgtgtaacacgccctgtcgtggcgaggacgggacgacgggccacccggtccgtaccgaacggggactcccgagttgcctgacgaacggtcgggccgaggaggtccgccccgtagaaccgtgaacgtaccaagtcggaaccgaaccgaacggaaccgacggacccgtaagggttgggtcggtacgacccggtaccccgtggaacgggacgccggtcgggtccccgtacggcccgaggtccgaacggtccgccggtccggtacccgttcgacgtcgtccgtggtccgttacgggtcgccggacgtacggtccgtacccgaccgtacgtcgtccgtacgtcgtccgaccgtccgtacgttccgtacggaccaccggacgacccggtacccggcgaccggtaccgtcgaccgtcctacgtacggtacgcgaaccgngtcccgcgccgacgtccgacgccggtcgtaccggngttaccggnggttaaccgggcaaccgggcccgtacgaaccccggtaccgagtacccgtacgttaccgccccggttttacgtcccccg

SEQ ID NO: 250002 - DNA, 791 bp, Homo sapiens
  misc_feature: GYAE6OF02IOA3C.13.4.A04.1.454.CMB.1.raw
tcagtcacgtactacacgaccggtgctcgatttagagtagtgatcaggggggagtcagtcccaaccaggacacagcatggacatgagggtccctgctcagctccgtggggctcctgctgctctggctctcaggtgccagatgtgacatccagtatgacccagtctcctactcccttccctgtctgctattcgtggtaggagacgagacgtccacctatctacgtgccacgggacgactcgaggtacctaattaactaacttaattttaaagttgggttactacgacgtaacaagaaaccgtaaggtaacctacccgtaagtaccttccgtagtacgtactaacgtatcgctaacttaccttaaggtttaccggaaacggtaccggggtacctacgttaacggtaacggtttaccggaggttaagggaagttacgggtactacgggtaggtaacacggttactttacctaccttccgttacaccgtataccgtaaccgtcgtactacggtacctaacgtacggtaaggtactcggtacctaaccgttaacttaacccgtagtaaccgtaaccctaaacgtttaccgttaacccggttaaacccgttacccgtttaaccggtttaccggtttaacggttttaccggggacccggttacgggtaacccgggttacggtaaccgggttacgggtaacgtaacccgtaaacggaaacccgtttacggttaacgggtaccgtaacgttacccggtaccggtaacccttacgtttaccgttccggtttacccttaccg

SEQ ID NO: 250003 - DNA, 843 bp, Homo sapiens
  misc_feature: GYAE6OF02GK3US.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctgggctcctgctgctctggctctcaggtgccagatgtgacactccagatcgacccagtcctccatcctccctgtctgcactctgtaggagacgagacgtcacctatcctacgttcgggccgggtactaacggcgacgggactaagtttaaggaaacgttggttaacgtttaacgggtcgttagggtaacttacgacggtaccgaaacggaaaacccggtaaacggggaaaccgtaccccgtaaacggtcctttacgttacgtacttaccgttaggtttacgggtacaccgtacgttaaccgttaagtttaaccgggtaaaaccgggtaccgggggtaccctaacggtaccggttaacgggttaacggtaacggggtaggttaacggtacggtaacgtcggttacggaacgttacgtttaactttttaccgtactacctacgtcgacgtacgaccgtaccggtcgacgtaccggtacgtaacggtaacgttacttacggttaaccgaaccttaacgttaaccttttacgttaaccggttaacgttaccggttaacgttacctaacggtttacgtaacggtttaacccttaacttacccggttacccgttaacgttacccgtaaccggtttacccggggtaacccggtaaacgggtaacccgtaaccggtaaccgggttaacggtaacgttaaaccggttaacggttaacggtacgtttacccggggacttaacccgg

SEQ ID NO: 250004 - DNA, 683 bp, Homo sapiens
  misc_feature: GYAE6OF02GTN3A.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatggtgacatccagatcgacccagtctccactccctccctgtctgctatctggtaggagacagacgtacaccatccacttcgaccgaggcgagtcgaagactaacttaaacaacttaatttaattgtatacgagacaagaaaccgtaaggtaaaccacccgtaaacgccttacctacgtactacgacgtatacgactactaccgtaagtttaacgggaaaccgtcgggtaccctaagttacgaaggtttcgaaggtagggtaacgttggaacgttcggtaggacgtagtttaactttttaccttaccgaacctacttacgactaccgacgtccccgagtaccgtaacgtaccgttaaggaattagttactacgaactaaccgttataaactttcgtagtcaaggtactagtaagttacgaaactttaccggccgttacccgactccgtttaccccgggtagaacccggtaacggaccgtaacgtggtaaccggaaagttaaccgttaaaccgggtacgtacgggtaccgacgttcgaacccc

SEQ ID NO: 250005 - DNA, 703 bp, Homo sapiens
  misc_feature: GYAE6OF02GZW3U.13.4.A04.1.454.CMB.1.raw
  modified_base (261)..(261): a, c, t, g, unknown or other
  misc_feature (261)..(261): n is a, c, g, or t
  modified_base (629)..(629): a, c, t, g, unknown or other
  misc_feature (629)..(629): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggagggaccagggccaccgtcctccgagggacgcccagtgctgcgaaggtccgggccaggnggtcgcccctagaacctgaacgccaatgaacgacccaagacgaggaccaaggtgggttagcggacgaccccgtagacggacgcgtcgggcccgtcggcccgaggccgtagcgcgtccggcccgtgcgtcgctcggcgtcgggtacgcggtaccgtacgtcggtaccgcccgtacggtccggcccgtcggtccgtccggtcccggacccgttaaggttcgggttaccgacccgtaaccggtaacggaaacccggggacccggggaacccctacgggaccccgtacgggtacctaccggttaccgtacgggtacggaacggaccgtaacggccgtaactccgacgtccggagtcggacgtccgtacgggnggaccggtacggaccgacggacccgtaccggacccttaccgacgttaccgccgtaccgtccctaccgttccccg

SEQ ID NO: 250006 - DNA, 941 bp, Homo sapiens
  misc_feature: GYAE6OF02FIJNV.13.4.A04.1.454.CMB.1.raw
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatcgacccagtcctccatccctccctgtctgcatctggtaggagacagacgtcaccntcacttgccaggcgagtcaggacctaagttaaaccaacttaattttaaagttggttanacagcaaagaaaccaaggtaaaccgacccctaagtcctccgtagactactacgactcgaccgtaactacccgttaaagtttaccgggaaaaccgtaccgggggtacccctaagttaccgtaacgggtttaccgtaagggtacgggtaaaggttcggggtaacttcgggttaacgggggaaacctttaagggttttaaacctttttttaacccgtttaaccctaccgttaaacgttaccgtaacgggaccgtaaccggtaccccgttcggtaacccgtaaccggttaccccgttaaagggtaaacggttaaacgtttaacggttttaaccggaaacccgttaaaaacgtttacgtttttaaaaccgttttaaccgtttaccgggttaaccgttaacgggttaaccgttaaacggggtttaacgttaaacgggtttaaaacccttttaaacccggttttaaccccggttaacccccgttaaaccgtttaacccccggtttaaccccggtttaaccccggggtaaccgggtaaaacccgggggtaaaccccgtaaaccgggttaaacccggtaacggggtttaaaaccggttaaaaccggttttaaaaaccccggtaacgggtttacgggttaacccggtaacggtttaacccgggacccttaaaccccggttaaccgg

SEQ ID NO: 250007 - DNA, 810 bp, Homo sapiens
  misc_feature: GYAE6OF02GEY6Q.13.4.A04.1.454.CMB.1.raw
tcagtcacgtactacacgaccggtgctcgatttagagtagtgatcaggggggcgagttggtagatgcccctctgggagagatccccaggggtgacagccatggaccctggaagggcctgggctagggacagggaccagagccagtccgagggagaggacagagccaatggactggggtgtactgtaacagccctgcgtggcgagagggaccgagggcaccgtcctccgagggacgccctagtcgctgcgaaaggtccgggaccaggtacggtcgcccctacggaaccgtggaaacgggccaaacgtcggaacgaacccgaaaggaccgaacggaccgaaacgggttcggggttacgtacggaaccggtacccccgtagggaacgggtaccggccggtccggggccccgttccgggttccccgagggaccgacggccggtccggtccggtccccgtacggccggtcgcgtcggccggttcgggtccgtccgggcgtacgttccgggtccgtacccgtaggtccggtccgtacggcgttaccgggcctaccggtagttacgggtcgacccggaaccgtacggaaaccgggcccgggaaccctaaccggcccgttaggacccgtccgtacgttaaggtacggaacgtacggaccgacgtaccgtcccgacggtccctacgggtaccggacggtcccggtggggaccggggtaccgacggggttcccgaaccgggacccccaaaaccgggcccccgtaaacccggtcggttacccgtacttaacccgttccccggttacccgttacccccccgg

SEQ ID NO: 250008 - DNA, 777 bp, Homo sapiens
  misc_feature: GYAE6OF02INE1T.13.4.A04.1.454.CMB.1.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
tcagtcacgtactacacgaccggtgctcgatttagagtagtgatcagggggcaggacgtcagtcccaaccagacacagcatgggacatgagggtccctgctcagctccgtgggactcctgctcgctccgtggtccacccgagtactaaccagattggcgaactactacccgagtaactcggacccagtcctaccngtccctcctgtacctgtactatcgtacgtacgganactacggtatccaccgttcacgttcggcggacaacggttccaagacttaacttaccgtatttaacgttcnccgtaggtanaccgngaacccgagaacccggttacaggggactaacggtaccttaaatttagtcggaatcgttccgatcgtactccggtctaacctcggaccgtaaccggtccgggttcctaacgttccgtaacgtttcgacgggttcgggccggaaaagttgttaaccgggaagttacggaaccttttaaacggtccaaacgttcctttaaccgtaaccccgtagttaaacccaacccttaaccgggtaaccacgtttaacccggagttaagttaaccgtaaggtttaccgggtaaaattcgggttaaacctacgttcggtaacccgtagtacggttaacggttaccggtcggttaaaccggtcgttacgttaacccggttgggacccggaagttcgggaacgttcgacccgttaagggccttaaaggaacccggtgtacgggttctcggataccccgtacgacttcggttaaacc

SEQ ID NO: 250009 - DNA, 704 bp, Homo sapiens
  misc_feature: GYAE6OF02FI7W5.13.4.A04.1.454.CMB.1.raw
  modified_base (428)..(428): a, c, t, g, unknown or other
  misc_feature (428)..(428): n is a, c, g, or t
  modified_base (524)..(524): a, c, t, g, unknown or other
  misc_feature (524)..(524): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatcgacccagtctccatccctccctgtctgcatctgtaggagacagacgtcaccatactacttgaccgaggcgagtcgaggaactataaactaacttaatttaagtggttatcagacaacgaaaccgtaggtaaacgaccctaacgtcctacctagtactacgtacgagtcgactataccgtaagttacggaaacgtacggggtaccctagtacgtacggttacgtaggtaggtaaggtgagtcgtaggactagttacgttttacttcacttanacgtagctacgtaccgtgaacctacgtcgtaaggaactagttacgtacgtaactaaactaagttactttacgtagtaccgtagtacgtacgtttanaacgtttaaacgtaaaccttccccgttaacccgggttaacctttaccccggttaccccgttaacccgggaaccgggtaaacccggggaacctaacccgggtaaacgttaacgggtaaaccgttaaaaccggttaaaccggttaaggttacggttaccgggttaccgttaccggtaacccg

SEQ ID NO: 250010 - DNA, 730 bp, Homo sapiens
  misc_feature: GYAE6OF02FLD3N.13.4.A04.1.454.CMB.1.raw
  modified_base (242)..(242): a, c, t, g, unknown or other
  misc_feature (242)..(242): n is a, c, g, or t
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
tcagtcacgtactacacgaccggtgctcgatttagagtagtgatcaggggcagttggtagatgcccctctgggagagatccccaggggtgacagccatggaccctggaagggcctgggctaggacgagggaccaggagcccagtcccaagggacaggacagagacctaagtgggactggggtgtactgtaacaggccctgccgtggcgagacggggaccagggcaccggtcctccgagggancccctatcgcctagctaacggtccgggccaggtagggtcgccccctggaacccttgaacgggcccaaaagttcgacggaaccccaagacaggcccaaagtcggggttatggaacgtccccctagacggagtctgggccncggtcccaggcaggtcgcttcggccctgcngctgcctggtcnggtccagttggacgcccgagttccggctggcgtacgccggccccgaatttcggtcgacgacccgaccgtaaacgggccgggtaacccacggaccccgtcgggaccgtcccgtaagtcccgttagggaaccgtccgaacggtacccagtacccgtaaccgccggttaaccggtccggaacggttcccgacggggttaccggggacgtaccggttaccgaccggacccccggttaacggaccccctaaccccggtaccggtttacccgaacccggttcccgttacccgttccgtttaaccccccccggg

SEQ ID NO: 250011 - DNA, 602 bp, Homo sapiens
  misc_feature: GYAE6OF02JCKIC.13.4.A04.1.454.CMB.1.raw
  modified_base (121)..(121): a, c, t, g, unknown or other
  misc_feature (121)..(121): n is a, c, g, or t
  modified_base (180)..(180): a, c, t, g, unknown or other
  misc_feature (180)..(180): n is a, c, g, or t
  modified_base (263)..(263): a, c, t, g, unknown or other
  misc_feature (263)..(263): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
  modified_base (555)..(555): a, c, t, g, unknown or other
  misc_feature (555)..(555): n is a, c, g, or t
  modified_base (594)..(594): a, c, t, g, unknown or other
  misc_feature (594)..(594): n is a, c, g, or t
tcagtcacgtactacacgaccggtgctcgatttagagtagtgatcagggggagtcagtcccaaccaggacacagcatggacatgagggtccctgctcagctcctggggctcctgctgctcnggctctcaggtcgccagatgtgacatccagatcgaccagtctccatcctccctgtctgnatctggtacgagacaggacgtcaccatcactcgccgaggcgagtcgaggacaagttaaacaacttaatttaagttggtatcanacaacgaactagtaacgaccctagcctctgataccagtatcgctactacctaagttacggaacgtacgggtacctagtacgtaagtcgaggtaggagtaggagtcggtaggactagttactttaccttcacatcgtacgctcggctggcagtacgtagaagttatacgtnacgtaatnttacgttacgntaccgagtactaacggttctagtaacttaccgttacccttaccggtaccttaccggtaacgttaccggaccgagggttacccgaacggacgttaacgggtaanaacccgttaaggacgtttgggaccgtacgaccgttaccngtttaccc

SEQ ID NO: 250012 - DNA, 844 bp, Homo sapiens
  misc_feature: GYAE6OF02GIQ43.13.4.A04.1.454.CMB.1.raw
  modified_base (128)..(128): a, c, t, g, unknown or other
  misc_feature (128)..(128): n is a, c, g, or t
  modified_base (133)..(133): a, c, t, g, unknown or other
  misc_feature (133)..(133): n is a, c, g, or t
tcagtcacgtactacacgaccggtgctcgatttagagtagtgatcagggggagtcagtcccaaccaggacacagcatcggacatgagggtccctgctcagctcctggggctcctgctgctctgctctnaggtnccagatgtgactatcagatgacccagtctccatcctcctgtcagcatcgtagtaggagacagacgtccaacctacgtctaccttcggaccgaagggcctaacgtccgaaggaacctaacttaaacctaaactttaatttaacgttaggtactactagactaagaaccgaaacggtaaccgtaaccctaacctacttacctagtagtacctaacgtacgtacgtactaaccttacgttaaacggtttaacggaaacgggtaccgggtaccctaacgtaccgttaacggttaacgttaaggtagggttaaagtacggtaacgttacggtacgggggtaaacctaacggtacgtttaccttaaacttaccctttaccaaacccctagtaacccggacggtaacccgtacggtacccctaacgacccgtaacgtacccgggttaggtaaaccgttaagtttttaccgaacgtttaaacttaaacttaccgttaaaccggttactaaaccgtaaacgttacctaaccgtaaaacgttaacttaacccggtttaccggtaccgggttaaacccggtttaccgggaaacccggaaacgggttaccgtaaacgggtaaccggtaaaacgttaaaccgttaaacccgggtaacgtcggggttaacccgttacggtaacccgtaccttaaccccgtttagttacccggtttagtttacccc

SEQ ID NO: 250013 - DNA, 804 bp, Homo sapiens
  misc_feature: GYAE6OF02JGL45.13.4.A04.1.454.CMB.1.raw
  modified_base (214)..(214): a, c, t, g, unknown or other
  misc_feature (214)..(214): n is a, c, g, or t
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacactccagatcgaccagtctccactccctcctgtctgcatcgtaggtaggagacagtactccaaccnctcgacttcgcccgaggcgagtcgacggtacaacttaactaacttaattttaaagttagttacacgtacaccgaaacgaaaccggaacggtaaaccgacccctaacgtacctaccggtacgtacttaaccgtacgtactacgtactaacctttaaccgttaacggtttaaggggaaacccggttacggggtacccctaacgtaaccggttaaacgggttaccggtaaggtaacggggtaacggtacggttaagtaccgggtaacggggttaaccttaacgggtttaacttttttaacccgtttaacctactaaccggtacaacgtccgaaccgtccgtacgaccgtacgtacgtaagagttaacttaacgtcgaaactaacttacttacgtttacctagttacctaaggtactacggtttaagtaacgtaacccgtttaacctaaccgttcccggtaacttacccggttacccggtaaccggaccccggggttaaaccggaccggttaacccggtaaggaaaccggttaaccgttaaaacggttaaacccggttaaggtttaccgggaggtaccccttaagtacccccgg

SEQ ID NO: 250014 - DNA, 992 bp, Homo sapiens
  misc_feature: GYAE6OF02HGMHU.13.4.A04.1.454.CMB.1.raw
  modified_base (99)..(99): a, c, t, g, unknown or other
  misc_feature (99)..(99): n is a, c, g, or t
tcagtcacgtactacacgaccggtgctcgatttagagtagtgatcagggggcaggagtcagtcccaaccaggacacagcatggacatgagggtccccgntcagctcctggggctcctgctgcctctggcctccgaggtcgccagatgtcgccatccagtatcgacccagttcctccacttccctccgtgtctacgctattcgtaggtaacgggactaacaggtacgtaccaacctataccctacgttcgggacccggtacaacggtcggtagggaactaagttaaagaaagtaggttaacgttacggtctagggtaactacggaagaccgtaaacgtaaaaccgaacggggtaaaccctcccgtaaacgttccgttaccgttagtacgttacggttaagggtaccggtacgtaaccttaacggttaaaccgggttaaaagggttttaaaaccggggccgggttaacccttaacggtaacggttaaacgggtttaccggaaccggtacccggggtagttaaacggttaggtaccgggttacgtaaccggggtacgaacccgttaaagtttacccgtaactttaccctttaaccgtaaccctaaacccgttacgtacccgggtaacacccggttacccggtaccgtaaccgttaccggacccgtaaaccgttaacggggttaactttttacggtttaaacctaaccggttttaaaaccgtacgtttttaacccgttaaccggttaaccttaaaccgggttaaactaacccgttaacctttaaaacgttaaccccgttttaacccgggttaacccggggttaaccgggtttaaccccggtaaccggggttaacccgggtaaacccgggtaaaacggggttaacccggttaacgggttaaaacccgggttaaaccgtaaaacccgggtaccggttttaacgggtaacccggccggttttaaccggacccgttttacccgttagttaaccccccggg

SEQ ID NO: 250015 - DNA, 611 bp, Homo sapiens
  misc_feature: GYAE6OF02FG8O0.13.4.A04.1.454.CMB.1.raw
tcagtcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtcctcatcctccctgtctgcatctgtaggagacagagtcaccatcacttgccaggcgagtcagacattaacaactatttaatgtatcagcacgaaccgagtaaacgacccctaagcctacctgatctacgtatgcactacctaagttttaggaaaacgtacggggtacccacgtactaaggttactaggttacgggaagtaggtatacgttagggactaagttactttttaactttccaacctaacgtcctaacgtcgacgtcccgttacgaccgtacgacctacgaagtacttaagttacactaaacattacttactgtcagtacgtagtaagttagtagtaactacccgttccgactaccgttaccgtacggtacgaacgggacctacggtaacgtacggtaacgtaacgttaaaccgtaacgttcggtacggtacgtcgtaaccg

SEQ ID NO: 250016 - DNA, 907 bp, Homo sapiens
  misc_feature: GYAE6OF02GGKLA.13.4.A04.1.454.CMB.1.raw
  modified_base (534)..(534): a, c, t, g, unknown or other
  misc_feature (534)..(534): n is a, c, g, or t
tcagtcacgtactacacgaccggtgctcgatttagagtagtgatcagggggcaggagtcagtcccaaccagacacagcatggacatgagggtccctgctcagctcctggggtctccgtgcctgcctactcggctacgtacgaggttcgcccgaaggtatacgttcggaaccacgtcccaagtacttacggaacccctaacgtctcccacttcccgtccccttggtcctacgcacttcgtacggtaggacacctaggacgtcctaaccacgttaccgtaactttcggacccgacgggaccgacggttacccgaggtaacctaaagtttaaaccctaaacggtttaacttttaaacggttacggtaacttacgaaccggactaaaacggaaccgtaacggttaaacccgtacccctaaaggttccaacttcggaacttccgtaacacgtggtaccctactacgttaacggtttaaacggaaccgtaccggggtacccacttacgtaaccgggttatcgggtaaagtacggtacgtntaacggggtgtaaaccgtgttttaaccgtttttacctacgtaccgtaactccgggaaacctccgtaaccggttaccgttccggaaaccgtacccggtttaaccgtaaggggtaaaccggtttacttaaacgggtttaccggtaaccctaaagttaaaccgtttcttaacccgggttaggtttaccccggaaggtaaccctaagggtttaactaacggttaaccttaaaccgtcccggttaaccggttaccctaacccggtttccgggttaaccggaacccgggtaaccggtaacgtaacccggtaaccggtttagggaaacccgtttaacgttaaccggaaccgtttgggacgttacccggtacttaacccgg

SEQ ID NO: 250017 - DNA, 819 bp, Homo sapiens
  misc_feature: GYAE6OF02HO8CQ.13.4.A04.1.454.CMB.1.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
tcagtcacgtactacacgaccggtgctcgatttagagtagtgatcagggggcagttggtagatgcccctctgggagagatccccagggatgacagccatggaccctggaagggcctgggctagggacagggaccagagccagtccagggagaggacagagccaatggactggggtgtactgtaacagccctgctggcgagacgggaccagggccaccgtcctcagggacgccatgctgcaaggtcggaccaggnggtcncccctgaacctggaacggccaagtgacgaccaagacgaggaccaaggtcgggttgtcgacggtacccctggtacggacggtccgtcgggccccgtgggtacccgacggtcgacggccgtccgttcggccccgtgccgtcggtaccgttcggtccggttacgggtccgtcgggtacccgtacggttccgggtacccggtccccgtacggttccggccgttcggtacccggtccggaaccccggtacccggtaacggttcggggttccgaccggtacccggtaacccggaaaccgggtcccgggggaacccctaccgggtaaccccggttagggaccgtacccgttaccggtaagggttaccggtaaccggtccgtacggtacccgtaaccgtacccgacggttccccgtacgggacccgggtccggtacccgggttcgggggttaccgggaccggttaaccggggtacccgaaccgggtaaccccggaaaccccgggtaccccgtaacccccgtaaccggttaccccggtacccgttacccgttcccggtttaaccccccg

SEQ ID NO: 250018 - DNA, 697 bp, Homo sapiens
  misc_feature: GYAE6OF02IHEER.13.4.A04.1.454.CMB.1.raw
  modified_base (126)..(126): a, c, t, g, unknown or other
  misc_feature (126)..(126): n is a, c, g, or t
  modified_base (178)..(178): a, c, t, g, unknown or other
  misc_feature (178)..(178): n is a, c, g, or t
  modified_base (463)..(463): a, c, t, g, unknown or other
  misc_feature (463)..(463): n is a, c, g, or t
tcagtcacgtactacacgaccggtgctcgatttagagtagtgatcagggggagtcagtcccaaccaggacacagcatggacatgagggtccctgctcagctcctggggctcctgctgctctggctntcaggtgccagatgtgaacatccagatcgacccagtcctccactcctccctntctgctattctgtaggatacagacgttccacctatcgtacgttggaccggcaagtcgagggacagttagtaatgtaagttacggcttggtactacgactacgaaggtaaacccgagggtaaacctacccgtaacgtcttacgttagttactacttagtgtcgactacgtaccgtaaggttttaaaacgtcgggttaccctagtacgtaggttaccgagtccggagtacgtaggtactacgtggactacgtaacgttccttagactttacgtccgtacatcgtaancttacgcgtagcctacggtcttaacggtacgtttacgtttcgaacctttactttacggttacctagtaaccttaagaaagtccctttaagaacctttaacggtttcaacccggttaggtaccccggttaggaaccgggttaaccgtaacgggaaacggttaataaaccggttaacgaacggtttaaccgtgtaacgggttaaccaccggtttacccgacgttaaccgtttccgg

SEQ ID NO: 250019 - DNA, 1092 bp, Homo sapiens
  misc_feature: GYAE6OF02G03I5.13.4.A04.1.454.CMB.1.raw
tcagtcacgtactacacgaccggtgctcgatttagagtagtgatcagggggcagttggtagatgcccctctgggagagatccccaggggtgacagccatggaccctggaagggcctgggctagggacgagggaccagagccagtccgagggagaggacagagccaatggacgtggggtgtactgtaacacgccctgcgtggcgaggacgggaccgacgggccacccggtcctccgaacggggacgcccgagtcgcgtgaccgtaacggtccgggaccgaggacgggtccggacccccgtacggaacccgttaggaaccggtaccgaaacgtacggaaccggaaaccccgaaaacgaacccggtaacgggtacccgaaagggttacgggggtttaggttaccgggaaccggtaccccccgggtaggaaccgggtacgggtcccggtaccgggggttaccccggttaccgggttaccccggacggggacccggtaacgggccccggtcccggggttacccgggtccccccggttcggggcccgttaccgggtccgtttccggggtaccgggttcgggggtttcccgtaccgggggtacccgttacgggtttacccgggggtacccgtaccccggttaacgggttcccgggtaccccgtttccgggttacccggtcccggtaccccggtaaccccgggttaacgggttacccgggtttaaccggaaccccgtaacccgggaaacccgggtaaaccccgggggtccccggggaaacccccggtaacccggggtaaccccgggttaccggggtaaccccggttaacccgggttaaccccggtaacgggggttttaaccgggaaaccgggtaccccgggtaaacgggtacccccgtaacccgggttacccgaacccgggtttaccccggaacgggtaccccggggtaaccgggttcccggggttagggggttacccgggtaaccgggtacccgggtaccggtaccccgggaacccggtaaccccgggaacccggtaaccccgtacccggtttaccgtaccccgtaaccgtttccccggtttaaccccggttccccccg

SEQ ID NO: 250020 - DNA, 789 bp, Homo sapiens
  misc_feature: GYAE6OF02IJAKA.13.4.A04.1.454.CMB.1.raw
  modified_base (129)..(129): a, c, t, g, unknown or other
  misc_feature (129)..(129): n is a, c, g, or t
tcagtcacgtactacacgaccggtgctcgatttagagtagtgatcgagggggcaggagtcagtcccaaccaggacacagcatggacatgagggtccctgctcagctccgtggggctcctgctgcttcgnggctctcgaggtcgccagtactgtagacactccaggactcgaccgatctaccacttcccgtcctgtcctgacctattcgtagtacggagacgagactaccacctatcctaagtcggaccgagggcgtacgtacgaggaactaacttaaactaactttaacgttaaaggtttcgtaacgtacgacgtaccgaaaaccgtaaaaccgtaaacggtaaacccgtaccccgttaagtcccgttacgtaagtaaccttacgtaccgtagtacctacctaacgttaaccgttaaggttaaaccggaaccggttaaccgggtccaacggttacgtaacggttaccggtaggtacgggtaagtcggtagttcgtaacgtagttacgtttacttttaccgtaccaactacgtacgacgtacggtactacccgtgaccggacgtagtacgattccgtagttaccgaactaacgttgttaacttacgttacgacgtaccgaacgtaggtttaacaccgttaaacgtttaccgaccctttaaccgtaaccgttccgtaacccgggttaccggtaccgaaaccgggtaccttaccggggtaactaagggaaacccgtttaaaccgtaaacgggtttaccgtcgggtaacggttccctaccgttaaaccccggg

SEQ ID NO: 250021 - DNA, 737 bp, Homo sapiens
  misc_feature: GYAE6OF02HV19A.13.4.A04.1.454.CMB.1.raw
  modified_base (179)..(179): a, c, t, g, unknown or other
  misc_feature (179)..(179): n is a, c, g, or t
  modified_base (236)..(236): a, c, t, g, unknown or other
  misc_feature (236)..(236): n is a, c, g, or t
  modified_base (656)..(656): a, c, t, g, unknown or other
  misc_feature (656)..(656): n is a, c, g, or t
  modified_base (686)..(686): a, c, t, g, unknown or other
  misc_feature (686)..(686): n is a, c, g, or t
tcagtcacgtactacacgaccggtgctcgatttagagtagtgatcagggggcagttggtagatgcccctctgggagagatccccaggggtgacagccatggaccctggaagggcctgggctagggacagggaccagagccagtccgagggagaggacagagccaaatggacgtggggtntactgtaacagcctgctggcgagacgggaccagggccaccgtcctaccgacgggacncccgatcgcgtgcgaacggtccgggccaggaggtcgccccgtagaaccgtggaacggaccaaagtcgaacgaaccgaaacggaccgtaacggacccgtaagggttggggttcggtacggtacccgaacccccgtgggaagggtaacggtccgggtcgggtccccgtcggtccccgaacgggccggtaacggccggtccggtcccgggtccccgtacggtccgtcggtccgtcggtacggttccggggtcgtcggtaccgtacggtccggtcccgtccgtacggtcggtcctcggtaccgtccggacccgtccgttaacgttcggtaccggaccgtaacccgaacgggtaaaccgggacccgggacccaacgggtaccgcggtaccgtaccgtcggtacgtggaacgaccgcgacgtaccncgtcgcgtcggacgtcgcgttggcggtcgngtccgaccgtccaaccgcctaccgtctcgtacctctaccgtcccgtccccg

SEQ ID NO: 250022 - DNA, 512 bp, Homo sapiens
  misc_feature: GYAE6OF01A146P.45.69.G03.1.454.CMB.1.raw
  modified_base (295)..(295): a, c, t, g, unknown or other
  misc_feature (295)..(295): n is a, c, g, or t
  modified_base (451)..(451): a, c, t, g, unknown or other
  misc_feature (451)..(451): n is a, c, g, or t
  modified_base (504)..(504): a, c, t, g, unknown or other
  misc_feature (504)..(504): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctgggtgcgacaggccccgganaaggacttgagtggataggatggatcgagcgcaaacatggtgacacacactatgcacagaagttccggggacagagtcctcttgaccactgacacatccagagacagcctatggagtgatgagcctgacatcgtagacgacacggcctctacttcngtgacaaaggagcaacgtggaaactcctagtgacgtacgtgggaccagggacncgtacggg

SEQ ID NO: 250023 - DNA, 503 bp, Homo sapiens
  misc_feature: GYAE6OF01BS714.45.69.G03.1.454.CMB.1.raw
  modified_base (273)..(273): a, c, t, g, unknown or other
  misc_feature (273)..(273): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
  modified_base (496)..(496): a, c, t, g, unknown or other
  misc_feature (496)..(496): n is a, c, g, or t
tcagacgcgatcgacacgaccggtgctcgatttagtcgctgcgtaaaggagaaagggggcagaagtctctcccagtcaggacacagcatggacatgagggtccctgctcagctcctgggactcctgctgctctggctcccagataccagatgtgacctccagatgacccagtctccatcctacgtgtctgcctctgttggagacagagtcaccatcacttgccgggcgagtcaggacattgacaattatgtaggctggtatcagcaaaaaccngggaaattcctaaggtcttggtctatgctgtctcaactttacagttcggggtccctctcgattcagcggcaggtgggtctgggacactatttcactctcaccatcaacngtctgcagcctgagatgtgctaattntactgacaaagtactttaccggtgttccgctcgtacgtttcggcggaggaccaaggtggagtatacgaaacgacgtgtggctcgcacntctgtcc

SEQ ID NO: 250024 - DNA, 692 bp, Homo sapiens
  misc_feature: GYAE6OF01D3VBK.45.69.G03.1.454.CMB.1.raw
  modified_base (309)..(309): a, c, t, g, unknown or other
  misc_feature (309)..(309): n is a, c, g, or t
  modified_base (355)..(355): a, c, t, g, unknown or other
  misc_feature (355)..(355): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatcctttctggtggcagcagcaacaggtgcccactcccaggtccagctggtgcagtctggagctgaggtgaagagccgtggggcctcgagtgagggtctccgtgcgcgacttcgaggtctcgtcctttacgagtctagttcggtttctggcgtgggtgaccgacgacgggccccggganaaggtcttggaggtggaatggatggatcgagcacaaacgagtgganacacacgactagtcgacaagtaaggtaacgggttccggggacaacggtacgttcctacgttacgaaccctacgtagaaccaactacgtacccgaacgggtaacgaccacgtaccttacggttgggaaggttcagtacgacgtcgtagactacgtacgtacggaaccgaccggtaccgggtacccttaccgttaccgtttcgtacggttaaccggaaccggtaaaggggtaaccggtaaccgtaaacggttaacgggtaaacccttcccggtaagggtaccgaaacccgggtcgggtacccggggaacgaacggggtaaaccctcgggttaacccggg

SEQ ID NO: 250025 - DNA, 808 bp, Homo sapiens
  misc_feature: GYAE6OF01DGCHA.45.69.G03.1.454.CMB.1.raw
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcgagtgagggtctccgtgcgcgacttcgaggtctcgtcctttacgagtcattggtttcngcgtgggtncgacgacggccccgganaaggcttggagtggagtaggatggatcgagcgaacaaacgaagtggtacgacacaacactaatcgacacgaaggtaacggttccggggactaggtacgtcccttacgttacggaaccctacgtacggaacctaacgtaaccgttaccccgaaacgggtaacggaaccgtaacggtaccccgtttaacggttttacgggggaacgggtttacggaacgttacgggtaaccggtacccgttaggtaaacccgtacgtttacccgttaacgggtaacccggaacccggtaccccggggttaccccggtttacctttaacccgttttaccggttacgggttaacggaaacccgggtaaaacgggggtaaaccgggtaacccgtaaaacgggttaacgggtaaaaacccgtttcccccggttaagggttaaccgggaacccggttaaccggggttaccggggggaaccccgtaaacgggggttaaaccgacccgggttttaacccgggg

SEQ ID NO: 250026 - DNA, 717 bp, Homo sapiens
  misc_feature: GYAE6OF01B4LZO.45.69.G03.1.454.CMB.1.raw
  modified_base (308)..(308): a, c, t, g, unknown or other
  misc_feature (308)..(308): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcattccttttcttggtggcagcagcaacaggtgcccactcccaggtccagctggtgcagtctggagctgaggtgaagaagccgtggggcctcgaggtggagggtctccgtgcgcgtacttcaggtctcgtcctttagagtcagttggtttctgcgtgggtgcgacgacgggccccgganaaggtcttggagtggaataggatggatcgagcgacaaagagtggtacacacacactatgacacgtaaggtacggttccgggataggtacgttcctacgttacgaaccgtactacgaaccaactactacccgaaacggaacggaacctacggtacccgtttaacggttaggggaagggttacggtaagtacggtaaccgtcccgttaggtaaccgtacgttaccggtaacggaacccggaaccggtacccgggtacccctttaccgtttaccgtttcgtacggtacggtaaaccggtaaagggtaaccggtacgtaaaccggttacgggtaaaccttcccggtaaggtaccgggaaccggtacgggtaccgggggaacccgtaacggggtaacccgtacggttacccggg

SEQ ID NO: 250027 - DNA, 786 bp, Homo sapiens
  misc_feature: GYAE6OF01ELBB7.45.69.G03.1.454.CMB.1.raw
  modified_base (307)..(307): a, c, t, g, unknown or other
  misc_feature (307)..(307): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctgaggtgagggtctccgtgcgcgtacttcaggtctcgtcctttacgagtcattggtttctgcgtgggtgcgacgacgggccccgggaanaaggtacttggaggtggaagtagggatgggatcgagcgacaaacagtggtagacacacaactactgacaacgaggtaacggttcccggggactaaggtacgttcccgttcgttacgaccctaacgttacggaaccaaccgtacgttaccccgaaacggtaacggaaccgtaaccggtacccgttaaacggttcggggaagggttacgtaacgttggaacccggtaccttagggaacctacgtttaccggtaacggtaaacccggaccgttaacccggggtaccccgtttaccgtttaacccgtttccggttaggttaaccgggtaacggtaaaaacggggaaccggttaacccgtaaaaccgggttaaccgggtaaaaccctttccccggttaacggggtaccggtaaacccgggtaacccgggtacggggggtaaaccccggaaaacgggggttaaccccaaccgggttaacccgggg

SEQ ID NO: 250028 - DNA, 845 bp, Homo sapiens
  misc_feature: GYAE6OF01BTVZP.45.69.G03.1.454.CMB.1.raw
  modified_base (304)..(304): a, c, t, g, unknown or other
  misc_feature (304)..(304): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcattccttttcttggtggcagcagcaacaggtgcccactcccaggtccagctggtgcagtctggagctgaggtgaagacgccgtggggcctcgagtgagggtctcgtgcgcgacttcgacggtctcgtcctttacgagtcattggtttctgcgtggtgcgacgcggaccccgganaacggcttgaggtggagtaggagtggatcgagcgaacaaaacgtagtcggtacgacaactacaacttactacgaccaacgaacgggtaaacgggtttccggggactaacgggtacgttcccgttacgttacgaacccgtacgttacggaaccctaacctaaccgttaccccgaaacgggtaacggaaaccgtaaccggtacccgtttaaccgggtttaggggtaacgggtacggtacgtaaccgggtacggtcccgtaaggtaacccgttaacggttacccgtaaccgggtaacccgaacccgggtaacccgggtccccggttttaaacccttccgttttaccggttaacgggtccggtaaaccgggtaaaacgggggtaaaccggtaacccggtaaaaccgggttaaacccggggtttaaaaacccgtttccccccgggttaagggtttaacccggggtaacccggttaacccggggttaacggggggaacccccgtaaaacggggggtaaccccgttaccgggtttaaacccccggggg

SEQ ID NO: 250029 - DNA, 635 bp, Homo sapiens
  misc_feature: GYAE6OF01BQKIT.45.69.G03.1.454.CMB.1.raw
  modified_base (202)..(202): a, c, t, g, unknown or other
  misc_feature (202)..(202): n is a, c, g, or t
  modified_base (627)..(627): a, c, t, g, unknown or other
  misc_feature (627)..(627): n is a, c, g, or t
  modified_base (632)..(632): a, c, t, g, unknown or other
  misc_feature (632)..(632): n is a, c, g, or t
tcagacgcgatcgacacgaccggtgctcgatttagtcgctgcgtaaaggagaaagggggcagaagtctctctcagtcaggacacagcatggacatgagggtcctgctcagctcctgggactcctgctgctctggctccagactaccagatgtcgacctcagatcgaccagtctcatcctacgtgtctgcctcgtggtagganacagagtcacctatcacgttcggccgggacgtagtcgaggactagttagtaactaagttaagtagtaggtacgtaggtagtacgaacgaacgaaaaccggaacgggtaaacggttaccgttaacggttacgttacggttacgtacgtcgtacgttcgtacgttactaacttacgtacggttaccgggttccgtacgtcgtacgtacgacgtcggtacgtaggtcggtcgtaggacccccccccccgtagtacttactactactactacctactactaacgtacgtacgtacgacgacgtacgtagtagtagtacgtacgtactaacttactactacgtactaacgtacgttacggtcgttcgtctacgtacgttcggtacggtacggacgtagtagacgagacgaacgtacgtgtcgtcgacacnctgtntcg

SEQ ID NO: 250030 - DNA, 756 bp, Homo sapiens
  misc_feature: GYAE6OF01CXO04.45.69.G03.1.454.CMB.1.raw
  modified_base (233)..(233): a, c, t, g, unknown or other
  misc_feature (233)..(233): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactctgctgctctggctcccagataccagatgtgacctcagatgacccagtctccatcctacgtgtctgtcctctgttggagactagagtccaccatccacgttcggcccgggngagtcgaaggactagttgaactaatttaagtgtaaggcgttaggtataccgaagtaaccgaaaaaacccggtaaggggtaaaaccgtttaccgttaaagggtcgtttagggtaacctagtacggtcttgttactaaccgttaaaccttttaacggtaaccggttttcccggggggtccccttacgttaccggtaacgtttccgaacggtccgggtagtacggtcggggttccgtaggggaactacttacgtttccaaccgttctaccacctaactaacgtaaacgtacggtctagcctaaggcccgtaagggtacgggtaacttcggttaacacccgtttaaacgtttaactttaaccgtacgtaaaccgttaaaggttacggtttttaacccgggttcgttaccccggtactttaccgtacgggtttacgggaaccgggtacgggtaaaccgtagggtacggaaacgtaacgtaaccgtaaaacgacggttgtacggaccttgacctacgtcgttccgttag

SEQ ID NO: 250031 - DNA, 575 bp, Homo sapiens
  misc_feature: GYAE6OF01BO0A9.45.69.G03.1.454.CMB.1.raw
  modified_base (205)..(205): a, c, t, g, unknown or other
  misc_feature (205)..(205): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactcctgctgctctggctcccagaaaccattggagaaatactgatgacgcagtttccagccaccctgtctgtgtctccgagggaanagccacctctcctgctgggccagtcagagtgttagcaaccacttagcctggtaccagcaagaaacctggaccaggcctcccgagaccttccctctattttattcggttcttcctaccgagggcctcgtggtactcccagccaggttcagtcgacctaggtcgggtctgggaccaggtacgttcaccgtctacaccctatcacgtcacgcctagctagttctagaagttcttttagccttagtttatttctgtctagtcagttactactagttaactgtactcggttactggttttacggccgtaacgggacctaggtccgtaggtaaactcgtaaaacggtactcggtacggcttacgctaacccgtacg

SEQ ID NO: 250032 - DNA, 652 bp, Homo sapiens
  misc_feature: GYAE6OF01AGG1K.45.69.G03.1.454.CMB.1.raw
  modified_base (371)..(371): a, c, t, g, unknown or other
  misc_feature (371)..(371): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactcctgctgctctggctcccagataccagatgtgacctccagatgacccagtctccatcctacgtgtctcgcctctgttggagacagagtcaccatcacgttggccgggcgagtcaggacattgacaattagtgtaggctggtatcgagacaaaaccgagggaaacgttccgtaaggtcttggtctatgctgtctactaactttactacgttccggggtccctcgtcgtattcgagcggcaggtcggtcgngggtacactattcactctccaccataccaactacgtctacgcgtacgtccgtaggacggtagttcgttacgtacctaactttatttaaccgtacgtaaccgttaaacggttacgtttttacccgggttacgtttacccggtacctttaccgttacccgggtttccggggacgggttaaccggggtaacccgtaaggggttacgggaacttaaccggtaacgtaaaaccggttacgtacggttacggtccttaccgacctaccgttagttccgtttacccgg

SEQ ID NO: 250033 - DNA, 540 bp, Homo sapiens
  misc_feature: GYAE6OF01E3M4C.45.69.G03.1.454.CMB.1.raw
  modified_base (402)..(402): a, c, t, g, unknown or other
  misc_feature (402)..(402): n is a, c, g, or t
  modified_base (441)..(441): a, c, t, g, unknown or other
  misc_feature (441)..(441): n is a, c, g, or t
  modified_base (505)..(505): a, c, t, g, unknown or other
  misc_feature (505)..(505): n is a, c, g, or t
  modified_base (534)..(534): a, c, t, g, unknown or other
  misc_feature (534)..(534): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactcctgctgctctggctcccagataccagatgtgacctccagatgacccagtctccatcctacgtgtctgcctctgttggagacagagtcaccatcacttgccgggcgagtcaggacattgactaattatgtaggctggtatcagacaaaaaccagggtaaagttcctaaggtctggtctagtgctgtctctaactttacgagttccggggtccgtctcgattcgagcggcgtaggtgggtctgggacacgtatttcaacttcctacaccctaatccaaacngtctagcagtcctagaggtatgtgactaactttatacgngtaccaaagtcgttaccgtgttccgcttacgtacgttcggcggtagggaccgaaggtggagtanacgtaaacgacgtggagtctagaccactntcgtcg

SEQ ID NO: 250034 - DNA, 744 bp, Homo sapiens
  misc_feature: GYAE6OF01EXT9F.45.69.G03.1.454.CMB.1.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (368)..(368): a, c, t, g, unknown or other
  misc_feature (368)..(368): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcattcctttttcttggtggcagcagcaacaggtgcccactcccaggtccagctggtgcagtctggagctgaggtgaagaagccgtggggcctcgagtgagggtctccgtgcgcgacttcgaggtctcgtcctttacgagtcagttcggtttcngcgtgggtgcgacgacgggccccggganaaggtcttggaggtggagtaggagtggatcgagcacaaacagtggtagacacacatangacaacaggtaacggttccggggatacggacgttccgtacgttacggaccctacgtacgaacctacgtacgtacccgaacggacggtaaccacggtaccgttacggttacggggaggttacggagttacggaccggtaccgttacgaacgttacgtaccgttaacggaaccggtaacccggtaccgggttacccgtttaccgtttaaccgtttcgtacgggtaacggtaaccggtaaacggggtaaaccggaaccgttaaaccggttaagggtaaaccccgtttccccggttagggttaaccgggtaacccgggttaaccggggtaccggggggaaacccgtaaacgggggtaaaccctaccgggttaaacccggg

SEQ ID NO: 250035 - DNA, 689 bp, Homo sapiens
  misc_feature: GYAE6OF01BP8GD.45.69.G03.1.454.CMB.1.raw
  modified_base (185)..(185): a, c, t, g, unknown or other
  misc_feature (185)..(185): n is a, c, g, or t
tcagacgcgatcgacacgaccggtgctcgatttagtcgctgcgtaaaggagaaaggggcagaagtctctctcagtcaggacacagcgatggacatgaggtccctgctcagctcctgggactcctgctgctctggctcccagataccagatgtgacctcagatcgacccagtctccatcctacgtntctgccttctgttggacgacagagtccacctatccacttgccgggcagtccaggactagttgaactaacttagtcgtaggcttgggtaatcgaagaaccaaaaaccgagggtaaaacgttccctaaagggttctttacggtacttagtgtccttagttacctacgttaacctttacgaccggtttccggggtcccctcgtaccgtattccgaacggcggtacacggttcgggtacttacggggactacgtacttttccgacttccgtccaacccgattaccgaactacgtcgttacgacctacgcctaggtacggtagttcgttcgtacctaacgtttacttaacgtcgtactaaacgttaccgtttcccgggtagttacccggtcttacggtaccggtttccgggacgggtaacccggtaccggtaaaggtcgggaaacgttacgtaaccgaaacgtaccggttggtaccggtactaccggtaccaccctaacgttcgtaccg

SEQ ID NO: 250036 - DNA, 855 bp, Homo sapiens
  misc_feature: GYAE6OF01B7IB3.45.69.G03.1.454.CMB.1.raw
  modified_base (164)..(164): a, c, t, g, unknown or other
  misc_feature (164)..(164): n is a, c, g, or t
  modified_base (188)..(188): a, c, t, g, unknown or other
  misc_feature (188)..(188): n is a, c, g, or t
tcagacgcgatcgacacgaccggtgctcgatttagtcgctgcgtaaaggagaaaggggacccaaaaaccacacccctcctcgggagaactcccctagatcacagctcctcaccatggactggacctggagcattccttttcgtggtggcagcagcaacaggtcncccactcccgaggtccagctggtnctagtcgtggacgcgtaggacggtagaagacgtccggtgggcctacgagtggacgggttcctaccgcgtaccgacgtacgttcgacggttcctaccgtccgtttaacggcgtacttaggtttcggttttcgcggtcggtcgggtcgacccgaacggtaccggggacccccggaaagtaacgggttaccgttagggtacgggttaacgggtagttaaacggggagttcgggtaactaccggacgaaccggtaaaccaaaaggtagtacgggtaacaaccttaaaccacgttaacgtagtccgaaaccgtaacggttaaacgggtaccgggtacggactaacgtccttaccgttacgtaccgacgtacgtacgaccgtactaccgtaccgaacggaacggacctaacgggttccttaagggtcggggtaacgtaggtaacgtaccgtaaccgttcgtaaggaacccttaggtaccgaacccggtacccggtaacccggtccgtttacccggttaccctttacggttacggtaaccgttaccgggaaacgggtaaacccggtaaacgggtaaccttaacgggtaaacccggttaccgttccgttaaacgggacccgtaaacgggtaccgggaaccgggaaccggtaacggtaaaccgtcggtaacccggg

SEQ ID NO: 250037 - DNA, 690 bp, Homo sapiens
  misc_feature: GYAE6OF01BQK2C.45.69.G03.1.454.CMB.1.raw
  modified_base (349)..(349): a, c, t, g, unknown or other
  misc_feature (349)..(349): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactcctgctgctctggctcccagatacccagatgtgacctccagatcgacccagtctccatcctacgtgtctcgccttctgttggagacagacgtcaccatccacgttcggccgggcgagtcaggactattagactaattatgtaggtctgtatcagaaccaaaacaggtaacgttcctaggtcttggtctatgtctgtctactaacttactcggttccgggtacccgtntccgtattccgacgcggtcgtaggttggtaccgtcgggactacgtactttaccgacttccgtactaccgtactaccaagtacgttactacgctacgtcccgtggtaacgtagttccgttagtacctaacttttagtacccgtagtaaacccgtaaagttacccgttttaccgggtaccggtttcccgttaccttaccggtttacgttacccggggtacggtaaacggggtacccgtaaaggggttacgggaaaccggttaaagttaacccgggtaaacgttaacccgttagggacccggtttcgacccgtacccgtaacccgtacgttaccggtttacccg

SEQ ID NO: 250038 - DNA, 773 bp, Homo sapiens
  misc_feature: GYAE6OF01AL359.45.69.G03.1.454.CMB.1.raw
  modified_base (110)..(110): a, c, t, g, unknown or other
  misc_feature (110)..(110): n is a, c, g, or t
  modified_base (125)..(125): a, c, t, g, unknown or other
  misc_feature (125)..(125): n is a, c, g, or t
  modified_base (127)..(127): a, c, t, g, unknown or other
  misc_feature (127)..(127): n is a, c, g, or t
  modified_base (143)..(143): a, c, t, g, unknown or other
  misc_feature (143)..(143): n is a, c, g, or t
  modified_base (145)..(145): a, c, t, g, unknown or other
  misc_feature (145)..(145): n is a, c, g, or t
  modified_base (153)..(153): a, c, t, g, unknown or other
  misc_feature (153)..(153): n is a, c, g, or t
  modified_base (498)..(498): a, c, t, g, unknown or other
  misc_feature (498)..(498): n is a, c, g, or t
  modified_base (529)..(529): a, c, t, g, unknown or other
  misc_feature (529)..(529): n is a, c, g, or t
tcagacgcgatcgacacgaccggtgctcgatttagtcgctgcgtaaaggagaaaggggacccaaaaaaccacacccctcctcgggagaatcccctagatcacagctcccncacagcgcgcgacgngnctctttctttgtggcnancacacagngtccaccacctccgacgtcacgtcgtggcacgtacgtcggtacggcgtggtaaggttaggtaacgaacggaccggtccggggtaccggtccctaggtacggtacggggttaccggttccttccggacgccggttacctcgttacggtccgttccgtaccgtttacgttaacggcttacgtttacggtttcgttcgtcggttcgggtcggccgaccggacggtaccccggggaccgaacgtacgttcgtaggtaggtacgagtaggtgacgcctagacggaactaagaaacgtgtcgaacgaaccctagtaccataccgcaacgtaacggacggttacccggggtnaaccgtcgttacccgtgttaccaccgtaacnccgacactaccgaccgacgtacgacccgactacgtaccgtaggtacggtagacgttgacgacgtcgtcgtactcgtacgaccgacgtacccgtcgtaccgttacttacgtacgtacgaacgtaacgggaaacgtaccggttaaacgacgtaacccggttacccgtacggtaaccgggtacccgtaaccggggggtacccgtaaacgggtacccggaacggtaacccgggtttcccggaccccgg

SEQ ID NO: 250039 - DNA, 794 bp, Homo sapiens
  misc_feature: GYAE6OF01BN8U4.45.69.G03.1.454.CMB.1.raw
  modified_base (400)..(400): a, c, t, g, unknown or other
  misc_feature (400)..(400): n is a, c, g, or t
  modified_base (448)..(448): a, c, t, g, unknown or other
  misc_feature (448)..(448): n is a, c, g, or t
tcagacgcgatcgacacgaccggtgctcgatttagtcgctgcgtaaaggagaaaggggacccaaaaaccacacccctcctcgggagaactcccctagatcacagctcctcaccatggactggacctggagctatccttttcttggtggcagcagcaacaggtcgcccactcccaggtccagctggtgcagtctggagtctgaggtgaaggaacgccgtggggcctcgaggtcggaggtcctccgtgcgaccgtacgttcgtacggtctaccgtaccgttttaacgagttacctaaggtttggtttcgtcggtggtcggggtagaccggtaaccggaccggggacccccggggaagtaacgggtacgttagggacggttaggaagtaggtagtacggtacncgaagacgaactaaaacgtagtaggtacaacgaacaactacgtaacgngtaaccaaggtaacggtaacgggttaccgggaactaaacggtacgtttaccccgtacggttacgaacccgtaacttcggaacctacgtaaccgtaaccccgaaacgggaaacggtaacgaccggttaccctttaaggggtagggtacgtttaagagttacggaacgtcctagggaacctacgtacgtacggaaccgtaccggtacccgggtaccttacgttactacggttacggtaggaaaccgtaaagtaaccggacttaaaggacggtaaacgttccccgggagtaacccggaccggttaacgggacgggtaacccggaagggtaaacccgtcggttaaccggg

SEQ ID NO: 250040 - DNA, 679 bp, Homo sapiens
  misc_feature: GYAE6OF01BD5M5.45.69.G03.1.454.CMB.1.raw
  modified_base (217)..(217): a, c, t, g, unknown or other
  misc_feature (217)..(217): n is a, c, g, or t
  modified_base (369)..(369): a, c, t, g, unknown or other
  misc_feature (369)..(369): n is a, c, g, or t
  modified_base (661)..(661): a, c, t, g, unknown or other
  misc_feature (661)..(661): n is a, c, g, or t
tcagacgcgatcgacacgaccggtgctcgatttagtcgctgcgtaaaggagaaaggggacccaaaaaccacacccctcctcgggagaatccctagatcacagctcctcaccatggactggacctggagcattccttttctggtaggcagcagcaacaggtcgcccactcccaggtccagctggtgcagtctggagctgagtgagacgcgtgggcctnagtgacgggtctcgtgcgcgtacttcgaggtctcggtcctttagagtcgagttggtttcgtgcgttggggtacgcggtacgacgggccccgggacgaaagggtcctttgggaacggttggaagtagggtagttgggacttcggaggaccganaaaaccggtagttacgggacgaccgtaacaaccggtattaacgcgaaccaagaacggtacgggttaccgggacgaagtccgtcgtacgttcgaccctacgtcgactaacctatccgaacgtacggtaacacgtaccgttacgttgggaggttacgagtacggacgtacccgttagaaccgtacgtcgtaagaccggtaccgaccgggttccttacgtaccgttcgtgacgtacggaacgggaagtaccgacttaggaacttcggtagtccgaaacggtcggaccgggtaacncgggtaacgtgttaccgg

SEQ ID NO: 250041 - DNA, 549 bp, Homo sapiens
  misc_feature: GYAE6OF02F0KYN.45.69.G03.1.454.CMB.1.raw
  modified_base (296)..(296): a, c, t, g, unknown or other
  misc_feature (296)..(296): n is a, c, g, or t
  modified_base (372)..(372): a, c, t, g, unknown or other
  misc_feature (372)..(372): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctgggtgcgacaggccccggganaaggacttgagtggataggatggatcagcgacaaacaatggtgaacacacactatgcacaggaaggttccgggganaggacgttcctcttcgacccactgaacacatccgacgacggacagcctacgtggaggtgatgacgcctgacatcgtagaccgacgaccggccgttctaaccttctgtcgacgagggaagacgaacgtaggaaactcccgtagtagacgacggtcggggaccaagggaccacgtacgg

SEQ ID NO: 250042 - DNA, 610 bp, Homo sapiens
  misc_feature: GYAE6OF02F9Z70.45.69.G03.1.454.CMB.1.raw
tcagacgcgatcgacacgaccggtgctcgatttagtcgctgcgtaaaggagaaagggggcagaagtctctctcagtcaggacacagcatggacatgagggtccctgctcagctcctgggactcctgctgctctggctcccagataccagatgtgacctccagatgacccagtctccatcctacgtgtctgcctctgttggagacagagtcaccatcacttgccgggcgagtcaggacattgacaattatgtaggctggtatcagacaaaacgagggaaacgttctaaggtcttaggtctatgtctgtctctaactttacgagttccggggtccctcgtcgtattcaggcggctaggtcgggtcgtgggacactatttccactctcacctatcaactcgtctgctacgcccgtaggagtacttcgtttacgaccttaactttacttaacgtacgtaaccgtaaagtttaccgtttacccggtcgtttcccgtcgttaccgtaccggttttcgggaccgggttaacgggtacccgtaaggggtggaaacggtactaaccggtaaaccgttacgtacggttacgggacttacgaccaccgttactccgttacg

SEQ ID NO: 250043 - DNA, 667 bp, Homo sapiens
  misc_feature: GYAE6OF02I7CQL.45.69.G03.1.454.CMB.1.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagccgtggggcctcgagtggagggtctcctgcgcgacttcaggttcctcgtcctttacgagtcagttggtttcngtcgtgggtgcgacgacgggccccgganaaggacttggaggtggagtaggagtggatcagcgacaaacgagtggtagacacacactatgacacgaggtaacgtcgggacagacgtcctacgttcgaaccctagtcgaaccacactccgaacgacgacacgtctacgtgggaggtgagtggacgcctagactagtccgtacgaaccgaccgtaccgggcccgtttacgttaaccgtttcgtacggttacgacccggtaaagggtaaccgggtaccttaaacgggtaaccggtaaaaccgttccccggttaagggtaaccggtaacccgggtacggggttacccgggggaacccggtaaacggggtaaacccgtccgggtttaacccggg

SEQ ID NO: 250044 - DNA, 540 bp, Homo sapiens
  misc_feature: GYAE6OF02FE9NB.45.69.G03.1.454.CMB.1.raw
  modified_base (339)..(339): a, c, t, g, unknown or other
  misc_feature (339)..(339): n is a, c, g, or t
  modified_base (438)..(438): a, c, t, g, unknown or other
  misc_feature (438)..(438): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctgggtgcgacaggcccccgggacaaggcttgagtggataggatggatcagcgcaaacaatggtanacacacgactatgcacagaacggttccggggcaggagtcctcttgaccactgacacatccacgaggacagcctacgtggaggtgatgagcctgacatcngaccgacgacggccgttctacttctgtcgacgtaggaacggctaaacgtggaaacctccctaggacgaccgacggtggggacccaaggggaccacgtacggg

SEQ ID NO: 250045 - DNA, 576 bp, Homo sapiens
  misc_feature: GYAE6OF02G2LTK.45.69.G03.1.454.CMB.1.raw
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctgggggcctcagtgagggtctcctgcgcgacttcaggtctcgcctttacgagtcatggtttctgctgggtgcgacgcggccccgggacaagggtacttggagtggatagggatgggatcagcgacaaacatggtgacacacactatcgacacagaacggttccggggacaggacgtccctcttacgacccactcgaacacactaccgacggacggacacgcctacgttgggaggttgatgacgctgacactcagacgacgcggtccgtactacttcgtgtcgcgaagggaggactaacggtacggaaacgttccctaggtacggacggtacggtcgggggacccgaacggggtaaccagtaccggg

SEQ ID NO: 250046 - DNA, 599 bp, Homo sapiens
  misc_feature: GYAE6OF02G65X6.45.69.G03.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (345)..(345): a, c, t, g, unknown or other
  misc_feature (345)..(345): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactcctgctgctctggcctcccagatacccagatgtgacctccagatgacccagtctccatcctacgtgtctgcctctgttgganacagagtcaccatccacttggccgggngacgtcgaggacattgaactaattatgtaggctggtatacagacaaaaaccgagggtaaacttccgtaaggtctggtctagtgctgtctcaactttacgagtttcggggtcctntcgacttcaggcgtcaggtcgggtctagggactactagtttcacctctaccacctataccaactgttcgtagcagcctaggaggtatcgttacgaccttaaatttactaactcgtaacctaaaggtacgttttaaccggtcgttaccgtccgttacggtaccggtttaccgggacgggtaacggaccgtaagggtcgggtaagacgttaaccgaaacggttactaggtacggtctagcccgactgtccgttacg

SEQ ID NO: 250047 - DNA, 562 bp, Homo sapiens
  misc_feature: GYAE6OF02IB43V.45.69.G03.1.454.CMB.1.raw
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactcctgctgctctggctcccagataccagatgtgaccttccagatgaccccagtctccatcctacgtgtctgcctctgtttggagacaggagtcaccatcacgttgccgggnagtcaggcattgacaattatgtagctggtatcagacaaaaacngggaaagttacctaaggtcttggtctatgctgtctctaactttanagttcggggtcctctcgattcngcgcagtgggtctgggacactatttcactctcaccgtatccaactagtctgcagcctagacggtatcgttgactaacttattactgtacctaaagtcttttaccgggtgtttccgaccttcgtaccgttttcgggacgggacgggtaccaaggggtcggaaggtacctaacgaaacggtaacgtggtacggtacttcggacctaacctacgttcgttacg

SEQ ID NO: 250048 - DNA, 664 bp, Homo sapiens
  misc_feature: GYAE6OF02I6SWR.45.69.G03.1.454.CMB.1.raw
  modified_base (231)..(231): a, c, t, g, unknown or other
  misc_feature (231)..(231): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (653)..(653): a, c, t, g, unknown or other
  misc_feature (653)..(653): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactcctgctgctctggctcccagactaccagatgtgacctccagatgacccagtctccatcctacgtgtctgcctctagttggagacagagtcaccatcacgttcgccgggngagtcaggactagttgactaattactggtaggctaggtatacgaagacaaaaacccggtaggggtaaacttccgtaaagggtcttagggtaccttatcggtctagtacctacgtaacctttacgacgttccggggtaccctctcgtactttcgacgccgggtcacggtttgggcgtacgggactacgtactttcgactcctaccnctaactacaacgtntacgtnacgtacgccgtagacgttattggtttacacctaaagtttacacgttacgaaccggtaaagttaccgttttaccggtcggtttacccgctttaaccgtaccggtttccgggacggggttaaccggacgttaagggtcggaacgttacgtaaaccggtaacggtaaccttgggaccggttcaaccggttcctaaccgtnttaccggttac

SEQ ID NO: 250049 - DNA, 627 bp, Homo sapiens
  misc_feature: GYAE6OF02JE7WK.45.69.G03.1.454.CMB.1.raw
  modified_base (307)..(307): a, c, t, g, unknown or other
  misc_feature (307)..(307): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcgagtgagggtctccgtgccgcgacttcgaggtctccgcctttacgagtcattggtttctgcgtggtgcgacgacgggcccccggganaaggtacgttggaggtggagtaggatggactcgagcgacaaacagtggagaacacgaacactagtcgacaacaaggtaacggttccgggacacgtacgttccctcgttacgacccgacgtacgacctacactaccgaacggacggacacgtccgttacgtgggtaggtagtatacggacgtccgtagacctgtacgtcgaccgacgtaccggtcccttacgttaccttcgtgacgtacgaacgggacgtacgtaacgtacggtaactcccgtaggtaccgacgtaccggtacgggacccgaagggtaccgtacgtaccgg

SEQ ID NO: 250050 - DNA, 502 bp, Homo sapiens
  misc_feature: GYAE6OF02IKEL1.45.69.G03.1.454.CMB.1.raw
  modified_base (356)..(356): a, c, t, g, unknown or other
  misc_feature (356)..(356): n is a, c, g, or t
  modified_base (383)..(383): a, c, t, g, unknown or other
  misc_feature (383)..(383): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
tcagacgcgatcgacacgaccggtgctcgatttagtcgctgcgtaaaggagaaagggggcagaagtctctctcagtcaggacacagcatggacatgagggtccctgctcagctcctgggactcctgctgctctggctcccagataccagatgtgacctccagatgacccagtctccatcctacgtgtctgcctctgttggagacagagtcaccatcacttgccgggcgagtcaggacattgacaattatgtaggctggtatcagacaaaaaaccagggaaacgttccgtaaggtcttggtctatgctgtctctaactttacagttcggggtcctctcgattcagcgcaggtggtcnggacactatttcactctcacatcaacngtctgcagcctgagtntgttgactaacttntactgactaaagtctttacgnttccgcttcacgtttcggcggaggaccaggtgatactacaaacgtactggngctacgcactntcgtcg

SEQ ID NO: 250051 - DNA, 647 bp, Homo sapiens
  misc_feature: GYAE6OF02GIC6L.45.69.G03.1.454.CMB.1.raw
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (503)..(503): a, c, t, g, unknown or other
  misc_feature (503)..(503): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagccgtggggcctcgagtgagggtctcctgcgcgacttcaggtctcgcctttacgagtcagttcggtttctgcgtgggtgcgacgacgggccccggganaaggcttggagtggataggatggatcgagcgacaaacagtggtacgacaccacgactancgacaacgaggtaacggttccggggactaggacgttcctacgttacgaaccctacgtacgaaccactacgtacccgacggaacggaccgacgtacccgttacgtagggaaggttcgagttacggacgtcccgtagacctnttccgtacgaccgaccgaccggtcccgtttacttaccgttcgtggttacgaacgtaagggacgtacgaacgttacggtaacctcccggtaggtacggaccggtacgggtaccggggaccgaacggggtaccacggttacccggg

SEQ ID NO: 250052 - DNA, 820 bp, Homo sapiens
  misc_feature: GYAE6OF02IGKW8.45.69.G03.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcgttggtggcagcagcaacaggtcgcccactcccaggtccagctggtgcagtctggagctgnggtgaagagccgtgggcctcgaggtgaggtctccgtgcncgtacttcgaggtctccgtcctttaacggagttctagttggtttacctggtcgtgggtcgacggacgacggggtcccccgggtaagaacggtaccgttaggacggttcgggaagttaagggattcgggaattcgaacggacgtaacaaaaccggtaagtggggtacgtaaccgtaacaccgttaaacgttacgtaccgactaaacgtaacgggtaaaacgggtttcccggggacgtaaacggttaccggttccccgttacgtaacgtaacccgtaacggtttaccggaacctaaccttaccgttaaccccgaacggaacggaaccgtacgttaacccgttacgttacggggtaaggttactacggtacgtacgcccgttagaaccgttaccgttaagtaccgggaaccgtaacccgttaccgggtacccgtttaccttaacggttccttagggtaccgtaacggaaacggggtaccgcccggtaaaaaggttaccggtaaacccttcccggttaaacggttccggaaccgggtacggttaccgggggaacccgtaacgggaccgttaccggttaacccggg

SEQ ID NO: 250053 - DNA, 697 bp, Homo sapiens
  misc_feature: GYAE6OF02IVIJU.45.69.G03.1.454.CMB.1.raw
  modified_base (393)..(393): a, c, t, g, unknown or other
  misc_feature (393)..(393): n is a, c, g, or t
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttctggtggcagcagcaacaggtgcccactcccaggtccagctggtgcagtctggagctgaggtgaagagcctggggcctcgagtgaggtctcctgcgtcgacttcgagtctcgtccttacgagtcagttcggtttctgtcgttggggtcaccggtacgtacggggacccccgggaagtaacgggtacttcggaggtaggagttagggatggtatcgagccgaacaaacgtagtcgggtagaccaacgaaaaccgtntacgaccgaacgtaggtaacgtttcgagggtacgtacgggtaccaacgtcgtacgaccggtaacgggacctacgtacccgtaagtaccacggaccaaccgtagtaccctaagtacggtaggaccgacgttcggaacgttcgacggtcgtaggacgtacgtacgtacggaaccggaccgtaccgggtccgttaaggttacttacggtggtacgaggtacggtaacgggccgttaaaggtaacctttacgggttagttttacgggacgtttacggtttacgtacggggtacgttagttaaccgggg

SEQ ID NO: 250054 - DNA, 765 bp, Homo sapiens
  misc_feature: GYAE6OF02GU8NO.45.69.G03.1.454.CMB.1.raw
  modified_base (135)..(135): a, c, t, g, unknown or other
  misc_feature (135)..(135): n is a, c, g, or t
  modified_base (689)..(689): a, c, t, g, unknown or other
  misc_feature (689)..(689): n is a, c, g, or t
tcagacgcgatcgacacgaccggtgctcgatttagtcgctgcgtaaaggagaaagggggcagaagtctctctcagtcaggacacagcatggacatgaggtccctgctcagctctgggactcctgctgctctgccnccagactacagtattgacgacctacagatcgaaccctgtcctaccaactccttacgtcgtctgtcctcgtggttacgggaactaacgagtaacgtccaccgtactacgtaacgttcggacccgggaccgtaagtacgacggtaacttagttacgaactaacgtttagtcggtacggtacgttagggttactacgaacgaaaaccgaaaacgtaacggtaacgttaacccgtaagtcggttagttactagtcgcttgcttactactttacgtacgttccgggtacgtctcgtatcgcgtacgacgtaggtcggtacgcggtacttacgtacttacgtacctctacgaacgtactacgtaaaccgtcgtactagtacgtaaccgtcgttagtaccggttagttacgttaccgttaaaccgttaaacgtttaacgtaacccgtacggttaaaccgttaaccggttaacccgttttaccggtttaccgggtaaccctttccgggtaaccctttaaacgggttccccggtaaccgggtaaccgggtacgttaaacgggnggttaaaccggtaaccgtaaactaaaccggtcgtaggtacgtaccgtaaccgtacgtaccgttacgtcgttaaccg

SEQ ID NO: 250055 - DNA, 506 bp, Homo sapiens
  misc_feature: GYAE6OF01C5S9W.12.67.G01.1.454.CMB.1.raw
  modified_base (397)..(397): a, c, t, g, unknown or other
  misc_feature (397)..(397): n is a, c, g, or t
  modified_base (471)..(471): a, c, t, g, unknown or other
  misc_feature (471)..(471): n is a, c, g, or t
  modified_base (500)..(500): a, c, t, g, unknown or other
  misc_feature (500)..(500): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaatcatgatttttgatgtcactaatcggccctcaggggtttctgatcgcttctctggctccaagtctgactacacgcctccctgaccatctctggctccaggctgagacgagctgattatattgcagctcatatacaagcagcagcaccctntttgtctggaagtggacaggtcaccgtctacgtcacgcccaaggcccaacccactcgtcacctctcgttccccnccctcctctacgtcgtatcctgagcgggntggacg

SEQ ID NO: 250056 - DNA, 571 bp, Homo sapiens
  misc_feature: GYAE6OF01ASD8Q.12.67.G01.1.454.CMB.1.raw
  modified_base (218)..(218): a, c, t, g, unknown or other
  misc_feature (218)..(218): n is a, c, g, or t
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (376)..(376): a, c, t, g, unknown or other
  misc_feature (376)..(376): n is a, c, g, or t
tcagatacgacgtacacgaccggtgctcgatttagagtatacatattgggtttgggggggtctcaggaggcagcgctctcaggacatctccaccatggcctgggctctgctcgctcctcaccctcctcactcagggcacgagggtcctgggcccaatctgccctgactcagcctgcctccgtgtctgggtctcctggacagtcgatcacctatttccngccaccggaacaatagtgacgttgtcgttataactttgctctgtacaacngcaccagcaaacgcccccaatcctgatttangaggtcactattcggtcctcgaggtaatttctaatcgctttctcgtggttaccaagtctggacaacgaccgcctccngacctactcctcgtcggggtccaggcctggacggtacgaggtctagtatttacgtactggacctagttcaattactaacaagtcctacttccgacttctcggtgttcgtcggcggtaggacctagctcggacctcgtaacgtcacgccctaaggcctaccgccccgttggacctaccttcgtccgtccccgtccc

SEQ ID NO: 250057 - DNA, 524 bp, Homo sapiens
  misc_feature: GYAE6OF01BCADE.12.67.G01.1.454.CMB.1.raw
  modified_base (428)..(428): a, c, t, g, unknown or other
  misc_feature (428)..(428): n is a, c, g, or t
  modified_base (491)..(491): a, c, t, g, unknown or other
  misc_feature (491)..(491): n is a, c, g, or t
  modified_base (516)..(516): a, c, t, g, unknown or other
  misc_feature (516)..(516): n is a, c, g, or t
tcagatacgacgtacacgaccggtgctcgatttagagtatacatattgggtttggggggtctcaggaggcagcgctctcgggacgtctccaccatgcctgggctctgctattcctcaccctcctcactcagggcacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatangcgggtagtgcactttcgattgtcctagttcggcggagggaccaagctggaccgtcctgggcngccccaaggcctcgccccctggccncgtctccg

SEQ ID NO: 250058 - DNA, 600 bp, Homo sapiens
  misc_feature: GYAE6OF01DKOC9.12.67.G01.1.454.CMB.1.raw
  modified_base (340)..(340): a, c, t, g, unknown or other
  misc_feature (340)..(340): n is a, c, g, or t
tcagatacgacgtacacgaccggtgctcgatttagagtatacatattgggtttggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaataactatgtcctctggtaccaacagccacccaggcagacgacccccaaatcatgtatttttgatgtcaactaatccggccctcgtaggggtttctgatcgtctttctctggcctccaagtctgactacaccgcctccgtnaccatctcgtgggcctaccgaggctggaggacgaggctgtatttattattgcagcttacattataacaagctagcaagcctaccttcttttgtcgtttacgggaaggttcgggaacctaagggtccaacccgtcgttaacgtccgacgaccccgaaacggccccaaaccccctacgttcgtacctaccttccttaccggtttccccccaaccccttcccttcgttacccgttcgtactcgtagacggtcggctggaaccg

SEQ ID NO: 250059 - DNA, 635 bp, Homo sapiens
  misc_feature: GYAE6OF01EDR3A.12.67.G01.1.454.CMB.1.raw
  modified_base (252)..(252): a, c, t, g, unknown or other
  misc_feature (252)..(252): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcaccctgcctccgtgtctgggtctcctggacagtcgatcaccatctcctgcactggaaccagcagtgacgttggtgttataactntgtctcctggtaccaacagcaccaggcacgacgaccccaaactcatgtattttgatgtcactaagtccggccttcgtacggggtttctgtacgtccgtcttctcgttcggtctacgaacgtctagaccgtaccgaccggtccctcccgtagaccctatccgtacgtcgggcctaccgacggtcgtaggaacggacgtacggcgttaggtaatttagtttagttcgactacgtctactaataactaacgtaacgacgacgacgtacgccctaacccttcgtttacgtcgttacgggtaacggtacgggtaaccgtacgggtacctacccgtccgttaccgtccgaaccgtcccgaacggacccctaaccccgcgtccgtacccg

SEQ ID NO: 250060 - DNA, 643 bp, Homo sapiens
  misc_feature: GYAE6OF01B2ITT.12.67.G01.1.454.CMB.1.raw
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaactcatgtatttttgatgtcactaatcgccctcgtagggtttctgatcgcttctctggctccaagtctgactacacggcctcctcgaccattccctcgtcgtcctacgcgtcgtaggacgacggcgtagtagtatttattgtcgcgacgtctacgtaactaacaacgacgacgacgacgacgtacccttacccgtttcgtttccgtttacggttaacgggttaacgggtacccgggtaaacggttaaccggtacccggttaccccggttaacccggttacccgtaaccggtaaccccgtaacccgggaaacccccggtaaccccccgtaaaccccgttccgttaccccgg

SEQ ID NO: 250061 - DNA, 627 bp, Homo sapiens
  misc_feature: GYAE6OF01DUQBA.12.67.G01.1.454.CMB.1.raw
  modified_base (622)..(622): a, c, t, g, unknown or other
  misc_feature (622)..(622): n is a, c, g, or t
tcagatacgacgtacacgaccggtgctcgatttagagtatacatatttggtttgggggctctgctattcctcaccctcctcactcaggacacagggtcctgggcccagtctgccctgactcagcctgcctccgtgtctgggtctcctggacagtcgatcaccatctcctgcactgggaccagcagtgatgttgggacttataaccttgtctctgtaccaacaacaccaggcaaacgccccaaactcatgatttatgagggcactaagcggcctcgaggggtttcttatcgtcttctctggctccgagtctggcaacacggcctccctgacaatcctcgtgggcctccgaggctggaggacgaggcggtattattactgttgctcatacgtggtacgggttagtacgccgtacgttttcgagttcgttccgttaggttccgggcgggtagggaaccctaaggccttcggacccgttccggtcgggtacacggaccccgaagggcccttcccggcccccgttcggtacctacgttccgtccgttcccctaacccttccccgtacgttacccgttcgttagtcccgtagggaccggtccgggtacgttcgggacaacgggtccgngtacg

SEQ ID NO: 250062 - DNA, 562 bp, Homo sapiens
  misc_feature: GYAE6OF01CNZ2Z.12.67.G01.1.454.CMB.1.raw
  modified_base (300)..(300): a, c, t, g, unknown or other
  misc_feature (300)..(300): n is a, c, g, or t
  modified_base (419)..(419): a, c, t, g, unknown or other
  misc_feature (419)..(419): n is a, c, g, or t
tcagatacgacgtacacgaccggtgctcgatttagagtatacatattgggtttggggggggtctcaggaggcagcgctctcgggacgtctccaccatggcctgggctctgctgctcctcaccctcctcactcagggcacagggtcctgggcccaatctgccctgactcagcctgcctccgtgtctgggtctcctggacagtcgatcaccatttcctgcaccggaacaatagtgacgttggtcgttataactttgtctcctggtacaacagcaccaggcaaacgcccccaatcctgattangaggtcactattcggtcctacaggtaatttctaatcgcttctctgttcaagtctggacaacgacgcctccctgaccatcgtcgtcgggtccaggctgaggacgaggctgtattattacngctagtcatatacagctactcactcgtgtgtcgtcggcggtgacagtctacgtaccgtctaagtcgacgcccgtaaggtcctccggtaccccccgttcggtaccctacgttccttcccggttcccccacccttcccgttaccg

SEQ ID NO: 250063 - DNA, 545 bp, Homo sapiens
  misc_feature: GYAE6OF01BCGUP.12.67.G01.1.454.CMB.1.raw
  modified_base (463)..(463): a, c, t, g, unknown or other
  misc_feature (463)..(463): n is a, c, g, or t
tcagatacgacgtacacgaccggtgctcgatttagagtatacatattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaactcatgtatttttgatgtcactaatcggccctcaggggtttctgatcgcttctctggctccaagtctgactacgacggcctccctgaccctatctcgtcgggcctccgaggctggaggacgaggctgtattattattgcagctcatatacaagcagcacgcctacccttntttcgtcttcgggaacgtcgggaaccaggtccacccggttcctacggtccacgaccccgaaggccccaaaccccgtcgtacg

SEQ ID NO: 250064 - DNA, 561 bp, Homo sapiens
  misc_feature: GYAE6OF01B9PPZ.12.67.G01.1.454.CMB.1.raw
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (439)..(439): a, c, t, g, unknown or other
  misc_feature (439)..(439): n is a, c, g, or t
  modified_base (545)..(545): a, c, t, g, unknown or other
  misc_feature (545)..(545): n is a, c, g, or t
tcagatacgacgtacacgaccggtgctcgatttagagtatacatattgggtttggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaattttgacctagtctcctggtaccaacaataccccggnaaagtcccaagttaatcatttangaggcactaagcgccctnaggtagtttctgatcgcttctctggctcgaaggctggcgaccgggcctcccgtgacatatcgtgggcctcaggctgaggacgaggctcattactactgctgctacatgtggtagttanagctacgttgggtgttcggcggtacgggactaaggtcgtaccgtccgtaaagtcacgcccgaaggcctccggccccccgtggtccaccgttccttacggttccccnccccgttccgtacccg

SEQ ID NO: 250065 - DNA, 708 bp, Homo sapiens
  misc_feature: GYAE6OF01EEBXK.12.67.G01.1.454.CMB.1.raw
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagccacccaggcagacgacccccaaatcatgtatttttgatgtcactaactccggccctgtaggggtttctgatcgtctttcctcgtggcctccaagttctgactacgaccgtcctccctgacctatccgtcgtcggtcctcgaggcgtcggacgggacggacggtctagtatttaagttattcgacgtacgtctacgtaattaactaacgaacgcaagcgacgtaccctacccttacgttttacgtcgtttacggggaacggtacgggtaacccgtaacgggtacccgtacccgttaccgttacggacccgtaaccggtaaccccgaaccggtaaccccctaaacccccgtaccgttaccgtacctacccgttaccgtttacccgtttacccccctacccccgttacccctttcccgttaacccgggtttaccgttacgttacccggttagggtaccgggtcccggggtcgtaccggaaccggg

SEQ ID NO: 250066 - DNA, 546 bp, Homo sapiens
  misc_feature: GYAE6OF01BLWXT.12.67.G01.1.454.CMB.1.raw
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcagacgcccccaaactcatgtatttttgatgtcactaatcggccctcgtaggggtttctgatcgcttctctggctccagtctgactacacggcctccctgaccatctcgtcgggcctcgaggctggacggacgaggctagtatttattattgcagtctcatacacaagcagcacgcctacccttcgtttgtcgttacggaaggtcgggaacctaggtcctaccgttcctacgtccaccgacccaacggaccccaaccccgtgtaccg

SEQ ID NO: 250067 - DNA, 527 bp, Homo sapiens
  misc_feature: GYAE6OF01CKIVU.12.67.G01.1.454.CMB.1.raw
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (410)..(410): a, c, t, g, unknown or other
  misc_feature (410)..(410): n is a, c, g, or t
  modified_base (472)..(472): a, c, t, g, unknown or other
  misc_feature (472)..(472): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaatcatgtatttttgatgtcactaatcggccctnaggggtttcngatcgcttctctggctccaagtctgactacacgcctcctgaccatctctggcctccgaggctggacggacgaggctgtatttattattgcagctacatatacaagcagcagcctacccttntttgtcttcggaagtgggacctaagggtccaccgtctacgtcacgcccaacggcccaacccntctccactctccgtccccgcctcctctaccgtcgtactcgtgacgcggctggacg

SEQ ID NO: 250068 - DNA, 621 bp, Homo sapiens
  misc_feature: GYAE6OF01DD6N0.12.67.G01.1.454.CMB.1.raw
  modified_base (201)..(201): a, c, t, g, unknown or other
  misc_feature (201)..(201): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (409)..(409): a, c, t, g, unknown or other
  misc_feature (409)..(409): n is a, c, g, or t
  modified_base (488)..(488): a, c, t, g, unknown or other
  misc_feature (488)..(488): n is a, c, g, or t
tcagatacgacgtacacgaccggtgctcgatttagagtatacatattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacatctcctgcactgaaccagcagtgacgttggtgtanactntgtctctggtacaacagcaccagcagacgaccccaatcatcgtattttgatcgtacactaacgtccggaccctgtacggggtttcagtactcgtctttcgtcgtcggtccttaccgaagtctacggacctaccgaccgggtccctcccgtagaaccctnttccgtacgttccgggccttacccgaggtcctagggacggtaccggaaggtccttagtatttattacgtgctagccttntaatactaacaacggctagccacgtcctacctttcgtttctacggttacgggtagtacgggtaacctaagggttccctacccgttaccgtacgttccacggtaccccacggaccccctaaccgtcttacccgg

SEQ ID NO: 250069 - DNA, 642 bp, Homo sapiens
  misc_feature: GYAE6OF01CGPOT.12.67.G01.1.454.CMB.1.raw
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacagccacccaggcagacgcccccaaatcatgtattttgatgtcactaatccggccctcgtaggggtttctgatcgtctttctctggctccaagtctacgactacaccggtcctccctacgaccattcctcgtcgggccttccgaggtctaggacggacggtacggtcttagtaagttttaattacttcggacctaggtccttaacaattaactaacgaacgtacgaagaccgacgtcccttaccccgtttgttttcggttaccgtttacggggaaacgttccggggtaaacccgttaacgggtttaccccgtccccgttaccggaccccgaacggaccccgaaacggacccccaaaccccgtcgtcggtacccc

SEQ ID NO: 250070 - DNA, 681 bp, Homo sapiens
  misc_feature: GYAE6OF01C1ZWQ.12.67.G01.1.454.CMB.1.raw
  modified_base (223)..(223): a, c, t, g, unknown or other
  misc_feature (223)..(223): n is a, c, g, or t
  modified_base (447)..(447): a, c, t, g, unknown or other
  misc_feature (447)..(447): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacngcacccaggcagacgcccccaaatcatgtatttttgatgtcactaagtccggccctcgtaggggtttctgacttccgctttctctcggcctccgaagtctcgaacctacaccggtccctccctgacctatctcgtggcctccgaggctaggaggacgaggtctgtatttattagttcgctagtcctacgaattacgtaacgaagcagccacgtccctacccttntttcggttcgttacggtaacggttacgggaacctaacgggttccaacccggttacccgttaccggtcccgtaaccggaccccgaaaccgggtaccccctaaccccgtaccgttacggtaccctaaccccgttcccgttacccgtttcccccccaaccccttcccgttacccgttaccggttaccgttacgttcccggttacgggaccgggtccgggtcggttcggtaacccggg

SEQ ID NO: 250071 - DNA, 553 bp, Homo sapiens
  misc_feature: GYAE6OF01CMGUT.12.67.G01.1.454.CMB.1.raw
  modified_base (224)..(224): a, c, t, g, unknown or other
  misc_feature (224)..(224): n is a, c, g, or t
  modified_base (489)..(489): a, c, t, g, unknown or other
  misc_feature (489)..(489): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacngcacccaggcagacgcccccaaatcatgtatttttgatgtcactaactcggccctcgtaggggtttctgatcgctttctctggctccaagtctgactacgaccgcctccctgaccatctctcgggcctccgaggcctggacggacgaggcttgtaatttattattgctagctacataactacaagcagcagcctaccttcttgtcttacgggaagtcggacctaagtcctaccgtacctacgtcacgacccaacggcccaacccntccgtcctacctctccgttccccacccttcctcttaccgtcgtactcagcggccggtgtggacg

SEQ ID NO: 250072 - DNA, 563 bp, Homo sapiens
  misc_feature: GYAE6OF01B1MTR.12.67.G01.1.454.CMB.1.raw
  modified_base (228)..(228): a, c, t, g, unknown or other
  misc_feature (228)..(228): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggcagacgcccccaaactcatgtattttgatgtcactaatcggccctcgaggggtttctgatcgcttctctggctccaagtctgactacaccggtccctccctcgaccattcctcgtcgggcctccgaggctgaggacgaggcttggatttattattcgcagtctatatatacaagctagcagcctacctctttcgtcttacggtaaggtcgggaacctaaggtccacccggttcctaaccgtccgaccgaccccgaaaccggacccctaaaccccgcgttaccg

SEQ ID NO: 250073 - DNA, 560 bp, Homo sapiens
  misc_feature: GYAE6OF01CXKX1.12.67.G01.1.454.CMB.1.raw
  modified_base (224)..(224): a, c, t, g, unknown or other
  misc_feature (224)..(224): n is a, c, g, or t
  modified_base (329)..(329): a, c, t, g, unknown or other
  misc_feature (329)..(329): n is a, c, g, or t
  modified_base (498)..(498): a, c, t, g, unknown or other
  misc_feature (498)..(498): n is a, c, g, or t
  modified_base (542)..(542): a, c, t, g, unknown or other
  misc_feature (542)..(542): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacngcacccaggcagacgcccccaaatcatgatttttgatgtcactaatcggccctctaggggtttctgatcgcttctctggctccaagtctgactacacggcctccncgaccatctctggctccgaggctgaggacgagctagatttattattgctagctcatatacaagcagcaacgctacccttgtttcgtcgttacggaacggtcgggaacctaagggtccaccggtccttacggtccacggtacccaaggtccccaaccctacgtcgtaccnccttactccgttaccccaccctttcctacttaccgtctacgtcncgaggcggtcgtggaccg

SEQ ID NO: 250074 - DNA, 595 bp, Homo sapiens
  misc_feature: GYAE6OF01DYA4J.12.67.G01.1.454.CMB.1.raw
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaatcatgtatttttgatgtcactaatccggccctctaggggtttctgatcgtcttctctggcctccaagtctgactacacggccctccctgaccatctcgtggcctccgaggctggaggacgaggctagtatttattattgactagcttacattaactacaagcagacacgtccctaccctttgtttcgtcgtttacgggaagtcgggaacctaagggttccaaccgttcctaacgtcacgacccgaacggaccccaacccctacgtcgtaccaccttccgttccgttcccctacccttcccttaccgtaccgttcgtacttcgtacggacggtccgggtcgtgggaccg

SEQ ID NO: 250075 - DNA, 783 bp, Homo sapiens
  misc_feature: GYAE6OF01CN4PV.12.67.G01.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagatacgacgtacacgaccggtgctcgatttagagtatacatattgggtttggggggggtctcaggaggcagcgctctcgggacgtctccatcatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctggtaccaacagccaccaggcacgacgacccccaaactcacttgtatttttgattcgtactaacttaactccggtcccttcggtacgggggttttcctaggtacttccgtctttccgtccgtcgggtcccttaccgtaaacgtccgtacgtaacctaacccgtacccgggtaccccttccccgtacggtaacccctacgtttcccgttccgtcggggtacccttacccggacgggtccgttagggaacggggaaccggtacgggtccttaggttaactttaagtttaacgttcgacgtaacgtccttacgtaacttaacgttaaccgaaacggtaccaacggtaccaaccgggtaccccttaaccccgtttccgttttccgggttacccgtttaacggggtaaacgggttacccggggtaacccgtaaacgggtttcccctaacccccgggtttacccgtaacccggttacccgaacccggtaacccccgaaacccgggtacccccctaaacccccgtaacccgg

SEQ ID NO: 250076 - DNA, 530 bp, Homo sapiens
  misc_feature: GYAE6OF01A19K3.12.67.G01.1.454.CMB.1.raw
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
  modified_base (461)..(461): a, c, t, g, unknown or other
  misc_feature (461)..(461): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaatcatgatttttgatgtcactaatcggccctcaggggttttctgatcgcttctctggctccaagtctgactacacggcctccctgaccatctctgggctccaggctgaggacgaggctgattattattgcagctnatatacagcagcagcacctntttgtcgttggagtggacctaaggtccaccgtcctacgtcacgacccaaggcccaacccnctcgtccacctcctcgttcccccgcccttcccgtctaccgtcacttcgtacggaggccgggctggaccg

SEQ ID NO: 250077 - DNA, 695 bp, Homo sapiens
  misc_feature: GYAE6OF01DKKM4.12.67.G01.1.454.CMB.1.raw
  modified_base (277)..(277): a, c, t, g, unknown or other
  misc_feature (277)..(277): n is a, c, g, or t
  modified_base (324)..(324): a, c, t, g, unknown or other
  misc_feature (324)..(324): n is a, c, g, or t
tcagatacgacgtacacgaccggtgctcgatttagagtatacatattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgtacggttggtacggttaataactatgtctccgtagtaccaanacgacaaccgaggacaacgaccgacccccaaatcattagtattttanatacgtctaacgtaactccggtccttacgtacgggtttctacgtatcgtcttacgtccgtcggtacctaccaagttctacgtaacctaccgaccggtcccttaccgtacgacctattccgtacgtcgggtacctccgtagggtcgtagggaacggaacgtacgggttctaacggtttattttaaacgtttacaccggtctaaacggtacctaactaacgttaaacaacggaaacgcgaacgaccgtaccgtacctttacccgttcgtttacggtaccgttagggaaacgttcgggaaaccgtaccggttacctacccgttaccgtaacgtaccgaaccggaaccctaaccggacccctaaccgtctacccg

SEQ ID NO: 250078 - DNA, 707 bp, Homo sapiens
  misc_feature: GYAE6OF01DP2HI.12.67.G01.1.454.CMB.1.raw
  modified_base (276)..(276): a, c, t, g, unknown or other
  misc_feature (276)..(276): n is a, c, g, or t
  modified_base (347)..(347): a, c, t, g, unknown or other
  misc_feature (347)..(347): n is a, c, g, or t
tcagatacgacgtacacgaccggtgctcgatttagagtatacatattgggtttggggctctgctattcctcaccctcctcactcagggcacagggtcctgggcccagtctgccctgactcagcctgcctccgtgtcgttgggtctccgtgaccagtcgatccaccattcctcctgcaactggaaccagtcagtgtacgttggttagaatttatactctcgtcgttaccagacaccacgcgaccagccgaaccgaccaccctaatcttattacgttnttagacttacgactacgtaccgtcgtcgtgtaggttcacgtcgttctcgtctcgtagtctaacgtcgtacncccggtacctcccgcgttacccctgtccgactcggccttacggaggtcctagggacggtcgtagggactacggtatttacgtaagtttgtaactgtaccacgtactaactaacaaagtaccacgtacacgtactacccgtttacgtacccgtttacgtttacggtacgggttaccggtaacggtaacggtacctaacccggtacgtaacccgtacccgttaccggaccccgaaacgtacccccaaaccggtcctaaccccgtaccttaccgtcccttaccgtaccccttacccgttcccctaacccttaccgtccgttacgtccgtacgggtacgtcgggtaactcgggccgacggtacg

SEQ ID NO: 250079 - DNA, 622 bp, Homo sapiens
  misc_feature: GYAE6OF01BPT9O.12.67.G01.1.454.CMB.1.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (337)..(337): a, c, t, g, unknown or other
  misc_feature (337)..(337): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaanagcacccaggcagacncccccaaatcatgtatttttgatgtcactaatcggccctgaggggttctgatcgcttctctggctccaagtctgactacacgcctcctgaccatctcgnggcctcaggctggacggacgaggtctagtactttattatgactacgctctaatataacaagcagacacgcctaccctttcgtttcgtccgttacgggaagttacgggaaccgtaacggttccacccgttacctaccggtacctaaccggacccgaaacggacccccaaccccgtacgttccgtacccgaaccttccttcccggttcccccgttacccttccttacccgtaccgtttccgtaacgtttcccgtacgggacggtacccgggccgttacgggtaaccg

SEQ ID NO: 250080 - DNA, 704 bp, Homo sapiens
  misc_feature: GYAE6OF01B3IXY.12.67.G01.1.454.CMB.1.raw
  modified_base (690)..(690): a, c, t, g, unknown or other
  misc_feature (690)..(690): n is a, c, g, or t
  modified_base (697)..(697): a, c, t, g, unknown or other
  misc_feature (697)..(697): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatcctctgcactggaaccagcagtgacgttggtagttataactatcgtctcctcggtaaccaacagaccaacccgacggacacggaacctaccccccaaaatctagttgttaagtttttgaagtctacgaacttaaccgtccggtacccttacggttacggggtttcctgtactccggttccttccgttcgtcggtaccttaccaacggtttcctacgtaccctaccgaccggtccctaccccgtagacctacgtccgtcgtccggactccggaggctaggaacggtacgaaggtcttagtaagtttactacgtcgacgtacgtacctacgtatacggtcgaacgacggacagtacccttaagttcgtttcgtacgttaccggacgtccgggtaaccctagtacccgtacgtccgtacgtaccgtaaccgacccgtaaccgaccctaaccgacttcgaccttcctaccttcccgacccctccgttccctacgttccgtaccttagtcccgtagggacgtccgggtacncgggtanaaccggg

SEQ ID NO: 250081 - DNA, 625 bp, Homo sapiens
  misc_feature: GYAE6OF01AT48Z.12.67.G01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatccaccatcctcctgcacgtggaaccngcagtcgacgttggtgttataactntgtctcgtgtaccacagccaccgagcagaccgaccccaaatcatgtattttgatcgtacactaacgtccgcctagtagggttctagtctcgtcttctcgtcgcctctagtctatacgtacgccgtccctccgtacgacctacttcctcgtcggcctccgacgtcgtacggaacggcggtacgtcgttgtaagtttattacgtcgctacgtctacgtaatacgtaacacgtaccgaacgcctaacgtcccttaccctttctttcgggtacgttaccgggtaacggtaccgggtaacccgtagggtccctaccggttacccgtaccgtacgaaccggaccccgaaccggaccccctaacccgttcgtacccg

SEQ ID NO: 250082 - DNA, 742 bp, Homo sapiens
  misc_feature: GYAE6OF01DB7MU.12.67.G01.1.454.CMB.1.raw
  modified_base (396)..(396): a, c, t, g, unknown or other
  misc_feature (396)..(396): n is a, c, g, or t
tcagatacgacgtacacgaccggtgctcgatttagagtatacatattggggtttgggggggggtctcaggaggcagcgctctcgggacgtctccaccatggcctgggctctgctattcctcaccctcctcactcagggcacagggtcctcgggcccagtctcgccctgactcagcctgcctcgtgtctggtctcgtggacagtcgatcactatcgtcctgacactggaaccagcgaggtgtacggtttggtaggttaactaacgtagttcgtaccgtccgtacggtaaccaacgacgaccaacccgaggcacgtaaccgacccctaaacgtcaagttcgtattttggacttacgtacaacgttacgtccggtaccgtacggtacggggtttcagtntccgtcttcctcgtcggtccttacgtacgttacgtacgtaaccgtacccggaccgtccctacccgttacgaacccgtacgttccgttaccgggtaccggttaccgaccgtacggtccgtaacggggaacggtacggaacgggtcgttaagttaggttttaactttacgcgtacgacgttactagtaacttaacgacacgacgtacgcctaaccgtaccttaccggttcgtttacggtacggttaaccggacggttaccgggaaccgttacggtacccttccggtaacccttacggaccggtaaccccgtacccggaaacccgtacccccgtacccgtagttccccg

SEQ ID NO: 250083 - DNA, 727 bp, Homo sapiens
  misc_feature: GYAE6OF01CXWDO.12.67.G01.1.454.CMB.1.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctagacagtcgatcaccatctcctgcactggaaccagcagtgacgttggtgttataactatgtctctggtaccaanagccaacccaggcacgacgaccccaaactcatgttatttttagatcgtacactaacgtcgccctgtaggggtttcngtatcgtcttctcgtcggctaccaagtctacgacctacgaccggtccctcctacgacctacttcgtccgtcgggaccttccgaaggtcgtacggaacgggtaaccggaggtacgttagttaacgtttaagtttaacgtcgacgtacgtcttaactaagtaactaacgaagacgagtaccacggtacccttacccgtttgtttacgtaccggtttacgggaacggtccgggtaaaccgtaacggttccctaacccggttacctacccggtaaccaacccggtaacccccgaaacggaccccctaacccgtaacgttcgtaaccctcccgttacccgttaccccgtacccccgttaccccgtttccttacccggtttacccgtaccgttactcccggttacggaccgggttcccgggacgtcgggtaaccgg

SEQ ID NO: 250084 - DNA, 600 bp, Homo sapiens
  misc_feature: GYAE6OF01AQOYY.12.67.G01.1.454.CMB.1.raw
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
  modified_base (600)..(600): a, c, t, g, unknown or other
  misc_feature (600)..(600): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagccggccctcaggtagtttctgactcgtcttctctggcctccaaggctggcgaccgggcctcccgtgactaatatcgtcgggctccgaggctaggacggacggacggctacattactactgctgctcatagtggtagttatgcgtacgttgggtcgttcgggcggacgggaccgtaacgtacgtacccgtacctacgtaccacgcccgtaacggctccgtccccgttcggcctactccttccgttacccctccctccctaccgtaccgttacgttacgtccgtcgacgggtcgggtcgtgggcgaacgggtccgacgtacgtagcngnngn

SEQ ID NO: 250085 - DNA, 803 bp, Homo sapiens
  misc_feature: GYAE6OF01C9OTC.12.67.G01.1.454.CMB.1.raw
  modified_base (184)..(184): a, c, t, g, unknown or other
  misc_feature (184)..(184): n is a, c, g, or t
  modified_base (226)..(226): a, c, t, g, unknown or other
  misc_feature (226)..(226): n is a, c, g, or t
  modified_base (803)..(803): a, c, t, g, unknown or other
  misc_feature (803)..(803): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctccgtggacagtcgatcaccatcctcctgcactcggaaccngcagtgtacgttggtgttattacttgtcctcgtagtaacaancgccaccgaggaccaaaccgcccccaatccgtagtatttagtaggtaggtactacgttacgtttccggtaccttacgtaaaggttacttttaactaacgtcgttactttctacgtttcggtacctagttcgtacggacaaccgccggtcccttacccgacgtaacctacgttcccgtcggttacgggtacccgaggtaccgtagggaacggtaccggacgtcgttagtaactttaacgtacgtcggtattacgttactaacgttaatacgtaaccgtaccttacccgtttctaacccggtttcggtttaccggggttaggtttccgggggttacgggtacggggttaccggaaccggtacggttccgtacccggtaaccgttaccggtttaacgaccggtaaccgtacccggtaaccgtcccgttaccccggtcccccgttacggtaaccttcccttacccggttcccgggttaccccctccccgttacgttaccccggttacgttaccgttacccttggggtaacgtccggggcccggtcggtacccggtaacggacgacccgtaacgtgccggtn

SEQ ID NO: 250086 - DNA, 617 bp, Homo sapiens
  misc_feature: GYAE6OF01APCMN.12.67.G01.1.454.CMB.1.raw
  modified_base (276)..(276): a, c, t, g, unknown or other
  misc_feature (276)..(276): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagctagtgacggtttggtaggtttataactatgtcctcctggtaccaanagccacccaggcagacgacccccaactcatgtattttgatgtcactactcggccctgtagggtttctgactcgtccttctcgtcggactccgaagtctcgactacgaccggtcctcctgacctatcgtcgtcgggacctcgaggctaggacggacgaggtctagtatttacgttagttcgcgtagtctactacttaacgtaacacgacgacgacacgtccctacccgtttcgtttacgtccggtaacgggtaacggtaccgggtaaccgtaacggttaccctacccggttccctacggtacccgaccgaccccgtaaccggcccctaaacccgtcgtaccg

SEQ ID NO: 250087 - DNA, 690 bp, Homo sapiens
  misc_feature: GYAE6OF01DFPF2.12.67.G01.1.454.CMB.1.raw
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
tcagatacgacgtacacgaccggtgctcgatttagagtatacatattgggtttgggggctctgctattcctcaccctcctcactcagggcacagggtcctgggcccagtctgccctgacctcagcctgcctccgtgtctgggtctcctggacagtcgatcaccatctcctgcactggaccagcagtgacgttggtgttatactntgtctctggtaccaacngcaccaggcagacgccccaaatcattgatttttgatgtcactaatccggccctgagggttttctgactcgtcttctctggtctaccaagttcctggactaccgacccggtccctcccgtacgtacctcgttccgtcggtcggtccgtacggacggtcggacgggacggaacggtcgtacggtagttaactttatttacgtacgtacgtacgttactactaacgttaactaacaacgtcgaacgacgtacgtacccctttctttcgtttccggtaccgttacgggtacggtaccggaaccggtacgtacccgtacccgttaccgtacgtccgacccggtaccaacccggaacccctaccctacgttacccgtacctacttcccgttacccgttaccccctaaccctttcccgttacgttaccgttatttccgtcggttacgggaccgggtaccggtcggtacggaaccgg

SEQ ID NO: 250088 - DNA, 640 bp, Homo sapiens
  misc_feature: GYAE6OF01DZVUP.12.67.G01.1.454.CMB.1.raw
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (539)..(539): a, c, t, g, unknown or other
  misc_feature (539)..(539): n is a, c, g, or t
  modified_base (598)..(598): a, c, t, g, unknown or other
  misc_feature (598)..(598): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgtacgttggtggttataactatgtctctggtaccaacagcaccagcagacgccccaatcatgtatttttgatgtacactactccggccctgtacgggtttctgactcgtcttctcgtggcctccgagtctagactacaccggtcctcctcgacctattccgtcgtcggcctccgaggtccgtagggaggacgtacggcttagtatttagttntcgacncgtactacgaattaacgtacaagtcacggacacgtcccttacccgtttcgttttcgttacggttacgggaggtaccgggaacctacgggtccacccggttacctacgtcaccgacccgaacgacccctaacccgngtccgtccaccttcccgttacccgttcccccgtacccttcccgttaccgttacccgttntacccgttcgacggtacgggtaccggtccggttcgggaaccg

SEQ ID NO: 250089 - DNA, 681 bp, Homo sapiens
  misc_feature: GYAE6OF01CR69D.12.67.G01.1.454.CMB.1.raw
  modified_base (278)..(278): a, c, t, g, unknown or other
  misc_feature (278)..(278): n is a, c, g, or t
  modified_base (356)..(356): a, c, t, g, unknown or other
  misc_feature (356)..(356): n is a, c, g, or t
tcagatacgacgtacacgaccggtgctcgatttagagtatacatattggggtttgggggggggtctcaggaggcagcgctctcggggacgtctccaccatggcctgggctctgctattcctcaccctcctcactcagggcacagggtcctgggcccagtctgccctgactcagtctgcctccgtgtctgggtctcctggacagtcgatcaccatctcctgcacgtggaaccagcagtggtacgttggtgttaatactatcgtctcctaggtaaccaancgaccaccgaggcacggaccaccccaaatcatgttattttgatcgtacaacgtacgtccggcccttggtagggtttcngtactcgtcttcgtcgtcgcctacgtagtctcgtacctacccgtaccgtccctaccgtacgtaaccctcgttccgtcggtcgggtaccctaccggacggggtccgtagggaacgggtaaccggtcggttacgttagttacttttaagttacggtacgaccgtacgttacctaactaactaaacgtaacgacgtacgacggtaccacgtacccttaccttagtttcggtaccgtacggggtaacggtacggtaaccgtaacggtcccgacgttaccggtaaccgtcgaacccggtacccaaccggtacccctacccgtgttacccg

SEQ ID NO: 250090 - DNA, 675 bp, Homo sapiens
  misc_feature: GYAE6OF01DF49B.12.67.G01.1.454.CMB.1.raw
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctgtaccacagccaccnggcacgacgacccccaaatcatgtattttgatgtacactactccgtcctgtagggttcngtatcgtntctcnggctacgtatctagactacgccgtccctcctcgacctacttcctacgtcggcctacgaggcgtagggacggacgtacggtcttagttaatttatttacgtcggactacgtctaactattaacgtacgaacgtcactacgaccgtcccctacctttgtttacggtaccgttagggtaacgggtcggtaacccgtaacggttccctaacccgttccgttaaccgcgtaacccgacccgtaaccggaccccctaacccgtcgtcccgttaccgtaccgtttccgttccccgttacccccgtccccgtttaccgttaccgttaccccgtttcgtaaccgttccggtaacggtaccgggttccggacggttcgggaaccgg

SEQ ID NO: 250091 - DNA, 731 bp, Homo sapiens
  misc_feature: GYAE6OF01CGZ5G.12.67.G01.1.454.CMB.1.raw
  modified_base (730)..(730): a, c, t, g, unknown or other
  misc_feature (730)..(730): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctcctggtaaccaacacgaccacccgaggcaacggaccgaccccccaaaactcattgtatttttgatgtacactaacgtccggccctcgtaggggtttctatcgtcttctctcggtctccaagtctacggaccaaaccggtccctccctacgacctactctccgtacggacctccgacgtccgtaggacggacgacggccgtaacttacgtactgtactagttcgactaacgaacgaacgaacgggtaccgtaccccgtacggtttcggggttcggttccggggaccggggtaacgggaacccgtaaacggttccggtaacccgttacccggtaacggtacccgaaccggtacccggaacggtcccgttaccccggtcccccgttacgggttaccctaccgttacccgtttcccgttaccccctccccttcccgttacccgtacccggttccgttaacgttccggtacggtaccggtcggggtccggtaccgggacggaaccgggttccgaacgacgtggtcng

SEQ ID NO: 250092 - DNA, 711 bp, Homo sapiens
  misc_feature: GYAE6OF01ES0P2.12.67.G01.1.454.CMB.1.raw
  modified_base (293)..(293): a, c, t, g, unknown or other
  misc_feature (293)..(293): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctccgtgtaccaacacgccacccgaggcacgacgaccccaaatcatgtattttgatgtacactactcggccctgtagggtttcngctcgtcttctctcggtctacctagttcgtacgaccgtaccgacccggtcccttcccgtacgtaccctacgttcctccggttcgggccttacccgaagggtctacgggaacggtacgggacggtacgttaggtaatttttaattacgttacggtactaggtacccttacgtaattaacgtaacgagacgaacgaccgtataccccttaccctttcgttttacggttaccgttagggacgggtacgggtaacccgtaacggtaccgtacccgttaccgtaccgtcgaaccgacccgtaacggaccccaaacccctgtcgtacccgtaccttcccgtttaccgttacccccctaccgtttcccctacgttacccggtttcgtaccgtcttacgggacgggtcgggtacgtcggaaccggg

SEQ ID NO: 250093 - DNA, 774 bp, Homo sapiens
  misc_feature: GYAE6OF01CBW0E.12.67.G01.1.454.CMB.1.raw
  modified_base (221)..(221): a, c, t, g, unknown or other
  misc_feature (221)..(221): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgtacgttggtgttataactatgtctctgtaccaangcaccaggcagacgaccccaatcatgtattttgattgtctaactaacgtccggcccttgtacggggttttctaggtacttccgtctttccgtccgttcgggtccttaccgtaaggttcctacggtaccttaccgacccggtcccttcccctacgtaccctagttccgtcggtcgggtcctaccggaggtcgtaggacggacgtacggtcttagttacttttaagttattcggactacgcttactaaattaacgtaaacaacggtaccacggtacctaaccggtaccccttacccctttcgttttacggttacccggtttagggaaccgggttacgggtaaccctacgggttaccctaacccggtttcccgttaacccggtaccaccggtaccccgaaaccggaccccctaaacccgtcccgttacgtaccctaccgtttccccgttaccccggtttccccctaccccgtttacccgttcccgtttaaccccggttcggttacccttcgggttacccggaggggttcccggggttaccgtccggggtaaccggg

SEQ ID NO: 250094 - DNA, 872 bp, Homo sapiens
  misc_feature: GYAE6OF01C2POW.12.67.G01.1.454.CMB.1.raw
tcagatacgacgtacacgaccggtgctcgatttagagtatacatattggggtttggggggggggtctcaggaggcagcgctctcgggacgtctccaccatggcctgggctctgctacttcctcaccctcctcactcgagggcacgacggggtccgtcgggcccagtctcgccctgactcacgcctcgcctccggtgtcgtcgggtcctaaaaaccgtggacacgtcgactaccacctactcctccgtcgacacgtacggaaccgagcgtaggtcggttacggttgggttaggttaactacttagtcgttccgtcgtacggtaaccaacgacgaccgaccgacggacacgaccgaccccaactactacttacgttatttagtactcgtacctaacgttacgtaccggtaccgttcggttacgggtttctaggacttcgtcttcgtcgtcgtacctacgtacgtctacgactaccgccgtcctccgtacgtacctacgtcgtccggtaccggccgtaacgtcggtacgtacgggacggtaacgggtacgttacgttaacgtttaacgttttaagttacggtacggaacccgttacttaacccggtaactttaactaaccgtaaacggtaacggtacccgtaaccgggtaccgtaccgtttaaccccggtttacgttttccgggtttaacccgggtttacggggaaaccgggggtttaccggggtaaaccggttaaaaccggggtttccccgggttaaaccccggttacccgggttttaccccggttaaaacccgggttacccgggttaaaacccccggaccccggaaaccccgggttaacccccccgtaaacggtttaaccccgttacccgggg

SEQ ID NO: 250095 - DNA, 793 bp, Homo sapiens
  misc_feature: GYAE6OF01A30TI.12.67.G01.1.454.CMB.1.raw
  modified_base (236)..(236): a, c, t, g, unknown or other
  misc_feature (236)..(236): n is a, c, g, or t
tcagatacgacgtacacgaccggtgctcgatttagagtatacatattgggtttggggctctgctattcctcacctcctcactcaggcacaggtcctggcccagtctgccctgactcagcctgcctccgtgtctgggtctcctggacagtcgatcaccatctcctgcactggaaccagcagtgacggttggtggttaataactatcgtctccgtaggtacctaacagcctaacccgnggccacggaccgacccccaaaatcacgttgtattttgacttgtacactaagtccgacccttgtacggggtttcagtacgtcgcttcgtccgtcggttacccaaggttctacggcaaccgtaccgtcccttcctaggaccctgtcgtcccgtggggtaccctaggtcttaggcggtacgacgggtctaggtactttaacgtcggtcgtacgtaccgttactaagttaacgtaaccgtaacgtccgttaacccttccgtaaccgttcgttcgggtaacgggttccggttacgggtcggtttaccgggacctaaggtccgtacgggtacccgttcgtaaacgtcccgaaccgtacccggtaacgggtccttcccgggacccccgttacggttaccctaacccggttcccgttttaaccccgggttaccccccctacccggtttaacccccggttaccgtttaaccgggtttacccggtttacccttaccgggtttccggaaaccgggttccggggttaacccgttacgggaacccgttaaacgggttccccggtaaacgg

SEQ ID NO: 250096 - DNA, 756 bp, Homo sapiens
  misc_feature: GYAE6OF01AWJHN.12.67.G01.1.454.CMB.1.raw
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctctgcactggaaccagcagtgtacgttggtgttaataactatgtctcctgtaccaacagccaccaggcacgacaccccaaatcatgtattttgatgtacactagtccgcctacgtaggggtttcagtatccgtcttctcgtcggtcctacctaagtctagtacctaccgacccggtccctcccgtacgaacctacttcctccggtcggccttacccggaggtccgtagggacggtacggaggtacttaggtaacttttagttacgttcgactaacgtccttacgtaacttaacaacgaacgtaccacgtaccgaaccgtcccttaaccccgttttcgtttaaccgggttaccgtttacggggaacggttacggggtaacccgtaacgggttccccgtaacccgttacccgttaaccggacccggtaaccggaccccggtaaacccgtacccccgtaaccccgtacgtaccggttaccctcccgtttaccgtccccccgtttcccccggacccctttacccggttaccgtttacccggtatttacccgggtcgggtaacccgggtaggtccggtaaccggtcgggtaaccgg

SEQ ID NO: 250097 - DNA, 792 bp, Homo sapiens
  misc_feature: GYAE6OF01BB2BX.12.67.G01.1.454.CMB.1.raw
  modified_base (232)..(232): a, c, t, g, unknown or other
  misc_feature (232)..(232): n is a, c, g, or t
tcagatacgacgtacacgaccggtgctcgatttagagtatacatattggggtttgggggggggtctcaggaggcagcgctctcgggacgtctccaccatggcctgggctctgctattcctcaccctcctcactcagggcacagggtcctgggcccagtctcgccctgactcagcctgcctcgtgtcgtgggtctcctggacagtcatcaccatcctctgcacgtcggaaccngcaggtcgtacggtttggtacgttaataactagtcgttcctccgtacggtaaccaacacgccacccgaggacgacgacccgaccccgtaaactctagttcgttagttttgattcgtactaacgtaacgtccggtcccgttcggttacgggtttctacgtacgttccgtcttcgtcgtacgtactaccgtaagtccgtacgtacctaccgtaccggtccccttccgtacgtacctcgttccgtcgttccgggtaccttaccggacggtcgtagggaacgggtacggtacggtacgttacgttaacgttttagttacgttacgaccgtaagtacccttaacgtacttaaactaaccggtaaggaccgaacggtaaccggtaccttaccccttacccgttttacggtttacggtttacccgggttacggggtaaaccgggttaacggggtaacccgttaccgggttaccccggtaaacccggttcccgtaaacccggtacccggtaaacccggtaacccggtaaaccccggtaacccccgtaaacccgttccggtttaacccg

SEQ ID NO: 250098 - DNA, 762 bp, Homo sapiens
  misc_feature: GYAE6OF01BYMJZ.12.67.G01.1.454.CMB.1.raw
  modified_base (256)..(256): a, c, t, g, unknown or other
  misc_feature (256)..(256): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactgggaccagcagtgatgttggacttataaccttgtctcctggtaccaacaacaccaggacaaacgccccaaatcatgatttanggaggcacgtaagccgcctgtagggtttctagtcgtcttctcgtcggtctccgtagtcgtcggacaaccgaccggcctacccgtagaactaactccgttcgtacgggcctccgacggtcctagggaacgggacggagggtaccggtaatttaacttacgttggttacgtccttaagtaattaggtacgggtacgggttagtacgtacttaacgtttcggtaagtccggttaccgttacgggttcgggacggggtaacggaccgtaacggtaccgtacggtacccggtaccggttcgggacccgaaccggtaccccgtaacgggtccccgttacccggtccccccgttagggtaccccttaccgttacccgttcccggtttacccccctacccccgtttacccgtacccgtttaaccgggttcccttaacggttacccggtacgggtaacgggtcccggggtaccgttaccgggggaaccggttaacgggcccgtaacggttaacgg

SEQ ID NO: 250099 - DNA, 778 bp, Homo sapiens
  misc_feature: GYAE6OF01EZIJV.12.67.G01.1.454.CMB.1.raw
  modified_base (182)..(182): a, c, t, g, unknown or other
  misc_feature (182)..(182): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctccgtggacagtcgatcaccatctcctgcactggaaccngcaggtgacggttggtggttataactagtgtcctccgtagtaccaacacgccacccgaggcagaccaccccaaatctatgttattttttgacttcgtactacctaacgtcccggtcccttacggtacggggtttctggtactccgtctttctcgtcggtacctaccgtaagttcctacgtaacccgtaccggtacccggtccccttcccctacgtaaccctacttcccgttcggtcgggtaccgtacccggtaggtaccgtacgggaacgggaaccgggtacggtacttaacggttaacttttaagtttaacgttccggtacacgttaccctaactaaattaaccgaaacgtaacggacgtaaccggacctaaccggtacccctttaacccgtttccgttttacggttaccggttaacgggtaacgggtaccggtaacccgtacggtacccgtacccgttaccgtaacgtcgaacccggtacccgaaccgtacccccaaccgttctaaccgttcccgtaccttcccgtccgtacccccttcccttcccgttcgttaccgttctacgtcgtacgggaccggccggtgtcggaccggg

SEQ ID NO: 250100 - DNA, 644 bp, Homo sapiens
  misc_feature: GYAE6OF01EO259.12.67.G01.1.454.CMB.1.raw
  modified_base (250)..(250): a, c, t, g, unknown or other
  misc_feature (250)..(250): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctggggtctcctggacagtcgatcaccatctcctgcactggaaccagcagtgacgttggtggtttanaactatgtctcctggtaccaacagcacccaggcagacgacccccaaactcatgtatttttgatgtcactaatccggccctgtaggggttttctgatcgcttctcgtgctcagtctgactacaccgcctcccgtagacctacttcctcgtcgggcctccgaggtctaggaggacgagggcgttagtatttaacttagttgcacgtactcataatacaagtccaagccaacgtcccgtaccctttcgtttacggttccgtttacgggggtaaaccgttacgggggtaacccctaaacggggttccctaaccccggtttaccccgtaaacccggttaccggaacccggtaccccccgaaaaacgggtaccccccctaaacccccgtaccgttacccg

SEQ ID NO: 250101 - DNA, 755 bp, Homo sapiens
  misc_feature: GYAE6OF01BGYMT.12.67.G01.1.454.CMB.1.raw
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (439)..(439): a, c, t, g, unknown or other
  misc_feature (439)..(439): n is a, c, g, or t
  modified_base (735)..(735): a, c, t, g, unknown or other
  misc_feature (735)..(735): n is a, c, g, or t
  modified_base (755)..(755): a, c, t, g, unknown or other
  misc_feature (755)..(755): n is a, c, g, or t
tcagatacgacgtacacgaccggtgctcgatttagagtatacatattgggtttgggggctctgctattcctcaccctcctcactcaggacacagggtcctgggcccagtctgccctgactcagcctgcctccgtgtctgggtctcctggacagtcgatcaccgtctcctgcacgtgggaccagtaatgtattttaggtaaattttgactagtctcgtagtaaccaacaacgtacccggactaaacgtccccaagttaatctatttanggaggacaacgtaagccggcctcgaaggtagtttcngtatcgtcttctcgtcggcctaccgaaggtcgtccgggaccggtacccgggccctccgtagaactaatacgtccgtcgggcctacgtagggtcgtagggaacggaccgacggtacgtactaacttaacgttaccgngttacctgtcctaacgttaagtcggttaggtaaggtttacgacggtacgtttacggtttgggggttacgggttccgggggaccgggtaaccgggtaaaccgtaaacggttaccggtacccgggtttaacgtaacggtacccgaacggacccggtaacggtccccgtacccgtccccgttaacccggtctaccccgttccgttaccccgttacccctcccgttaccttacccgttaccggttccgttaactccggtaacgggtccggggtccggtacgtacgggaccgaccggggtnaacccgtagcgagtcagcgn

SEQ ID NO: 250102 - DNA, 816 bp, Homo sapiens
  misc_feature: GYAE6OF01CSJBD.12.67.G01.1.454.CMB.1.raw
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcacgtggaaccagcagtgacgttggtagttaataactatcgtctccgtacggtaaccaagacgccaacccgagggacacgaaccgacccccaaaatcaattgttatttttgattgtacaactaacgtccgccctcgtaggggtttctgactcgtcttctcgtcgtacctaccgtaagtcctagtaacctaaccgacccggtccccttcccgtacgaaccctacgtccgtccggttcggccctaccgaagggtccgtaaggggaacggaccggaggtcttaggtaattttaagttacgtgactagtacctacgtaataactaacgaagccagaccgaaccgtcccttaaccctttcgttttaccgttacgggttaccggggtaaacggtacccgggtaaaccgtaacgggttaccccaaccccggtttaccgttaacccgtaaccgaaccccggaaccccgtaaacccgggaacccccaaacccccgtttactacccggtaccttaaccccgtttcccgttaaccccggtttcccccccctaaccccgttttaccccgtacccggttttaaacccgttccccggtttaactacccggttaggggaacccccggggtccggggtcccggttaacggggaaaccccggg

SEQ ID NO: 250103 - DNA, 783 bp, Homo sapiens
  misc_feature: GYAE6OF01BB6M0.12.67.G01.1.454.CMB.1.raw
  modified_base (230)..(230): a, c, t, g, unknown or other
  misc_feature (230)..(230): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtggaaccngcagtcgtacgttggtgtttataactatcgtctcctggtaccaacgacgccacccaggcacgaccgacccccaaactcattggttatttttgacttcggtacacgttaacgtccggtccccgttacggttacggggttttcctaggtacgtttcccggtcctttccgttccgttcgggtaccccttacccggtaaacgtttccgtacgtaacccgtacccgtaacccgggtccccttaccccgtaccgacctacgttccgttccggtcgggtcccttaccggtacgggtcgtacgggacgggtaaccggtagggtaccttaggttaaacttttagtttacgtcgacctaacggttcccttaacgtaattaaaccgtaaccaacggtaccgaaccggtaccgtaccgtaccccttacccgttttacgttttccgggttaccggttacggggtaacgggttacccgggtaaccgttaaccggttacccggtacccgttacccgtacggtacccgaccggtaccccgaaccgacccccgtaaccccgttctacccg

SEQ ID NO: 250104 - DNA, 804 bp, Homo sapiens
  misc_feature: GYAE6OF01C42DL.12.67.G01.1.454.CMB.1.raw
tcagatacgacgtacacgaccggtgctcgatttagagtatacatattgggtttgggggggggtctcaggaggcagcgctctcgggacgtctccaccatggcctgggctctgctgctcctcactctcctcactcaggacacgagggtcctcgggcccagtctgccctgactcagcctgcctcgtgtctggtctcctggacagtcgatccaccgtctcctgcacgtcgggaccagtaatgtattttaggtaatttgaccttagtctcctggtaaccaacaactaccccgataaacgtccctaaagttaactctatttatgtacgggcctaacgtacgtccggccctacgaggtagtttctagtactcgtcttcctcgtcggtcctccgaaggtccgtacgggcccggacccgggtcccttacccgtagtaaccgtaacgttacgtccggttcgggtacctaccgacgggtcgtacgggaacgggaaccggtacggtccttaacgttaactttacgtacgtcgtccgtcgtacctagtaagttacggttacgggttaaggtttaacttacgggtaacccgttacgggtttacggggggttcgggtttaccgggggtcccgggggtaaccggggtaaacccgttacgggtacccgggttaaaccccgttacccggtaaaccgttaccggaaccccggtaacccggtaacgggttccccgtaccccgggtcccccccggttacggtaccccgtcccgtttacccgtttccccggttacccccccggtccccttacccggtttaaccccg

SEQ ID NO: 250105 - DNA, 828 bp, Homo sapiens
  misc_feature: GYAE6OF01BQ0BB.12.67.G01.1.454.CMB.1.raw
  modified_base (184)..(184): a, c, t, g, unknown or other
  misc_feature (184)..(184): n is a, c, g, or t
  modified_base (315)..(315): a, c, t, g, unknown or other
  misc_feature (315)..(315): n is a, c, g, or t
tcagatacgacgtacacgaccggtgctcgatttagagtatacatattgggtttgggggctctgctattcctcaccctcctcactcaggcacgagggtcctgggcccagtctgccctgactcagcctcgcctccgtgtcgtgggtctccgtggacagtcgatcaccatctcctgcactggaaccngcagtgacgttggtagttataactatcgtctcctggtaaccaacagccacccgaggcacgaccgacccccaaatcattgtatttttgatcgtactaactaacgtcccggtcccgtacggtaggggtttccngtactccgtctttcgtcgtcgctaccgaagtcgtacgaccaacgaccgtccctcccgtcgaccgtcgtccgtcgggtcctccgacggtcgtaggtaggtacgtacggacggtcttaggtaattttacgttaccgtcggtccgttagtaccctttagtaagttacggtcgggggtaacgtcccgttaaacggttccgtttttacggtttaacgttccggggtttaccgtttaacgggggaaaggtttacccggggaaacccgttacgggtttacccgtaaaccccgggtttccggttaaacgggacccgtaaacccgggtaccccctaaacccgggtacccccctaaaacccccgttacgggtttaccacccgggtttaaccccttcccggtttacccccggttccccccgttaccccttcccgtttacccggttaacccgtttacccggttacgttaacccggttccgggaacgggttccccggacgtaaccgggggacccgtaagggtcccg

SEQ ID NO: 250106 - DNA, 543 bp, Homo sapiens
  misc_feature: GYAE6OF01C5YVE.12.67.G01.1.454.CMB.1.raw
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (537)..(537): a, c, t, g, unknown or other
  misc_feature (537)..(537): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctcgggtctcctggacagtcatcaccatctcctgcactggaaccagcaagtgagtttggtggttaatatatgtctccgtgaaccaanacgccacccaggcaagaccacccccaaatcagtntattttgatntcactaacgtcgccctgtagggtttctgnttcgnttctntgctacagtcngactacgacgcctccngacngtctacgcggtcaccgagctagacggagagcgtnatttatatgactagctanaattacgacaagcagacctagcccctcttccgttagtcgttaccggaaagtcggaacctaggtccaaccgtctacgtcaccgacccaacgacccctaccgnttcccg

SEQ ID NO: 250107 - DNA, 770 bp, Homo sapiens
  misc_feature: GYAE6OF01EI0GW.12.67.G01.1.454.CMB.1.raw
  modified_base (256)..(256): a, c, t, g, unknown or other
  misc_feature (256)..(256): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactgggaccagcagtgatgttggacttataaccttgtcctcctgtaccaacaaccaccagacaacgaccccaactcatgtattanggaggcactaagccgcctgacgggtttctagtcgtcttctcgtcggcctccggtagttcgtacggacaaccgtaccgggccccttaccgtcgaacctaacttcccgttaccgttcggggacccttccggacggtaccgtaggggtaacgggaaccgggagggtaccgggttaacgttttaacgtttaacgtttggtttacgtccttaacgtaacttacgggttacgggtcgggggtttaacgtaaccggtccttaacggtttttaccgacgttttcgtacccgttggttacccggggaggggaaccggtaaccgaagtcccgtacggtacccggttccggtagggtaccgccggaaccccgtaggtccccgttacccgtaccccccgtcgggttaccctacccgtttacccgttcccgttacccccgtaccccgttccttacccggttaacccggttgttacctccggtcggaccggggtccggacggttacgggaacgcgggtcgcgtaacgg

SEQ ID NO: 250108 - DNA, 688 bp, Homo sapiens
  misc_feature: GYAE6OF01EH7CJ.12.67.G01.1.454.CMB.1.raw
  modified_base (212)..(212): a, c, t, g, unknown or other
  misc_feature (212)..(212): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (341)..(341): a, c, t, g, unknown or other
  misc_feature (341)..(341): n is a, c, g, or t
  modified_base (458)..(458): a, c, t, g, unknown or other
  misc_feature (458)..(458): n is a, c, g, or t
  modified_base (680)..(680): a, c, t, g, unknown or other
  misc_feature (680)..(680): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgccttccgtgtctgggtctccgtggacagtcgatcaccntctcctgcatggaaccagcagtgacgttggtgttataactntgtctcgtggtaccaacngaccaccaggcagaccgaccccaaatcatcgtattttgatgtcaactacgtccggccctcgtgggtttcngtactcgtcttctcgtggtctacctaagtcgtacgacctacgacccggtcccctccgtacaacctacgttcctcggtcgggtccctaccggacggtacgtagggacggtaaccgggngggtaccgttagttaacttttaagtttacgtttacggaccttacggtacttaccgtaaacttacgttaaccgtaacgaccgtacgaccggtacctacccttaacccgttccgttttacgttaccggttaccgggaacggttaccgggtaacccgttacggtaccccgtacccggttaccgtaaccggtacccaccggtacccgaacccggaccctaccccgngttacccg

SEQ ID NO: 250109 - DNA, 704 bp, Homo sapiens
  misc_feature: GYAE6OF01D1GCB.12.67.G01.1.454.CMB.1.raw
  modified_base (294)..(294): a, c, t, g, unknown or other
  misc_feature (294)..(294): n is a, c, g, or t
tcagatacgacgtacacgaccggtgctcgatttagagtatacatattggggtttgggggggggtctcaggaggcagcgctctcgggacgtctccaccatggcctgggctctgctattcctcaccctcctcactcgagggcacaggggtcctgggcccagtctgccctgactcagcctgcctcgtgtctggtctcgtggacagtcatcaccatcctcgtgcactacggaaccagcctaggtggtacggtttggttacggttaataacctgtcgttcctccgtacggtaaccaacncgccaacccgaggcaacgaccgaccccaaactcagttacgttagtttttgaacttcgtactaacttaacgtccggtacccgttggttacgggtttcaggtactcgtcctttcgtcgtacggccttacgaagtctacgacctacgccgtccctccacgtactactcgtcggttacggcctaccgagtcgtacggacggtacgaggtctacgttatttacgtagttcgagtaacgtctagtaactaagtaaccaacgtacgtacgtaccgaccgttaccctaccggttttcttaccggttacggtaccgggtacgggtaccggtaaaccggttaccgttacccggtacgttaccgttaacccggaccgacccgtaaaccccggacccgtaaccccgtaaccgtcgttacccg

SEQ ID NO: 250110 - DNA, 663 bp, Homo sapiens
  misc_feature: GYAE6OF01ERYXL.12.67.G01.1.454.CMB.1.raw
  modified_base (380)..(380): a, c, t, g, unknown or other
  misc_feature (380)..(380): n is a, c, g, or t
  modified_base (442)..(442): a, c, t, g, unknown or other
  misc_feature (442)..(442): n is a, c, g, or t
  modified_base (645)..(645): a, c, t, g, unknown or other
  misc_feature (645)..(645): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgactcaccatctcctgcactggaccagcagtgacgttggtgttataactatgtctcctggtaccaacacgcacccaggcacgacgaccccaaatcatgtacttttgatgtacactaactccggtccttgaggggtttctcggtatccgtcgttcgtctcggtacgtccctaagtccttacgaccgtaccgtccgcccttcctaccgactactcgtcgtcggtccncgtgcgtggacggacgtaggcttagtactttattacgttcgacgacgtctaactaaagttanaaaccgtaacgacttaacgacctcgtaccccgtaccctttccgtttttacggtaccggtttaggaacgggttcgggtaaacccctaacggttcccgaccgtttaacccgacggtaccgtacccggaaccgtacccggacccaacccgtgtacgcttacctccgttcgtacccctcccgtcctacgttcgcgtaacctcggtanacgggccgtggtcgtacg

SEQ ID NO: 250111 - DNA, 825 bp, Homo sapiens
  misc_feature: GYAE6OF01DZ5RW.12.67.G01.1.454.CMB.1.raw
  modified_base (137)..(137): a, c, t, g, unknown or other
  misc_feature (137)..(137): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
  modified_base (582)..(582): a, c, t, g, unknown or other
  misc_feature (582)..(582): n is a, c, g, or t
  modified_base (589)..(589): a, c, t, g, unknown or other
  misc_feature (589)..(589): n is a, c, g, or t
tcagatacgacgtacacgaccggtgctcgatttagagtatacatattgggtttggggggggtctcaggaggcagcgctctcgggactctccaccatggcctggctctgctattcctcaccctcctcactcaggcacngggtcctggcccagtctgccctgactcagcctgcctccgtgtctcgggtctcctaggtacacgtcgatccaccatcctctagcctacgtaggaacccaggcnggtcggtaccggttggttacggtttaataaaccgtntcgttcttaccgtcggtaacccaacacgccaccgacggaccgtaacgaccggaaccccctaaacgtctagttcgttatttttggacttacgtacctaacgttacggtacccggtcctacggttagggtttcctgtactccgttcttccgtacgttcgaccttacgtaagtcgttcggtaaccctaccgaaccgttccccgtccgtactaacccggtctttacggtccggttacggtaccctaacgaccgggttaccgaggtacgggtaacggaccggtgtttaacgtttaacgtttacgttacggtntaacgtntttacccgtaagttaacttaaccgaaccgttacgaacgtacgaccggttaaccctaaccgtttaccccttttcgggtttacgtttaccggggttaaccggtacggggtttaccggtaaaacccgggttaaccgggtaccctttaaaccccggggttacccgtttccgggaaacccgttaccccggggaaccccttaaaacccggacccccgttaacccctaagggtttaacccccg

SEQ ID NO: 250112 - DNA, 842 bp, Homo sapiens
  misc_feature: GYAE6OF01EESHX.12.67.G01.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagatacgacgtacacgaccggtgctcgatttagagtatacatattgggtttgggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcatcaccntctcctgcactggaaccngcagtgacggttggtgttataactntgtctccgtaggtaccaacacgccacccgaggcacgaaccgaccccctaaactctagtagttatttttaggacttcgtacgtaacgtaacgtcccggtcccttcggtacggggtttctagtactccgttcttcgtcgtcgtacctacgtaagtcctacgacctaccgacccggtcccttaccccgtacgtaaccctacgttccgtccggttcgggtaccccgtaccgacgggtcgttacgggaacggggtaaccggagggttaccgttaggttaacctttttaagtttacggttcggtacccgtaaggttacccttaaccgtaaacttaacgttaaacccgtaaggtaacccgtaacgtaacccgtaacccgtaccccgtttaccccggttttacgtttttaccgggttaacccggtttaaccgggggtaaccggggtttaacccgggaaaccccgggtttaacgggtaccccccggttaaacccccgggtttacccggttaaaccccggttaccccggtaaacccccggttaacccccggaaacccccgggttaacccccccctaaacccccgttccggttaccccg

SEQ ID NO: 250113 - DNA, 730 bp, Homo sapiens
  misc_feature: GYAE6OF01DFW3W.12.67.G01.1.454.CMB.1.raw
  modified_base (308)..(308): a, c, t, g, unknown or other
  misc_feature (308)..(308): n is a, c, g, or t
  modified_base (347)..(347): a, c, t, g, unknown or other
  misc_feature (347)..(347): n is a, c, g, or t
  modified_base (471)..(471): a, c, t, g, unknown or other
  misc_feature (471)..(471): n is a, c, g, or t
  modified_base (631)..(631): a, c, t, g, unknown or other
  misc_feature (631)..(631): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcgagggcacgagggtcctcgggcccagtctcgccctgtacctcacgccttcgcccgttccggttgttccgttgggtccttccgtggacctcggtcgactcccaaccgtcttcctcccgtgccaccgtacggaaccacgcgtaggtcggttacggtttaggttagttaactaacgttnttcgttcctacgttacggtaaccactaccgccgaaccgnggaccacggacccgaccctaactctagtttagtttacttttgacttcgtacctacgttaccgtccggtccgttacggttgggtttccagtcgttcctctttaccgcgtcgccttacgtaccgtntaccgactacccggcccgtccttaccgactacctcgttcgtccgtacggtcctacgcgggtcgacggtaacggcggtgtacgttacgtttaagttacgttgtacgcttacgactacttactaacgtaacgacgcgcgaccgttacctcctttaccgtttnttacccggttggtaaccggtacgttaccgggacccgtttaaccgcccgttaaccttcggacctacccgaaccgaccctaaccgtccccacgtcgtaccg

SEQ ID NO: 250114 - DNA, 810 bp, Homo sapiens
  misc_feature: GYAE6OF01ETSPF.12.67.G01.1.454.CMB.1.raw
tcagatacgacgtacacgaccggtgctcgatttagagtatacatattggggtttgggggggggtctcaggaggcagcgctctcggggacgtctccaccatggcctgggctctgctattcctcaccctcctcactcagggcacagggtcctgggcccagtctgccctgactcagcctgcctcgtgtctgggtctcgtggacagtcgatcaccatcctcctgacctacgtacggaaccgagcgtaggttacggtacggtttaggggttagtttaaactaaacttagtcggttcttacccgtacggtaaccaacgacgacccgaacccgacggacgaacgaacccgtaccccctaaacttccgtaagttacgtttagttttacgacttcgtaccgtaaccgttaccggtcccggtacccgttgggttacgggtttctacgtacgttccgtcctttcgtcgtcggtacccttaccgtaacggtcctacgtaccgtaccgaccccggtcccttaccgtacgtacctacgtttacccggtcgtaccggtcccgtaccggtacggtccggtaaggaccgggacggtaggtacgttatacgtttattacgtcgacgtcgttacgtactactaacgtaacgacggtactaacgtaccgtacgttacccttaccggtttcgtttacggttacccggttagggtaccgggttaaccggtaacccgggtttacccgacccggttaccccggttacccgtaaccggtaacccggaaccccggtaccccgtaacccggaccccccgtaaacgttacggttaccc

SEQ ID NO: 250115 - DNA, 772 bp, Homo sapiens
  misc_feature: GYAE6OF01EI0PV.12.67.G01.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (546)..(546): a, c, t, g, unknown or other
  misc_feature (546)..(546): n is a, c, g, or t
tcagatacgacgtacacgaccggtgctcgatttagagtatacatattgggtttgggggggtctcaggaggcagcgctcgtcgggacgtctccaccatggcctgggctctgctattcctcaccctcctcactcaggcacgagggtccctgggcccagtctcgccctgactcgacgcctgcctccgtgtctgggtcctccgtggacncgtcgatcacctntccgtctgcacgtacggaacctgctagtgacggtttggtagtttaactaactacgttcgtccttccgtacggtaaccctaaacgcgaccaaccgaggacctaacgaccccgtaccccctaaaacgtctaacgttagttacgtttttcggacttacgttacccgtaaaccttaacggtccccggtcccgtttacgggttacggggttttcctaggtaccttccgtcctttcgtcggtacgtaccgttaccgaaggttcctacgtaccttaccgacccggtcccttacccgtacggacccttcgttaccgttccggtccgggttaacccnccggtaacgggtcgtaacgggaacggtacggtaggtaccttagttaacgtttacgttagtccgactaagtccttagaacttacgaacgacgtagaccgacgtaccctacccttaccgttcgtttcggtaccggtttacggaaacggttaccggaaaccgttaccggaccctacccggttacgacgtcccgaaccgtacccgaacctcccccgaaccttgtaccccg

SEQ ID NO: 250116 - DNA, 525 bp, Homo sapiens
  misc_feature: GYAE6OF02IYIFM.12.67.G01.1.454.CMB.1.raw
  modified_base (521)..(521): a, c, t, g, unknown or other
  misc_feature (521)..(521): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaatcatgatttatgagggcaaaaaacggccctcggggatttctaatcgcttctctggctccaagtctggcaacacggcctccctgaccgtctctgggctccaggctgaggatgaggctgattattactgcagctcatatgcaggcagcaactgtttgtcttacggaactcgggaccctaggtccaccgtcctaggtcacgacccaaggcccaacccgctcgtccactcctcgttccccaccctcctctacgtctatctgacgcggctcggcaggcgntacg

SEQ ID NO: 250117 - DNA, 534 bp, Homo sapiens
  misc_feature: GYAE6OF02H17DO.12.67.G01.1.454.CMB.1.raw
  modified_base (469)..(469): a, c, t, g, unknown or other
  misc_feature (469)..(469): n is a, c, g, or t
  modified_base (504)..(504): a, c, t, g, unknown or other
  misc_feature (504)..(504): n is a, c, g, or t
tcagatacgacgtacacgaccggtgctcgatttagagtatacatattgggtttgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgccaccggaaccaatagtgacgttggtcgttataactttgtctcctggtacaaacagcacccaggcaaacgccccccaactcctgatttatgaggtcactattcggtcctcaggtatttctaatcgcttctctggttccagtctggacaacacggcctcctgaccatctcgtcggggtacccaggctggacggacgaggctgatttatactgctagttcatatacagcacttcactcgtcgtgtcgttcggnggtggaccagctgaccgtctagtcacgccaagccncgcccctggtccactctccgtcccctaccc

SEQ ID NO: 250118 - DNA, 532 bp, Homo sapiens
  misc_feature: GYAE6OF02JWP5P.12.67.G01.1.454.CMB.1.raw
  modified_base (475)..(476): a, c, t, g, unknown or other
  misc_feature (475)..(476): n is a, c, g, or t
  modified_base (494)..(494): a, c, t, g, unknown or other
  misc_feature (494)..(494): n is a, c, g, or t
  modified_base (525)..(525): a, c, t, g, unknown or other
  misc_feature (525)..(525): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaatcatgatttttgatgtcactaatcggccctcgagggtttctgatcgcttctctggctccaagtctgactacacggcctccctgaccatctcgtcggcctccgaggctggaggacgaggctagattatattgcagctcatatacaagcagcacgcctacccttgtttcgtcttacgggaagttcgggaccaaggtccaccgtcctacgcgacgcccgaagcccaacccnncgtccactctccgtcccnccctctcgtaccgtcgtatcgtgacgcggtntggaccg

SEQ ID NO: 250119 - DNA, 520 bp, Homo sapiens
  misc_feature: GYAE6OF02JIV5K.12.67.G01.1.454.CMB.1.raw
  modified_base (277)..(277): a, c, t, g, unknown or other
  misc_feature (277)..(277): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (460)..(460): a, c, t, g, unknown or other
  misc_feature (460)..(460): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaatcatgatttttgatgtcactaatcggccctnaggggtttctgatcgcttctctggctccaagtctgactacacggcctccctgaccatctctggctccaggctgaggacgaggctgattattattgcagctnatatacaagcagcagcacccttntttgtcttcggaatcgggaccaaggtcaccgtctacgtcacgcccaagcccaaaccccntcgtaccactctcgttccccgccttcctctaccgtcgtactcgtgaggccggtctggccg

SEQ ID NO: 250120 - DNA, 517 bp, Homo sapiens
  misc_feature: GYAE6OF02G3L7H.12.67.G01.1.454.CMB.1.raw
  modified_base (425)..(425): a, c, t, g, unknown or other
  misc_feature (425)..(425): n is a, c, g, or t
tcagatacgacgtacacgaccggtgctcgatttagagtatacatattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgatgctgggatgataagtttgtctcctggtaccaacatcacccaggcaaagcccccagactcatgatttatgagggacaaaaacggccctcggggatttctaatcgcttctctggctccaagtctggcaacacgcctccctgacaatctctgggcctccaggctggaggacgaggctgattattactgctnctcatatgcaggtagtggctacttcgctactgtcggcggacggacgaagctcgaccgttactacgtcacggccaaggcctacgcccctccgg

SEQ ID NO: 250121 - DNA, 526 bp, Homo sapiens
  misc_feature: GYAE6OF02IVDB2.12.67.G01.1.454.CMB.1.raw
tcagatacgacgtacacgaccggtgctcgatttagagtatacatattgggtttgggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaaccagcagtgatgctggggatgataagtttgtctcctggtaccaacatcaccccaggcaaagcccccagactcatgatttatgagggacaaaaacggccctacggggatttctaatcgcttctctggctcaagtctggcaacacggcctccctgacaatctctcggctccaggctgaggacgaggctgattattactgctgctcatagtgcgaggtagtggtctactttcgctactagttcggcggaggaccgaggtctacgaccgtccgtacgcacgcccaggcctccgtccccgtcgg

SEQ ID NO: 250122 - DNA, 524 bp, Homo sapiens
  misc_feature: GYAE6OF02F15B6.12.67.G01.1.454.CMB.1.raw
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
  modified_base (460)..(460): a, c, t, g, unknown or other
  misc_feature (460)..(460): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaatcatgatttttgatgtcactaatcggcctcaggggtttctgatcgcttctctggctccaagtctgactacacggcctccctgaccatctcgtcggctccaggctgaggacgaggctgattattattgcagctanatatacaagcagcagccacccttntttgtcttggagtcggaccaggtcaccgtcctacgtcacgcccaagcccaacccntcgtacacttctccgttccccgcccttcctcgtaccgtcgtactcgtgacggcgggactggacg

SEQ ID NO: 250123 - DNA, 542 bp, Homo sapiens
  misc_feature: GYAE6OF02HQDJL.12.67.G01.1.454.CMB.1.raw
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (508)..(508): a, c, t, g, unknown or other
  misc_feature (508)..(508): n is a, c, g, or t
tcagatacgacgtacacgaccggtgctcgatttagagtatacatattgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcactaagccggccctcgaggggtttctatcgctttctctggctccgagtctggcaacncggcctccctgacatcnctgggctcaggctggaggacgaggcggtatttagttacgtgttgctcatgtggtcgggtagtagctactttcgattcgttcctagttcggcgggaggaccaagctcgaccgtccgtggtcacgccgagcctccgcccctgtccacgtctccgttcccncccttcctctacgtcgtactcgtcgcggcggtcg

SEQ ID NO: 250124 - DNA, 601 bp, Homo sapiens
  misc_feature: GYAE6OF02IHU88.12.67.G01.1.454.CMB.1.raw
  modified_base (230)..(230): a, c, t, g, unknown or other
  misc_feature (230)..(230): n is a, c, g, or t
  modified_base (369)..(369): a, c, t, g, unknown or other
  misc_feature (369)..(369): n is a, c, g, or t
tcagatacgacgtacacgaccggtgctcgatttagagtatacatattgggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcacccaggcagacgcccccaaactcatgtattttgatgtcactaatccggccctcgagggtttctgatcgcttctctggctccaagtctgactacncgtcctcctcgacctatctcgtgggcctcgaggctggaggacgagggtctagtatttattattcgactagtcctactataagtaacaagcagcaacgtcctaccctttcgtttacgtccgtttacgggaacggttacggggaaaccctaacgggttaccctaaccccggttcctaacccggtaccgtaaccggaccccgtaaaccggccccctaaaccccgtcgttacccgg

SEQ ID NO: 250125 - DNA, 520 bp, Homo sapiens
  misc_feature: GYAE6OF02FU7NL.12.67.G01.1.454.CMB.1.raw
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
  modified_base (517)..(517): a, c, t, g, unknown or other
  misc_feature (517)..(517): n is a, c, g, or t
tcagatacgacgtacacgaccggtgctcgatttagagtatacatattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaatcatgtattttgatgtcactaatcggcctcgaggggtttctgatcgcttctctggctcaagtctgactacacgtcctcctgaccatctctgggctccgaggctgaggacgaggctgtattattattgcagctacatanacagcagcagccacccttnttcgtcttacggaagtcggaaccaaggtccaaccgttctacgtcacgtacccaaggcccaacccntcg

SEQ ID NO: 250126 - DNA, 533 bp, Homo sapiens
  misc_feature: GYAE6OF02GYQHJ.12.67.G01.1.454.CMB.1.raw
  modified_base (412)..(412): a, c, t, g, unknown or other
  misc_feature (412)..(412): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaactcatgatttttgatgtcactaatcggccctcgaggggtttctgatcgcttctctggctccaagtctgactacacggcctccctgaccatctcgtgggcctccgaggctggaggacgaggctgtattattattgcagctcatatacaagcagcagcctacccttntttgtccgttacggaagtcggaccgtaaggtccaccgtcctacgtcacgcccaacgcccaccccactcgtcacctctcgttcccgcccttcctctacgtctctcgtgcggtcggctggacg

SEQ ID NO: 250127 - DNA, 625 bp, Homo sapiens
  misc_feature: GYAE6OF02IS711.12.67.G01.1.454.CMB.1.raw
  modified_base (210)..(210): a, c, t, g, unknown or other
  misc_feature (210)..(210): n is a, c, g, or t
  modified_base (615)..(615): a, c, t, g, unknown or other
  misc_feature (615)..(615): n is a, c, g, or t
tcagatacgacgtacacgaccggtgctcgatttagagtatacatattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacntctcctgcactggaaccagcagtgacgttggtgttatactatgtctcctgtaccaacagcacccaggcacgacgcccccaaactcatgtattttgatgtcactaatcggccctcgagggtttcagatcgtcttctcgtgtcctaccaagtctgactacgtaccgcctcctcgacctactctacgtcggcctaccgaggtccgtaggtacgggacgacgggtactacgtaatttagtttacgttgccgtaacgactacctagttaactaacaagtaccagtaccaaccgtctacccttcgtttacgtaccgttagggtaacgttcgggaaccttaacgggtaccctaacccggttacctaccggtacccgtaaccggacccccgtaaacggtcccccgtaaacccnccgttaccgg

SEQ ID NO: 250128 - DNA, 592 bp, Homo sapiens
  misc_feature: GYAE6OF02IAX6J.12.67.G01.1.454.CMB.1.raw
  modified_base (207)..(207): a, c, t, g, unknown or other
  misc_feature (207)..(207): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (447)..(447): a, c, t, g, unknown or other
  misc_feature (447)..(447): n is a, c, g, or t
  modified_base (514)..(514): a, c, t, g, unknown or other
  misc_feature (514)..(514): n is a, c, g, or t
  modified_base (535)..(535): a, c, t, g, unknown or other
  misc_feature (535)..(535): n is a, c, g, or t
  modified_base (581)..(581): a, c, t, g, unknown or other
  misc_feature (581)..(581): n is a, c, g, or t
  modified_base (590)..(590): a, c, t, g, unknown or other
  misc_feature (590)..(590): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactgacaaccagcagtgacgttggtggttataactntcgtctcctaggtaccaacagccaccgagggccagacgtcccccaaaatcaatgattttgatgtcactaanccggccctgaggggttttcngactcgctttctctgactccaagtctgaactacacggcccttccgngaccattccgcgtacgggtcctccgaaggtctaggaaggaccggagggtcttaggtaatttagttagtttgacgacgtcttacattaacacaaagcaagcganccctaccttctttgtccttaagggaagttcgggaacctaaaggtcctaacccgtcgtactacggacncccgaaaggtccccaaacccngtcgtcactccgtaacgtcccaccctctctacgtcgtactctaggncccgggtancg

SEQ ID NO: 250129 - DNA, 613 bp, Homo sapiens
  misc_feature: GYAE6OF02IYDDR.12.67.G01.1.454.CMB.1.raw
  modified_base (223)..(223): a, c, t, g, unknown or other
  misc_feature (223)..(223): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacngccacccaggcagacgcccccaaactcatgatttttgatgtcactaactcggccctcgtacggggtttntgatcgtcttcgtctggtctaccgtaagtctacgacctacaccggccctcctgacccatcncgtcggcctcgagctgaggacgnggctgtattattattcgcacgtctactatactaacagacacgcacgccttacccttactttcgtacgtttacgggaacggtgggaacccgaagggttcccaaccgttccttacgtccgacgacccgaaacgccccaacccctacgtcttaccacttccttaccgttcccctaacccttccgttaccgttaccgttccgttagtccgtaggtaccggacggggttcctacgggtaacg

SEQ ID NO: 250130 - DNA, 611 bp, Homo sapiens
  misc_feature: GYAE6OF02IQFL0.12.67.G01.1.454.CMB.1.raw
  modified_base (230)..(230): a, c, t, g, unknown or other
  misc_feature (230)..(230): n is a, c, g, or t
  modified_base (339)..(339): a, c, t, g, unknown or other
  misc_feature (339)..(339): n is a, c, g, or t
  modified_base (390)..(390): a, c, t, g, unknown or other
  misc_feature (390)..(390): n is a, c, g, or t
tcagatacgacgtacacgaccggtgctcgatttagagtatacatattgggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtcgacgttggtgttaatactatgtctcctggtaccaacagccaccgagcagacgaccccaaatcatgtatttttgatgtcactaatccggcctcgtcgggtttcngtactcgtcttctcgtcggctactaacgtctcgaactacgccgtccctccncgacctctctcgtcggtcctccgaggtcgtaggacgggacggtacggctaggtactttatttactcgcagtcctatataactaacgacgacaggacacgacccttaccctttgtttcgttaccggttacggtaacgggtcgggaacccgtaacggttcccgtacccgttacccgttacgtcgacccgacccgtaaacccggacccctacccgtacctccgg

SEQ ID NO: 250131 - DNA, 632 bp, Homo sapiens
  misc_feature: GYAE6OF02FSUVL.12.67.G01.1.454.CMB.1.raw
  modified_base (223)..(223): a, c, t, g, unknown or other
  misc_feature (223)..(223): n is a, c, g, or t
  modified_base (388)..(388): a, c, t, g, unknown or other
  misc_feature (388)..(388): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaangcacccaggcagacgcccccaaatcatgtatttttgatgtcactaatccggccctcgaggggtttctgatcgcttctctggctccaagtctgactacacggcctccctgacctatctcgtggcctcgaggctggaggacgaggctagtattattactgttcgctnatagtggacgggtagtagtctacgtttcgattcgttccgttagttcgggacgggacggaccgaagtccgtacgtacccgttccgtagggtaccgaacggacccgtaacggtccttacccggtcccccgttcgggttaccctaccgtttccgttaccggtttaccccccacccgtttccccgttaccgttaccggtttccgttacttccggttacggtacggtccgggttacgtcgggtaaccgg

SEQ ID NO: 250132 - DNA, 615 bp, Homo sapiens
  misc_feature: GYAE6OF02G6DH8.12.67.G01.1.454.CMB.1.raw
  modified_base (293)..(293): a, c, t, g, unknown or other
  misc_feature (293)..(293): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
  modified_base (554)..(554): a, c, t, g, unknown or other
  misc_feature (554)..(554): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagccacccaggcagacgcccccaaatcatgtattttgatgtcactaactccggccctcgtaggggtttcngtactcgtcttctctcggcctaccaagtctgacctacgacggccctcctcgacctatctcgtcggctccgaggctaggaggacggagtctagtatttattatcgacngtctacatanacagcagcacgccctacctttgtttcgtaccgttacgggacgtacgggaacctaacggtccgtaccgtacctacggtccaacgtaccccgaaccgtacccaaaccccgtcttaccgtacctaccgttccgttacccgttccccncccttaccgtacccgttaccgttccgtacttcgtcggtaccggtcgggtcgtacggaccgg

SEQ ID NO: 250133 - DNA, 775 bp, Homo sapiens
  misc_feature: GYAE6OF02H4YW2.12.67.G01.1.454.CMB.1.raw
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgacccccaaatcatgtatttttgatgtcactaactcgccctcgaggggtttctaatcgtctttctacgtggttcctaagtctcggccaaccgaccggtccctcccgtacgacctactccgtccggttcggggtcccaacgggtcctaggtaacgggacggtacggccgttaggtaacttttaacgtttaaccgtcggtacgtacggtttactaatttaacgtaacaaacgtaccctaacctttacccctaaccgttccggttacgggtttcggtttccgggttacgggtccggggtaccggaaccgtaagtccgtaccggtacccgttaccgtaaagtcccgaaccgtaccccgtaaggcccgttacccgtaccccccgttcggttacccaccgtttcccgtttacccgttaccccccgtacccctttacccggttaccccgttacgggtttacccgtttaccgttaccgggttacggtaacccgggtccggggtacccggttacggggtaccgaaccgggtcccggtacgtaacgg

SEQ ID NO: 250134 - DNA, 726 bp, Homo sapiens
  misc_feature: GYAE6OF02ITGGX.12.67.G01.1.454.CMB.1.raw
  modified_base (320)..(320): a, c, t, g, unknown or other
  misc_feature (320)..(320): n is a, c, g, or t
tcagatacgacgtacacgaccggtgctcgatttagagtatacatattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccgtctcctgcactggggacccagtaaattcgtattttagggaaacttttgacctagtcctcctggtaccaacaactaccccggcaaacgtccccaagttaactcatttangtacggctaactaacgccggtcctacgagggtagtttcgtagtacgttcgcctttctctcggtcctccgaaggtccgtgggaccggtacccggggtccccttcccgtacggactaaacgttacgtccggtacggggtccttaccggaacgggtccgtaggggaacggacggaacggtccttaccgtaacgtttaccgtaccgtgtcccgttgtccctaacgtatacggtacggtaaggttactacggcttaacggttgggttcggttacggggcgggtaccggtaacgtaacggttcggtaccgtacgtaacggtcgaccggtaccgaaccggtcctaccggtcccccgtaggtccgttaccgttcgttcccgttccccgtcccgttcccgttacgtaccgttccg

SEQ ID NO: 250135 - DNA, 575 bp, Homo sapiens
  misc_feature: GYAE6OF02FJYPL.12.67.G01.1.454.CMB.1.raw
tcagatacgacgtacacgaccggtgctcgatttagagtatacatattgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcactaagcggccctcagggtttcttatcgcttctctggctcgagtctggcacacggccctcctgacaatctcgtgggcctccgaggctggaggacgaggcggattattactgttcgctcatatggcggtagtcgctacgtttcgattcgtccttagttccgggcgggtaggaccgaagcgtacggacccgtcgtcgggtcacgccaacggtcctaccgcccccgtcggtccaccgttcctccgttcccccacccttcccgtaccgttaccgtcgttactcgtcggtacggtccggtacgg

SEQ ID NO: 250136 - DNA, 600 bp, Homo sapiens
  misc_feature: GYAE6OF02IH871.12.67.G01.1.454.CMB.1.raw
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
  modified_base (560)..(560): a, c, t, g, unknown or other
  misc_feature (560)..(560): n is a, c, g, or t
  modified_base (598)..(600): a, c, t, g, unknown or other
  misc_feature (598)..(600): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccgtctcctgcactgggaccagtaatgtattttggaaattttgacctagtctcctggtaccaacaactacccggnaaacgtcccaagttaatcatttangaggcactaagcgccctcgaggtatttcngatcgcttctctggctccgaaggctggcgaccgggcctcccgtgacatactcgtgggcctccgaggctggaaggcgaggcctactattactatgctgctcatagtgggtagttatacgcgtacgtttggggtcgttccggggcggtaaccgggaactaaagggttcgaacccgttaccgtaagtaccgacgtcccgaagtccgtaccgtccccgtcggtacaccgttcgtaccgtcccctaccctcctacgttaccgtcttacgtcgtacgnggccggtcgtacggacgaacggcctagacgtagcgtannn

SEQ ID NO: 250137 - DNA, 681 bp, Homo sapiens
  misc_feature: GYAE6OF02H7LMJ.12.67.G01.1.454.CMB.1.raw
  modified_base (252)..(252): a, c, t, g, unknown or other
  misc_feature (252)..(252): n is a, c, g, or t
  modified_base (649)..(649): a, c, t, g, unknown or other
  misc_feature (649)..(649): n is a, c, g, or t
  modified_base (668)..(668): a, c, t, g, unknown or other
  misc_feature (668)..(668): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctctgcacgtggaacagcagtgatggttggacttatactgtctctgtaccaacacaccagacaacgaccccaactcatagtatttagnggacggactaacgtaacggccggtccccttacggtacggggtttctagtacgtccggtctttaccgtcgttcggtccttaccgtaagttccgtacgtacctaaccggacccggtcccttacccgtacggaccctacgttcctaccggttcgggacctcccggaaggtcgtacggaacgggacgtaggtctagttaatttacttacgtcgactacgtctactaattaactaacacgcacgctacgtacccttaccgtttcgtttacgtacgttacgggtaacggttacgggaacctacggtaccacccgttacgtacgtccgaacgacccaaccgtaccccaaccctctacgactacctccgtacccttccccaccgttcctacgtttaccgtccgtntaccgtggaccggtccggngtcggacgacgcg

SEQ ID NO: 250138 - DNA, 726 bp, Homo sapiens
  misc_feature: GYAE6OF02IQPNK.12.67.G01.1.454.CMB.1.raw
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctctgtacacagcaccaggcagacgacccccaaactcatgtatttttgatcgtcaactaacgtcggccctcgtacggggtttctgacttccgtctttctctcgggtactccgaagtctgtaacctacgaccggtcccttccctacggacctacttaccgtcgttcgggacctccgtaacgggccgttagggaacgggaccggtagggtacttaggtaacgttttaatttagttacgcgtacgtcttacgtaataactaaccgaaacgcgaacgcaacggaccccttaccctttcgttttcgggttacctttacggggaaagttcgggggtaaccctaaacggggttcccaaccggtttacccgttacggtccgtaaccggaacccgtaaccgaccccgaaacccctaagttccgtaaccttccgttacctttaccggttaccccccgtaccctttacccgttaacccgttacgtttaccgactttccggtaagtcccgggacggttccgtccggaacgg

SEQ ID NO: 250139 - DNA, 557 bp, Homo sapiens
  misc_feature: GYAE6OF02FNS42.12.67.G01.1.454.CMB.1.raw
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (403)..(403): a, c, t, g, unknown or other
  misc_feature (403)..(403): n is a, c, g, or t
  modified_base (484)..(484): a, c, t, g, unknown or other
  misc_feature (484)..(484): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaanagcacccaggcagacgcccccaaatcatgtatttttgatgtcactaatccggtcctcgaggggtttcngatcgcttcnctggctccagtcngactacacgcctcctgaccatctcgtcggctccgaggctggaggacgaggcttagtatttagttattgctagtctactatataacaagcngcacgcccacccttgtttcgtcttacggacgtcgggacctaagggtccaccgtctacgtcgacgcccaacggcccaacccncgtcgccacgttcctaccgttccccgccttcccgtcgttaccgtcgtactcgtacgacgcgggtctaggaccg

SEQ ID NO: 250140 - DNA, 740 bp, Homo sapiens
  misc_feature: GYAE6OF02I9M0Z.12.67.G01.1.454.CMB.1.raw
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
tcagatacgacgtacacgaccggtgctcgatttagagtatacatattgggtttgggggggggtcgtcaggaggcagcgctctcgggacgtctccaccatggcctgggctctgctattcctcaccctctcactcagggcacagggtcctgggcccagtctgccctgactcagcctgcctccgtgtcctgggtctcctggacngtcgatcaccatctcctgcactggaaccagcagtgacgttggtgttanaactgtgtctctgtacacagccaccngacacgacgaccccaactcgatgtattttgattcgtcacttactccggtccctgtagggtttctgtacttccgtcttcgtcgtcggtcctaccgtaagtcctacggtaccttaaccgccggttccctaccccgtagaccctactttaccctcggtttcgggaaccgttccccgtacgggccggtttaagggaccgggtaacggccggtaccgttacggttactttttaaccgtttagttcggtacgtaccgtcttacgttaaccgttaataaccggtaagaccgtaacgacctaaccgtaaccccgttcctttaaccgttttcgtttaacccggttacggggtaacgggttaaccggggtaaaccgttacccggttcccgaaaccccgggtttcccggttaaccggttcccggaaaccggttcccccggaaacccgtacccccgtaaccccgtcccgttaaccgg

SEQ ID NO: 250141 - DNA, 668 bp, Homo sapiens
  misc_feature: GYAE6OF02IX8YX.12.67.G01.1.454.CMB.1.raw
  modified_base (372)..(372): a, c, t, g, unknown or other
  misc_feature (372)..(372): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacagcaccaggcagacgacccccaaaatcatgtattttgatgtacaactaactccggcccttcgtaggggtttctgtactcgtcttctcgtggccttcaagtctagacctacgccgccctcctcgaccatcctcgtcggcctccgaggtcgngaggacgacggctatattattgtcgacagtacctactataactaacgaacgcagaccacgtcctacccgtttacgtttcgtaaaaaccgtttcgggtaacgggtacggtaaccgtaacggtaccctaccggttaccttaccgtaccaaccggacccgaaccggtaccctaaaccccgtccgttaccgtaccgtaccttccgtccccgttaccccctaccccgtttaccctacccgtttaccgtaccgttaccgttacgttaccggtaccgggtaccgggtacggtaccggtaccgg

SEQ ID NO: 250142 - DNA, 704 bp, Homo sapiens
  misc_feature: GYAE6OF02FM67B.12.67.G01.1.454.CMB.1.raw
  modified_base (345)..(345): a, c, t, g, unknown or other
  misc_feature (345)..(345): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataactatgtctcctggtaccaacagcacccaggcagacgcccccaaatcgatgtatttttgatgtcactaatccggccctgtaggggtttctgtactcgtcttcgtctggctaccgaagtctagactacgaccggtcctcccgngacctatctcgtcgggctccgaggcctggacgacgaggtctagtattttaagttagttcgcagtctactattaacgtacaaagcaacggccaacggcccttaaccccgtttgtttacggtaccgtttacgggaacggttacggggtaacctaacgggtccctaacccggttacccgttaaccggtccgaacccgtaacccggaacccggtacccctaaacccccgttagttcccgttaccctaccgttacccgttaccccggtttccccccggacccctttccccggttaaccgttacccgtttacccgttaacgttcccgggtaaggacccgggtcgggtaccgttacgggaacccgg

SEQ ID NO: 250143 - DNA, 700 bp, Homo sapiens
  misc_feature: GYAE6OF02JNDG6.12.67.G01.1.454.CMB.1.raw
  modified_base (258)..(258): a, c, t, g, unknown or other
  misc_feature (258)..(258): n is a, c, g, or t
tcagatacgacgtacacgaccggtgctcgatttagagtatacatattgggtttgggggggggtcgtcaggaggcagcgctctcgggacgtctccaccatggcctgggctctgctattcctcaccctcctcactcagggcacagggtcctgggcccagtctgccctgactcagcctgcctcgtgtctgggtctctggacaggtcatcaccatctctgaccactggaacccagctagtgacggttggtggttaataactntgtcctcctcgtacacagcaccaggcacggaccgaccccaaactcagttgtattttgatgtaccactaacgtcccggtacctacggttacgggttcctaggtacgttccgtccgtttcgtacgtcggtaccttaccaacgtttccgtacgaaccttaccgacccggtcccttcctacgtacctacgttccgtcgttacggccctacgacggtcgtagacgggaggacggtccgtattacgtttacgttcgtacgtctctaagtacggtcggtaggttacgtacgtacgttaaccgtttgtacgttcgtttaaccgtcggttaccggggtaaccgggaaggggttaacccaggttcccgtaggttaccccggttcggttaagggacccgttaccggaacccggtacggacccgtttccccgggtaccccgttcggttaacccc

SEQ ID NO: 250144 - DNA, 652 bp, Homo sapiens
  misc_feature: GYAE6OF02JP46P.12.67.G01.1.454.CMB.1.raw
  modified_base (258)..(258): a, c, t, g, unknown or other
  misc_feature (258)..(258): n is a, c, g, or t
  modified_base (586)..(586): a, c, t, g, unknown or other
  misc_feature (586)..(586): n is a, c, g, or t
  modified_base (646)..(646): a, c, t, g, unknown or other
  misc_feature (646)..(646): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactgggaccagcagtgatgttggacttataccttgtctcctggtaccaacaaccaccgaggcaaacgccccaaactcatgtatttangaggcactaagccgtcctcgtacgggtttcttatcgtcttctcgtcggcctccgtagtcgtacggacctaacgaccggtcctaccctacggactaacgtccgtctcgggacctcgacggacgtgacggacgaggtctagtaatttagttattcgacgagtactagtaactacgtaacgtaagcgaacgcacggtacctacccgtttatttcggttcgttaaggtacggtagggaaccctaagggttaccctaaccggtcctacggtacgtacccgacccgtaacggaacccctaaccgtactacgtcctaaccgtcttccgttccccncccttccgtaccgttacgtcttactaccgtggtaccggtcggtactacggacgtaccggngtaacg

SEQ ID NO: 250145 - DNA, 690 bp, Homo sapiens
  misc_feature: GYAE6OF02G6OJU.12.67.G01.1.454.CMB.1.raw
  modified_base (230)..(230): a, c, t, g, unknown or other
  misc_feature (230)..(230): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
tcagatacgacgtacacgaccggtgctcgatttagagtatacatattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccngcagtgatggtggacttataccttgtctctgtaccacacaccagcaacgccccaactcatnattangnggcactagcgcctcgagggtttctatcgtcttctctcggctacaagtctagacttaccgaccggtcctaccctgaccctactcctacggtcggtccttccgacgtcgtagggacggacggacggtctaggtaatttagttacgttgacgtaacgtccttaacgtaattaaccgtaaacgaaacggtccgaacggtcctaaacggtccccttaaccgttttccggtttttacggttccgtttaacgggggaacgttaccgggtacccgttaacgggtttccccggaaccccggttttacccgtaaaccggtcccgtaaacccgggaccccgtaaacccgggacccccttaaacccccgtaacggttcccgttacccgtacccttttcccccgg

SEQ ID NO: 250146 - DNA, 586 bp, Homo sapiens
  misc_feature: GYAE6OF02G7R24.12.67.G01.1.454.CMB.1.raw
  modified_base (230)..(230): a, c, t, g, unknown or other
  misc_feature (230)..(230): n is a, c, g, or t
  modified_base (338)..(338): a, c, t, g, unknown or other
  misc_feature (338)..(338): n is a, c, g, or t
tcagatacgacgtacacgaccggtgctcgatttagagtatacatattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtgttataactatgtctcctggtaccaacagcacccaggcagacgcccccaaactcatgtatttttgatgtcactaatcggcctcgaggggtttcngatcgcttctctggctccaagttctgactacgacggccctccctagaccatcctcgtcgggcttccgaggtctaggaggacgaggctagtattattattcgctgtctcatagtcgacgtaggttacggtggccttacgtttcgacctacgttacgttccggggacggtacgggacccaaggtccgtacggtacccgttaccgttacgtacccgtacgccccggaacggtcccttcccggtacccccgg

SEQ ID NO: 250147 - DNA, 687 bp, Homo sapiens
  misc_feature: GYAE6OF02G8V07.12.67.G01.1.454.CMB.1.raw
tcagatacgacgtacacgaccggtgctcgatttagagtatacatattgggtttgggggggggtctcaggaggcagcgctctcgggacgtctccaccatggcctgggctctgctattcctcaccctcctcactcaggcacagggtcctgggcccagtctgccctgactcagcctgccctccgtgtctgggtctccgtggacagtcgatccaccatctcctgcactgaaccagcagtgtacggttggtggttaataactagtgtccttccgtggtaccaacagaccacccgaggcagacgaccccccaaatcatgtattttgatgtcatactccggcctgtagggtttctgactcgcttctgtcggtctacgaagttctacgtactacaccggtccctcccgtcgaccctattccgtccgttcgggccctaccgtaggtcctagggaacgggaaccggaggtcctaggttaacttttaagttttacgttacggactacgtaccttactaattaacctaaccgaaagtccaacggtaccaaccgtccctaaccccgtttcgtttaccgtttacccggtttacggggaaccggttacggggaaacccgtaacggttcccctaaccggttaccccgttaacgtacccgaccgaaccccggaaccgtaacccccgtaacccctaccttacccg

SEQ ID NO: 250148 - DNA, 745 bp, Homo sapiens
  misc_feature: GYAE6OF02GE4LP.12.67.G01.1.454.CMB.1.raw
  modified_base (230)..(230): a, c, t, g, unknown or other
  misc_feature (230)..(230): n is a, c, g, or t
  modified_base (736)..(736): a, c, t, g, unknown or other
  misc_feature (736)..(736): n is a, c, g, or t
tcagatacgacgtacacgaccggtgctcgatttagagtatacatattgggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgtataactgtgtctctggtaccaacagccaccgaggcacgacgacccccaaactcaagtcgtatttttaggattggtacaaccgttaacgtcccggtcccttacggtacggggtttcctgtaccgttcgtactttccgtcgtacggtacctacccgtaaagtttccgtacgtaaccgttaaccgaacccgggtcccctttccccgacggaacccttacgttcccgttacgtccgggtcccgttaccgtacgggtaccgtaggtaaaccggaccgggtaacgggtaccgtttaggtaacttttaacgtttaggttcggaaccttccggtaacttaccgtaacgtaattaacccggaacgtacaccgggtaccacgggttacccttaccctttccgttacgttaccgttaccgggaggttaccgggaacccgttaagggtccctaaccggttaccgtaccgtacgaccgtaccccgaaccgtacccgtaccccncgttacccg

SEQ ID NO: 250149 - DNA, 649 bp, Homo sapiens
  misc_feature: GYAE6OF02HF9YT.12.67.G01.1.454.CMB.1.raw
  modified_base (207)..(207): a, c, t, g, unknown or other
  misc_feature (207)..(207): n is a, c, g, or t
  modified_base (279)..(279): a, c, t, g, unknown or other
  misc_feature (279)..(279): n is a, c, g, or t
tcagatacgacgtacacgaccggtgctcgatttagagtatacatattggggtttggggggggggtctcaggaggcagcgctctcgggacgtctccacatggcctgggctctgctattcctcaccctcctcactcgagggcacgagggtcctggggcccagtctgccctagactcagcctgcccttcgtgtcgtgggtctcgtggacngtcatccacctatcctctgacctacgtacgggaaccagctagttcggtaacggtttggtagttaataacttntcgtcctctacggtaccaacacgacctaccaggccacgaccgacccccaactactatgtattttgactcgtacacgttaacgtccggtccgttacgtacgggtttctgtactcgtcttctctcggtctcgtaagtctcgacctaccgtaccggtccctcctacgtacctactccgtcgcggtcctcgacggtcgcgtagggacgagtcgtataattatttacgtgcgtatccgtactaagacgaacagtacacgacctagccttaccgttcgtttacgtcggttacgggtacggtaccggacggttaccggtaccctacggtcccttaccggaccaccggtacccggaaccgcccccgtacgtactcccg

SEQ ID NO: 250150 - DNA, 588 bp, Homo sapiens
  misc_feature: GYAE6OF02JKWA3.12.67.G01.1.454.CMB.1.raw
  modified_base (196)..(196): a, c, t, g, unknown or other
  misc_feature (196)..(196): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (582)..(582): a, c, t, g, unknown or other
  misc_feature (582)..(582): n is a, c, g, or t
tcagatacgacgtacacgaccggtgctcgatttagagtatacatattgggtttggggggggtctcaggaggcagcgctctcgggacgtctccaccatggcctgggctctgctattcctcaccctcctcactcaggcacagggtcctgggcccagtctgccctgactcagcctgcctccgtgtctggtctctggacngtcgatcacagtctcctgcactggaaccagcagtgacgttgtgtataactntntctctgtaccancgcaccagcagaccgaccccaactcactgtatttcgatcgtacactacgtccgccgtacgtagggtttactgtactccgtcttcgtcgtcgtctaccgtaagtctacgtactaccgtacccggtccctcccgtacgacctacgtcgtccgtgtcctccggtacgcgtacggtacgacggacggtctagtacttagttagttacgactacgtcgtactaattaacgaactacgtagaaccgctaaccgcgttacccttcttacgtcgtacggtagtaccgacgtacgtcctaccgtcctgtcgacacccgacgacccacctntacccg

SEQ ID NO: 250151 - DNA, 790 bp, Homo sapiens
  misc_feature: GYAE6OF02HXYTR.12.67.G01.1.454.CMB.1.raw
  modified_base (182)..(182): a, c, t, g, unknown or other
  misc_feature (182)..(182): n is a, c, g, or t
  modified_base (366)..(366): a, c, t, g, unknown or other
  misc_feature (366)..(366): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgctactggaaccngcagtgacgttggtgttataactatgtctcctgtaaccaacagccaccgaggcacgacgacccccaaatcatgttatttttgatgtacataacgtcgcctgtagggttctgactcgtctttctcgttcggcctaccgtaagttcctagaccgttaacgcccggtccctcccgtacgaacccctntccgtttcggcgggtacccttccggagtccgtaggaaggaaccggtagggtcctaggttattttacgttagttacgacgacgttactaccgtaagttaacgtaaccgaaacgcggtaacgacgtaacccggtaccctttaaaccccgtttcgtttaccggtttccgtttaaacggggtaaccggttaaccggggtaaaccgtaacggggtttaacccaaccccgggtttaccttaccgggtaaccctaaccgggtaaccccgaaacccgggtacccctaaacccccggtattaaccggttccctaaccgtttcccgtttaacccggttacccccctaacccccgtttcccgttaacccgtttaccggttcggtttaacccttcggtaccgggtaccgggtcgggtccggtaacggtaacccggg

SEQ ID NO: 250152 - DNA, 725 bp, Homo sapiens
  misc_feature: GYAE6OF02HI4PQ.12.67.G01.1.454.CMB.1.raw
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (443)..(443): a, c, t, g, unknown or other
  misc_feature (443)..(443): n is a, c, g, or t
  modified_base (502)..(502): a, c, t, g, unknown or other
  misc_feature (502)..(502): n is a, c, g, or t
tcagatacgacgtacacgaccggtgctcgatttagagtatacatattgggtttgggggctctgctattcctcaccctcctcactcagggcacagggtcctggcccagtctgccctgactcagcctgcctccgtgtctgggtctcctggacagtcgatcaccagtctcctgcactggaaccagcagtgacgttggtagttataactntgtcctccgtagtaccaanacgccacccgaggtaccacgacccgaccccaaaactcaagttgttaatttttgagttacgtacctaacttaagttccggacccgttaggtaggggtttactacgtattccggtcctttctcgtcgtacctaacgaacgttctacgtacnccgtaccgcctacctcacgtatcgttcgngcctcgacgtcgtcgaacggacgcgtactagttaactttntacgtcgtacacgtacctatagttaacacgaaacgtccgagacgtacctcctaccgttnttacgttacgttacgaaaggttcgaccgtaactccggttaacctaccgttacgacacccggtaacccgtaacgaccccaaaccgttcgtaccttaccgtaccgttacccgttccccgttaaaccccgttccccgttaccttaaaccccggtttacgttacccggtttaacgttacccggttacggaacccgggggtaccgttttacccggtagggaaccccgg

SEQ ID NO: 250153 - DNA, 756 bp, Homo sapiens
  misc_feature: GYAE6OF02FQ1IX.12.67.G01.1.454.CMB.1.raw
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (462)..(462): a, c, t, g, unknown or other
  misc_feature (462)..(462): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatcctcctgcacgtggaaccagcagtgacggttgtggttataactatgtctctaggtaccaanacgcacccaggcagacgccccaaatctatntacttttgatgtactaatacgtccggtccgtcgtacgggtttctggtactctcgtttctcgtcgccttaccgtaacgtcgtcgtaaccgtacgaccgtcccttaccgacgtacctactaccgttcggtacggtcctccgaggtccgtggacgggacggcgtcgtattaacgtttaattcgtagccgtagtaccgtactaacgttaanaccgaaaggtccaacgtaccgaaccggttccctaccctttcggtttagttcccggttaaggggtaacgttaccgggaaccgggttaaccgttacccgacccgggtttaaccgtccgtaccggtaacccgtaacccggaaccgttaaccccaaccccggttaccgttaccgttaccgtaccccgttccgttacccgggtttccccctacccccggttttccctaaccggtttacccggtacgtttccttccgggttaacggcccgggggtaccgttaccgggtcggtaaacccgg

SEQ ID NO: 250154 - DNA, 804 bp, Homo sapiens
  misc_feature: GYAE6OF02FW0CC.12.67.G01.1.454.CMB.1.raw
  modified_base (151)..(151): a, c, t, g, unknown or other
  misc_feature (151)..(151): n is a, c, g, or t
  modified_base (795)..(795): a, c, t, g, unknown or other
  misc_feature (795)..(795): n is a, c, g, or t
tcagatacgacgtacacgaccggtgctcgatttagagtatacatattgggtttggggggggggtctcaggaggcagcgctctcgggacgtctccaccatggcctgggctctgctattccgtcaccctctcactcgagggcacgagggtccnggccagtctgccctgactcagtcctgcctcgtgtctgggtctccgtaggactggtcgatccacagtcctcctggccacgtcggaaacctgcctaaggtcgtaccggttttggtaggttaactaaacgtgttcgttcctccgtacggtaaccaacgacggtccctaccggacggtactacggaaccgtaccccccgaaaattccgtaagtttacggttacgtttttacggacgttccggttaaccgtaaccgttaaccggtcccggtacccgtttaacggttacggggttttacgttacggtacgttccgttaccgtttcgtcgttacggtaccttaccgttaacgtccgttacgtaaccgtaaccggtacccgtacccttacccgtacgtaccctacgtccgttaccggtacggtcccgtaccggtacggtacgtacggaacgggtaccgtacggttactacgttaaacgtttaacgtacggttacgcgtaacgtcttacgatttaacgaacacgtacgacgtaccgtaacgtccttaccgttacgttaccgtaccggttacggtaacggtaccggtactaaccggtccgtaacccgttccgtaacggtacccgacgtaacccgtaaccgacccgtaccccgtnttaccccgg

SEQ ID NO: 250155 - DNA, 715 bp, Homo sapiens
  misc_feature: GYAE6OF02GHT5E.12.67.G01.1.454.CMB.1.raw
  modified_base (224)..(224): a, c, t, g, unknown or other
  misc_feature (224)..(224): n is a, c, g, or t
  modified_base (305)..(305): a, c, t, g, unknown or other
  misc_feature (305)..(305): n is a, c, g, or t
tcagatacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctctgcacgtgaacagcagtcgagttggtgttataactagtcgtctcgtaggtaaccaanagccaacccgaggcaagaccgacccccaaaatcatagttattttgatgtacactaacgtaccggccttggtaggttcctanacgttcgtccttcgtcgtcggtacctaccgtaagttaccgtacgtaaccgtaaccgaccggtccccttacccgttacgaaccctaacgttccgttacggttccgggtacccgttaccggtaacgggtaccttaaggggacggtaaacgggtaacggtcgttaacggttaaatttagtttaacgtcgtacgtacgtactaccgtaataacgtaaactaagtacgagtacgtacgtacctaacccgtttgttacgttacgttacggtaaacggtcgggaacctacgggtaccgtaccgttaccgtacgaaccgtacgaaccgaaccgtaaccctaccgatacgtacctacgtcctacgtaccctaccctactacgtacgtacgtacgtacgtcgacggcgtcgtacgtacgg

SEQ ID NO: 250156 - DNA, 123 bp, Homo sapiens
  misc_feature: GYAE6OF01AQRZM.1.33.C11.1.454.CMB.1.raw
  modified_base (122)..(123): a, c, t, g, unknown or other
  misc_feature (122)..(123): n is a, c, g, or t
tcagacgagtgcgtcacgaccggtgctcgatttagagtgagctcgttgggcacagcggcctggctgcctggtcaaggactacttccacgcactcgtctgagcgggctggcaaggcgcatagnn

SEQ ID NO: 250157 - DNA, 195 bp, Homo sapiens
  misc_feature: GYAE6OF01A12I9.1.33.C11.1.454.CMB.1.raw
  modified_base (174)..(195): a, c, t, g, unknown or other
  misc_feature (174)..(195): n is a, c, g, or t
tcagacgagtgcgtcacgaccggtgctcgatttagagtgagctcgttgggtttgggggaagaggaagactgaccggtcccccaggagttcaggtgctgggcacagcggccctgggctgcctggtcaaggactacttccacgcactcgtctgagcgggctggcaaggcgcatagnnnnnnnnnnnnnnnnnnnnnn

SEQ ID NO: 250158 - DNA, 125 bp, Homo sapiens
  misc_feature: GYAE6OF01DD301.1.33.C11.1.454.CMB.1.raw
  modified_base (125)..(125): a, c, t, g, unknown or other
  misc_feature (125)..(125): n is a, c, g, or t
tcagacgagtgcgtcacgaccggtgctcgatttagagtgagctcgttggggcacagcggccctgggctgcctggtcaaggactacttccacgcactcgtctgagcgggctggcaaggcgcatagn

SEQ ID NO: 250159 - DNA, 125 bp, Homo sapiens
  misc_feature: GYAE6OF01BODMC.1.33.C11.1.454.CMB.1.raw
tcagacgagtgcgtcacgaccggtgctcgatttagagtgagctcgttgggggcacagcggccctgggctgcctggtcaaggactacttccacgcactcgtctgagcgggctggcaaggcgcatag

SEQ ID NO: 250160 - DNA, 125 bp, Homo sapiens; identical to SEQ ID NO: 250158
  misc_feature: GYAE6OF02F02XD.1.33.C11.1.454.CMB.1.raw
  modified_base (125)..(125): a, c, t, g, unknown or other
  misc_feature (125)..(125): n is a, c, g, or t

SEQ ID NO: 250161 - DNA, 131 bp, Homo sapiens
  misc_feature: GYAE6OF02IMTAP.1.33.C11.1.454.CMB.1.raw
  modified_base (126)..(131): a, c, t, g, unknown or other
  misc_feature (126)..(131): n is a, c, g, or t
tcagacgagtgcgtcacgaccggtgctcgatttagagtgagctcgttgggggcacagcggccctgggctgcctggtcaaggactacttccatgcactcgtctgagcgggctggcaaggcgcatagnnnnnn

SEQ ID NO: 250162 - DNA, 268 bp, Homo sapiens
  misc_feature: GYAE6OF02I5CGS.1.33.C11.1.454.CMB.1.raw
  modified_base (256)..(256): a, c, t, g, unknown or other
  misc_feature (256)..(256): n is a, c, g, or t
  modified_base (258)..(268): a, c, t, g, unknown or other
  misc_feature (258)..(268): n is a, c, g, or t
tcagacgagtgcgtcacgaccggtgctcgatttagagtgagctcgttgggtttgggacagagttcactctcaccatcagcagcctgcagtctgaagattttgcagtttattactgtcagcagtttaataactggccgtggacgttcggccaagggaccaaggtggaaatgaaacgaactgtggctgcaccatctgtcttcatcttcccaccctcctcacgctactcgtctgagcgggctggcaaggcgtcataggnannnnnnnnnnn

SEQ ID NO: 250163 - DNA, 173 bp, Homo sapiens
  misc_feature: GYAE6OF02FFN86.1.33.C11.1.454.CMB.1.raw
  modified_base (173)..(173): a, c, t, g, unknown or other
  misc_feature (173)..(173): n is a, c, g, or t
tcagacgagtgcgtcacgaccggtgctcgatttagagtgagctcggttgggtttgggggaagaggaagactgacggtcccccaggagttcaggtgctgggcacagcggccctgggctgcctggtcaaggactacttccacgcactcgtctgagcggctggcaaggcgcatagn

SEQ ID NO: 250164 - DNA, 128 bp, Homo sapiens
  misc_feature: GYAE6OF02F4VQW.1.33.C11.1.454.CMB.1.raw
  modified_base (126)..(128): a, c, t, g, unknown or other
  misc_feature (126)..(128): n is a, c, g, or t
tcagacgagtgcgtcacgaccggtgctcgatttagagtgagctcgttgggggcacagcggccctgggctgcctggtcaaggactacttccacgcactcgtctgagcgggctggcaaggcgcatagnnn

SEQ ID NO: 250165 - DNA, 124 bp, Homo sapiens
  misc_feature: GYAE6OF02FI28V.1.33.C11.1.454.CMB.1.raw
  modified_base (124)..(124): a, c, t, g, unknown or other
  misc_feature (124)..(124): n is a, c, g, or t
tcagacgagtgcgtcacgaccggtgctcgatttagagtgagctcgttgggggcacagcggccctgggctgcctggtcaggactattccacgcactcgtctgagcgggctggcaaggcgcatagn

SEQ ID NO: 250166 - DNA, 126 bp, Homo sapiens
  misc_feature: GYAE6OF02I3F5E.1.33.C11.1.454.CMB.1.raw
  modified_base (125)..(126): a, c, t, g, unknown or other
  misc_feature (125)..(126): n is a, c, g, or t
tcagacgagtgcgtcacgaccggtgctcgatttagagtgagctcgttggggcacagcggccctgggctgcctggtcaaggactacttccacgcactcgtctgagcgggctggcaaggcgcatagnn

SEQ ID NO: 250167 - DNA, 132 bp, Homo sapiens
  misc_feature: GYAE6OF02J26FM.1.33.C11.1.454.CMB.1.raw
  modified_base (125)..(132): a, c, t, g, unknown or other
  misc_feature (125)..(132): n is a, c, g, or t
tcagacgagtgcgtcacgaccggtgctcgatttagagtgagctcgttggggcacagcggccctgggctgcctggtcaaggactacttccacgcactcgtctgagcgggctggcaaggcgcatagnnnnnnnn

SEQ ID NO: 250168 - DNA, 526 bp, Homo sapiens
  misc_feature: GYAE6OF01D2T2G.16.37.D04.1.454.CMB.1.raw
  modified_base (388)..(388): a, c, t, g, unknown or other
  misc_feature (388)..(388): n is a, c, g, or t
  modified_base (521)..(521): a, c, t, g, unknown or other
  misc_feature (521)..(521): n is a, c, g, or t
tcagtgtactactccacgaccggtgctcgatttagtagcatactgtgggtttggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcacgtctcctcngcctccaccaaggcccatcgtcttcccctgccaccctcctccaagacgccacctcgtgggcacgagccggccctgggctgcctggtcaggctacttccgagtacgtacacgtgacgcggcgtggacaaggcgngatag

SEQ ID NO: 250169 - DNA, 561 bp, Homo sapiens
  misc_feature: GYAE6OF01CZW9Z.16.37.D04.1.454.CMB.1.raw
  modified_base (556)..(557): a, c, t, g, unknown or other
  misc_feature (556)..(557): n is a, c, g, or t
tcagtgtactactccacgaccggtgctcgatttagtagcatactgtgggtttggggagacttagtacagccgggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaacgggcccatcggtccttccccctggccacccctcctccaacgacgccaccctcgtcgggggccaccgacggcccggcccctggggcctcggcccgtgggtccgaaggtacctaccgttccgagtacgtacacgtgacgcgggctgggcaagggccgnngtag

SEQ ID NO: 250170 - DNA, 554 bp, Homo sapiens
  misc_feature: GYAE6OF01BSD0G.16.37.D04.1.454.CMB.1.raw
  modified_base (549)..(550): a, c, t, g, unknown or other
  misc_feature (549)..(550): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaaatgaacagtctgagagtcgaggacacggccatatattactgtgcgaagcgggaattggtgcggtgactgctattgactactggggccagggaaccctgggtcaccgtctcctcacgcctccaccaacgggcccagtcggtcttcccctcggccaccctcctccaacgacgccacccgtctcgggggcacgacgccggcccgtcgggcctcgccgtggtccgaacggactaccgttccgagtacgtacacgtgacgcgggctcggcaaggcgnngtag

SEQ ID NO: 250171 - DNA, 546 bp, Homo sapiens
  misc_feature: GYAE6OF01C238O.16.37.D04.1.454.CMB.1.raw
  modified_base (542)..(542): a, c, t, g, unknown or other
  misc_feature (542)..(542): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggccagggaaccctggtcaccgtctcctcagcctccaccaacgggcccatcggtcttcccctcggccaccctcctcccaacgacgccaccctcgtcgggggcacgacgccggccctgggcctgccgtggtcaacggtactacttccgagtacgtacacgtgagcgggcgtcggacaggcgcngtag

SEQ ID NO: 250172 - DNA, 562 bp, Homo sapiens
  misc_feature: GYAE6OF01EIYK0.16.37.D04.1.454.CMB.1.raw
tcagtgtactactccacgaccggtgctcgatttagtagcatactgtgggtttggggagacttagtacagccgggggtccctgagactctcctgtgcagcctctggattcacctttagtgcctatgccatgagctgggtccgccaggctccagggaagggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtgggccagggaaccctggtccaccgtctcctcacgcctccaccaacgggcccatccggtcttccccctggcccaccctccctaccaacgacgccacctccgtcggggcacgacgccggcccgtgggcctcgcccgtcggtccgaaggtaccttaaccgttccgagtacgtacacgtcgacggcgggctcgggacaaggcgcgagtag

SEQ ID NO: 250173 - DNA, 593 bp, Homo sapiens
  misc_feature: GYAE6OF01AXRF3.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccagggcccatcgtccttcccctcggccacccctcctccaacgacgccacccgtctcgggggccaccgacggccggccccgtcggggccttcggcccgttcgggtaccgaaacgggaccttaaccgttcccggaacggttacggtaccacgttcggaacggccgggaccgtcgggaccgaagggccgcgagtacgg

SEQ ID NO: 250174 - DNA, 570 bp, Homo sapiens
  misc_feature: GYAE6OF01CZ63Y.16.37.D04.1.454.CMB.1.raw
  modified_base (564)..(564): a, c, t, g, unknown or other
  misc_feature (564)..(564): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgacaaaatgaacagtctgagagtcgaggacacggccatatattactgtgcgaagcgggaattggtggcggtgactgctattgactacgtgggccagggaaccctggtcaccgtctcctcagcctccaccaacgggcccactcggtccttcccccgtcggccacccctcctaccaacgacgccaccctcgtcggggcacgacgccggcccgtgggcctcggcccgtggtaccaacggacctaccgttccgagttacgtaccacgtcggacggcgggcgtcgggacaagggcgngagtag

SEQ ID NO: 250175 - DNA, 585 bp, Homo sapiens
  misc_feature: GYAE6OF01BV89D.16.37.D04.1.454.CMB.1.raw
  modified_base (335)..(335): a, c, t, g, unknown or other
  misc_feature (335)..(335): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacgaccatatattactgtgcgaagcgggaattggnggcggtgactgctattgactacgtgggccagggaaccctggtcaccgtctcctcagcctccaccaaggcccatcgtccttcccctggccacccctcctcccaacgacgccaccctcgtcggggccacgacgccggcccgtgggccgttcgcccgttcggtaccgaaacgggtaccttaaccgttaccgtaaggtacgttaccaccgtcggacggccggggtaccgtcgggaccgaagggccgcagtacgg

SEQ ID NO: 250176 - DNA, 675 bp, Homo sapiens
  misc_feature: GYAE6OF01CWA92.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatctccagagacaattccaaagaacacgctgtatttgcaaaatgaacagtctagagagtcgaggacacggccatatattactgtgacgaaggcgggaattgggtggcggtgactgctattgactacgtggggccagggaaccctggtccaccgtctccctacgacgccctacccgaaccgaaccgggccccaacgttcccgggttccctttaccccccgtcgggtccctacccccgtccctacccgaaacgacgacccaacccgttccggtcggggggccaaccgacggcccgggccccgtcggggccgtcggcccgttcgggtaccgaaacgggtacccttaacccgtttacccggaacggttaacgtaaccgtaaccgttcgggaacgggccggggaccggttacgggaccgaaacgggccggacgaagtaacgg

SEQ ID NO: 250177 - DNA, 543 bp, Homo sapiens
  misc_feature: GYAE6OF01EBY0G.16.37.D04.1.454.CMB.1.raw
  modified_base (539)..(539): a, c, t, g, unknown or other
  misc_feature (539)..(539): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaaatgaacagtctgagagtcgaggacacggccatatattactgtgcgaagcgggaaattggtggcggtgactgctattgactactggggccagggaaccctggtcaccgtctcctcacgcctccaccaagggcccatcggtcttcccctggccaccctccctccaacgacgccacctcgtcgggggcacgacgcggcccgtgggcctgcctcggtcaaggactacttccgagtacgtacactgagcgggcgtggcgaaggcgcngtag

SEQ ID NO: 250178 - DNA, 521 bp, Homo sapiens
  misc_feature: GYAE6OF01DOV61.16.37.D04.1.454.CMB.1.raw
  modified_base (516)..(521): a, c, t, g, unknown or other
  misc_feature (516)..(521): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacggtgaatcttcaaatgaacagcctgagaaccgaggacacggccgtatattattgtataggttatggtggtaattcgggcccctggggccagggaaccgtggtcaccgtctcctcagcctccaccaagggcccatcggtcttcccctggcgccctgctccaggacgcacctccgagagcacagcggccctgggcctgcctggtcaaggactacgttccgagtagtacactgagcgggctggcaaggcgcatagnnnnnn

SEQ ID NO: 250179 - DNA, 545 bp, Homo sapiens
  misc_feature: GYAE6OF01B62DH.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtgcggtgactgctatgactacgtggggccagggaaccctggtcaccgtctcctcagcctccaccaacgggcccagtccggtccttcccccgtggccacccctcctccaacgacgccacctcgtggggcacgagccggcccgtcgggctcgccgtggtacaacggactactccgagtacgtacacgtgacgcgggctggcaaggcgcagtcg

SEQ ID NO: 250180 - DNA, 553 bp, Homo sapiens
  misc_feature: GYAE6OF01DU94X.16.37.D04.1.454.CMB.1.raw
  modified_base (546)..(546): a, c, t, g, unknown or other
  misc_feature (546)..(546): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtgggccagggaaccctggtcaccgtctcctcacgccctccaccgaacgggcccagtccggtccttcccccgtggtcccaccctccctccaacgacgccacctcgtcggggcacgacgccggcccgtgggctcgcctggtcaacggctacgttccgagtacgtacactcgagcgggctggcaaggcgngagtacg

SEQ ID NO: 250181 - DNA, 845 bp, Homo sapiens
  misc_feature: GYAE6OF01CS2M4.16.37.D04.1.454.CMB.1.raw
  modified_base (218)..(218): a, c, t, g, unknown or other
  misc_feature (218)..(218): n is a, c, g, or t
tcagtgtactactccacgaccggtgctcgatttagtagcatactgtgggtttggggagacttagtacagccggggggtccctgagactctcctgtgcagcctctggattcacctttagtgcctatgccatgagctggtcgtccgccaggctccgagggaagggctagaagtgggtctacgaagtatcaacaagcaagtagtacgaccgctagtggacncagacctcgtaggaacgggtccttaccacatcctaccagacgaactaacttcgaaagaacacgctagttattgaactaaagtacgaactagtctaggaaggtacggtcggaacggaaccaccggcctaattaattaactttacgtggtacggaaccggaaagggtaccggggtaaagtttggggtacgggtaccgggttacggtaaccgttggtacctttaaggttacggtaacccgtttaaccgggtccggggggaaccccgtaaacgggggttaacccccgttggggttacccctaaccccggtttcccgttaaccccgtaccgaaccggttacccccttaaccccggaaaccccgggtaaacccgggggtacccccccttaaccccggggttttccccctttccccccgggtacgggaacccccttaacccccgtttaccccgtaaccgaaacggtaccgccccgtaacccgttccggggtaccggggacccaaccgtaccggggccccgtccccggtgggtcctacgtcccggtacggtaccgaaacggttaccctaccgttaccggacgttaccgtaccgacggtcggacggccgggacgtggacaacgggcacgtagtacg

SEQ ID NO: 250182 - DNA, 572 bp, Homo sapiens
  misc_feature: GYAE6OF01B6CAW.16.37.D04.1.454.CMB.1.raw
  modified_base (337)..(337): a, c, t, g, unknown or other
  misc_feature (337)..(337): n is a, c, g, or t
tcagtgtactactccacgaccggtgctcgatttagtagcatactgtgggtttgggggagacctgataccgcctgggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtgccgnggccggtactcggatggttttgattttcgtgggaccaaggggacaaatggtcaccgtctcttcacgctccacacgggcccatccggtccttcccctggccacccgtcctcccaagacgcaacccgtcgtcgggggccaccgagccggcccctcggggcctcggcccttggtccaacgggaccttacgttcccggtagtaacgtacaccgttgacggcgggcgtggcaaggcgacg

SEQ ID NO: 250183 - DNA, 536 bp, Homo sapiens
  misc_feature: GYAE6OF01EBR8X.16.37.D04.1.454.CMB.1.raw
  modified_base (531)..(532): a, c, t, g, unknown or other
  misc_feature (531)..(532): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaacggcccatcggtcttcccctggccaccctcctccacgacgccacctcgtcggggcacgacgcggcccgtgggctcgcctggtcaaggactacgttccgagtacgtacactgacgcgggctcggcaggcgnngtag

SEQ ID NO: 250184 - DNA, 583 bp, Homo sapiens
  misc_feature: GYAE6OF01AHY5K.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctggtccaccgtctcctcacgcctccaccgaacgggcccactccggtccttcccccgtcggcccacccctccctacccaacgacgccaccctcgtcgggggcaccgacggccggcccgtgggcctcggcccgtggtccgaaggaccttaccgttaccgagtacgtaccgacgttcggacggcgggcgtcgggacaagggcgcgagtacg

SEQ ID NO: 250185 - DNA, 553 bp, Homo sapiens
  misc_feature: GYAE6OF01DZEA5.16.37.D04.1.454.CMB.1.raw
  modified_base (336)..(336): a, c, t, g, unknown or other
  misc_feature (336)..(336): n is a, c, g, or t
  modified_base (547)..(548): a, c, t, g, unknown or other
  misc_feature (547)..(548): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggnggcggtgactgctattgactactgggccagggaaccctggtcaccgtctcctcacgcctccaccgaacgggccccagtccggtccttcccccgtcggccacccctcctcccaacgacgccaccctcgtcggggcacgacgcggcccgtggctcgcctggtcaaggacctacgtcgacgtacgtacactgacggcggcgtcggcgaaggcgnngtacg

SEQ ID NO: 250186 - DNA, 572 bp, Homo sapiens
  misc_feature: GYAE6OF01DXNFU.16.37.D04.1.454.CMB.1.raw
  modified_base (336)..(336): a, c, t, g, unknown or other
  misc_feature (336)..(336): n is a, c, g, or t
  modified_base (565)..(565): a, c, t, g, unknown or other
  misc_feature (565)..(565): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggnggcggtgactgctattgactacgtgggccagggaaccctggtcaccgtctcctcacgcctccaccgaacggcccagtccggtccttccccgtggcccaccctcctccaagcgccaccgtcgtcggggcacgacggccggcccgtgggcctcggccgtggtacgaacggtacctaccgttccggagttacgtacacgtcggacggccgggtcgtcgggacgaagggccgngagtacg

SEQ ID NO: 250187 - DNA, 556 bp, Homo sapiens
  misc_feature: GYAE6OF01AC5VZ.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctggaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtgggccagggaaccctggtcaccgtctcctcacgcctccaccaacgggcccagtccggtccttcccccgtggcccacccctccctcccaagacgccaccctcgtcgggggcacgacggccggcccgtggggcctggccctggtcaacggactacctccgagtacgtacacgtcgagcgggctcggcaggcgcgagtag

SEQ ID NO: 250188 - DNA, 542 bp, Homo sapiens
  misc_feature: GYAE6OF01BZM4W.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatctgcaaatgaacggcctgagagccgaggacacggccgtatattactgtgcccgagggaggttttactatgatattactggttacaaaaagggtactactttgactactggggccagggaaccctggtcaccgtctcctcagcctccaccagggcccatcgtcttcccctggccgccctgctccaggacgcacctccgagaacacagcggccctgggctgcctggtcaaggctacgttccgagtagtcactgacgcgggctggcaaggcgacg

SEQ ID NO: 250189 - DNA, 572 bp, Homo sapiens
  misc_feature: GYAE6OF01DA6MS.16.37.D04.1.454.CMB.1.raw
  modified_base (564)..(564): a, c, t, g, unknown or other
  misc_feature (564)..(564): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatatactgtgcgaagcgggaatggtggcggtgactgctattgactagtgggccagggaaccctggtccaccgtctcctcacgcctccaccaacgggcccagtccggtccttcccccgtcggccacccctcctaccaacgacgccacctcgtggggcacgagccggccctgggcctcgccgtcggtacaacggtactaccgttccgagttacgtaccacgttcggaacggcgggccgttacgggactaagggccgngtagtagg

SEQ ID NO: 250190 - DNA, 585 bp, Homo sapiens
  misc_feature: GYAE6OF01ASBO4.16.37.D04.1.454.CMB.1.raw
  modified_base (443)..(443): a, c, t, g, unknown or other
  misc_feature (443)..(443): n is a, c, g, or t
  modified_base (579)..(579): a, c, t, g, unknown or other
  misc_feature (579)..(579): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgttcaccatctccagagacaattccaagaacacgctgtatttgacaaatgaacagtctgagagtcgaggacacggccatatattactgtgcgaagcgggtaattggtggcggtgacgtgctagttgactacgtcggggccagggaaccctggtaccaccggtcctcctcgacgccctaccaccgacgggcccacgttcccggtccttcccccgngcccacccctcctacccgaacgacgcctacccgtcggtcggggccacgacggccgcccgtgggcctcggccgtggaccgaacggtaccttacgttccggagttacgtacacgtgacggcggcgtggacgaaggcgngagtag

SEQ ID NO: 250191 - DNA, 544 bp, Homo sapiens
  misc_feature: GYAE6OF01DL00Q.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgacgaaagataagagtttgggacccgatgcttatgatagcgtggggccaagggacaagtggtcaccgtctcttcagcctccaccacggcccagtcgtccttccccctcggccaccctcctccaacgacgccacctcgtcgggggccacgacgccggcccgtgggctcgcctggtacaacggactacgttccgagtacgtacactgacgcgggctggcaggcgacg

SEQ ID NO: 250192 - DNA, 556 bp, Homo sapiens
  misc_feature: GYAE6OF01BJ8OO.16.37.D04.1.454.CMB.1.raw
  modified_base (551)..(551): a, c, t, g, unknown or other
  misc_feature (551)..(551): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgacgaagcgggaattggtggcggtgactgctattgactactgggccagggaaccctggtcaccgtctcctcacgcctccaccaacgggcccactcggtccttcccctggccaccctcctccaacgacgccaccgtcgtcggggcacgacgccggcccgtgggcctggcccgtcggtacgaacggactacgtccgacgtacgtacacgtgagcgggctcgggacaagggcgcgngtacg

SEQ ID NO: 250193 - DNA, 573 bp, Homo sapiens
  misc_feature: GYAE6OF01CFXDA.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgaggccagggaccctggtccaccgtctcctcacgcctccaccaacggcccatccgtccttcccctggccaccctcctccaacgcgccacctcgtggggccacgacggccggcccgtgggctcggtcccgtggtccgaacggaccttacgttcccggacggttacgtaccgtacgtcggaagccgggcgttacgggacaaagggtccgcgtaacg

SEQ ID NO: 250194 - DNA, 591 bp, Homo sapiens
  misc_feature: GYAE6OF01AXEG1.16.37.D04.1.454.CMB.1.raw
  modified_base (335)..(335): a, c, t, g, unknown or other
  misc_feature (335)..(335): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggnggcggtgactgctattgactcgtggggccagggaaccctggtccaccgttctcctcacgcctaccaccgaacgggccccagttccggtccttccccctggcccacccctccgtcccaacgacgcccaccgttcggtcggggccaccgacggcccgcccgttgggcctcgcccgtggtaccgaacgggtaccttaccgttccggacgtacgtaccacgtgacggccgggcgtacgggacgaagggccgcgaagtacg

SEQ ID NO: 250195 - DNA, 554 bp, Homo sapiens
  misc_feature: GYAE6OF01BP554.16.37.D04.1.454.CMB.1.raw
tcagtgtactactccacgaccggtgctcgatttagtagcatactgtgggtttggggagacttagtacagccgggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcacgcctccaccaagggcccatcggtctcccctggcacccgtcctccaacgacgccacctcgtcggggcacgaacgccggcccgtgggcctgcccgtggccaaggactacgttcccgagttacgtacacgttcgaggtccgggacgtgggacaagggccgcgagtacg

SEQ ID NO: 250196 - DNA, 574 bp, Homo sapiens
  misc_feature: GYAE6OF01DHS8Z.16.37.D04.1.454.CMB.1.raw
  modified_base (569)..(570): a, c, t, g, unknown or other
  misc_feature (569)..(570): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagacacgctgtatttgcaaatgaacagtctgagagtcgaggacacggccatatattactgtgcgaagcgggaatggtggcggtgactgctattgactacgtggggccagggaaccctgggtcaccgtctcctcacgcctccaccgaacgggcccacgtccggttcctccccctcggcccaccctccctcccaacgacgccacccgtcgtcgggggcaccgacgccggccccgtcgggccgtcgccgtcggtaccgaacggacctaccgttaccgagtaacgtacacgtcgacgcgggcgtcggacgaaggcgnngtag

SEQ ID NO: 250197 - DNA, 572 bp, Homo sapiens
  misc_feature: GYAE6OF01EIZTT.16.37.D04.1.454.CMB.1.raw
  modified_base (335)..(335): a, c, t, g, unknown or other
  misc_feature (335)..(335): n is a, c, g, or t
tcagtgtactactccacgaccggtgctcgatttagtagcatactgtgggtttgggggagacttagtacagccggggggtccctgagactctcctgtgcagcctctggattcatcttcagcggtttcgctatgcactgggtccgccaggctccaggaaagggactggaatatgtttcagctattagttataatgggggtaacacatactacgcagactcagtgaagggcagattcaccatctccagagacaattcccagaacacgctggatcttcaaatgagcagtctgagagctgaggacacggctgtgtattactgtgtagaaagtatttccgnggctactacgactactactacggtatggacgtcgtggggaccaagggacccacggtcaccgtctcctcacgcctccaccaacggcccagtccgtccttcccccgtcggccaccctcctccaacgcgccacctcgtcggggcacgacgccggcccgtcgggctcggccgtcggtacaacgggaccttacgttcccggtagtacgtaacacgtcggacggacgggcgtgggcgaacggg

SEQ ID NO: 250198 - DNA, 525 bp, Homo sapiens
  misc_feature: GYAE6OF01EJSVB.16.37.D04.1.454.CMB.1.raw
  modified_base (520)..(520): a, c, t, g, unknown or other
  misc_feature (520)..(520): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcgtctcccctggccaccctcctccagacgcacctctggggcacgagcggccctgggctgcctggtcaggactactccgagtgtacacgtgagcgggctcggcaaggcgcngtacg

SEQ ID NO: 250199 - DNA, 525 bp, Homo sapiens
  misc_feature: GYAE6OF01AGX4P.16.37.D04.1.454.CMB.1.raw
  modified_base (425)..(425): a, c, t, g, unknown or other
  misc_feature (425)..(425): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccagggcccatcggtcttcccctggccnccctcctccaagagcacctctcggggcacagcggccctgggctgcctggtcaggactacttccgagtacgtacactgacgcgggctggcaggccngntag

SEQ ID NO: 250200 - DNA, 536 bp, Homo sapiens
  misc_feature: GYAE6OF01CTS53.16.37.D04.1.454.CMB.1.raw
  modified_base (532)..(532): a, c, t, g, unknown or other
  misc_feature (532)..(532): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaacgggcccatcggtcttccccctggccaccctcctccaagacgcacctctgggggcacgacgcggccctgggctcgcctggtcaaggactacgttccgagtacgtacactgacgcgggctcggcaggcgcntacg

SEQ ID NO: 250201 - DNA, 547 bp, Homo sapiens
  misc_feature: GYAE6OF01A3QGL.16.37.D04.1.454.CMB.1.raw
  modified_base (429)..(429): a, c, t, g, unknown or other
  misc_feature (429)..(429): n is a, c, g, or t
  modified_base (541)..(541): a, c, t, g, unknown or other
  misc_feature (541)..(541): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctggtccaccgtctcctcagcctccaccaacgggccccacgtccggtccttccccnggcccaccctcctccaagcgccacctcgtggggcacgacgccggccctgggctcgcctggtcaacggactaccgttccgagtacgtacactggacgcgggctgggcaaggcngagtag

SEQ ID NO: 250202 - DNA, 530 bp, Homo sapiens
  misc_feature: GYAE6OF01EKIMR.16.37.D04.1.454.CMB.1.raw
  modified_base (526)..(526): a, c, t, g, unknown or other
  misc_feature (526)..(526): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctatgactactggggccagggaaccctggtcaccgtctcctcagcctccaccaagggcccactcggtcttcccctcgccaccctcctccaagacgcacctcgtggggcacgagccggccctgggctcgcctggtcaggactactccgagtacgtacactgagcgggctggcaaggcgcgngtag

SEQ ID NO: 250203 - DNA, 566 bp, Homo sapiens
  misc_feature: GYAE6OF01B5VID.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcctttcaccatcctccagagacaattccaagaacacgctgtatttgcaaatgaacagtctgagagtcgaggacacggccatactattactgtgcgaagcgggaattggtggcggtgactgctattgactacgtggggccagggaaccctggtcaccgtctcctcagcctccaccaaggcccatcggtccttccccgtggccaccctccctccgaacgcgccacctcgtcggggcaccgacgccggcccgtgggctcgccgtggtaccaaggtaccttaccgttccgaacggttacgtaccacgtggacggcgggcgtcgggcaaagggcgcgagtacgg

SEQ ID NO: 250204 - DNA, 546 bp, Homo sapiens
  misc_feature: GYAE6OF01BEA5A.16.37.D04.1.454.CMB.1.raw
  modified_base (542)..(542): a, c, t, g, unknown or other
  misc_feature (542)..(542): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccagggcccatcggtcttccccctggccacccctcctcccaagacgccaccctccgtcgggggccacgacgccggcccctggggcctggccctggtccaaggactacttccgagtacgtacactgagcgggctgggcaaggcgnatag

SEQ ID NO: 250205 - DNA, 609 bp, Homo sapiens
  misc_feature: GYAE6OF01C1KOK.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctggtccaccggtctcctcagccctccaccgaacgggccccagtccggtccttcccccgtggcccacccctcctacccaagacgccacccgtcgtcgggggccacgacgccgggcccgtcggggcctcggcccgttcgggtccgaaacgggtacctaccgttcccggaacggttacgtaccgacgtcggacgggccggggccgttacgggaccgtaaggggccgtcgacgtacgg

SEQ ID NO: 250206 - DNA, 556 bp, Homo sapiens
  misc_feature: GYAE6OF01EWHL2.16.37.D04.1.454.CMB.1.raw
  modified_base (337)..(337): a, c, t, g, unknown or other
  misc_feature (337)..(337): n is a, c, g, or t
  modified_base (444)..(444): a, c, t, g, unknown or other
  misc_feature (444)..(444): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaaatgaacagtctgagagtcgagtacacggccatatattactgtgcgaagcgggaattggnggcggtgactgctattgactacgtggggccaggggaaccctggtccaccggtctcctcagcctccaccaaggcccatcggtcttcccctggccacccctcacacgcncctcctcgggcgacacgacggcccgtcggcgtcgcgtcgtcgtaacgaacgtaccttaccgtacgtacgtactacgacgtaggcggcggcggtcgacggaggcgacgtgacg

SEQ ID NO: 250207 - DNA, 594 bp, Homo sapiens
  misc_feature: GYAE6OF01DLGYD.16.37.D04.1.454.CMB.1.raw
  modified_base (337)..(337): a, c, t, g, unknown or other
  misc_feature (337)..(337): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggcatatattactgtgcgaagcgggaattggnggcggtgactgcttattgactacgtggggccagggaaccctggtccaccgtctcctcacgcctccaccaacgggcccacgtccggtccttcccctcggcccacccctcctcccaacgacgccacctcgtcggggcacgcggccggcccgtcgggtccgtcgcccgttcggtaccgaacgggtacctaccgttccggtacggttaacggtaccacgtcggacgggccgggtcgtcgggacgaagggccgcgtagtacg

SEQ ID NO: 250208 - DNA, 714 bp, Homo sapiens
  misc_feature: GYAE6OF01DWRF9.16.37.D04.1.454.CMB.1.raw
  modified_base (205)..(205): a, c, t, g, unknown or other
  misc_feature (205)..(205): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcaacaagcagtagtagtaccgnatggtacgcagactccgtgaacgggtccgtttcaccatctccagagacaattccaagaacacgctgtatttgacaaatgaacagtctagagagtcggaggacacggccaatatattactgtgacgaagcgggaattggaggcgtgactgactagttagactacgtggggaccaacggggtaaccctgggtaccaccgtctccctcgacgtccctacccgaaccgaacgggtccctaacgtcccggttcccttcccccgtcggacctacccccgtcctacccgaaagtccgacctaacccgtcgggtacgggggaccaaccgaacggcccgggtccccggttacgggcccgttccgggacccgttacggggtaacccgaaaacggggtaacccttacccggtttaacccggaaacggtttaaccggttaaccaaccggttcgggaaccggggtcccgggggtaccgttaccggggaaccgaaaaccgggggtccgaaccgtaaggtacgg

SEQ ID NO: 250209 - DNA, 560 bp, Homo sapiens
  misc_feature: GYAE6OF01DUELS.16.37.D04.1.454.CMB.1.raw
  modified_base (336)..(336): a, c, t, g, unknown or other
  misc_feature (336)..(336): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggnggcggtgactgctattgactacgtgggccagggaaccctggtcaccgtctcctcagcctccaccaacgggcccatcgtccttcccctgccaccctcctccaacgacgccacctcgtcggggcacgacgccggcccgtgggcctcggccgtcggtaccgaacggacctaccgttcccggagtacgtacacgtgacggcgggctcgggacgaaggccgcgatacgg

SEQ ID NO: 250210 - DNA, 569 bp, Homo sapiens
  misc_feature: GYAE6OF01CBUZB.16.37.D04.1.454.CMB.1.raw
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggaattggtgcggtgactgctagtgactacgtgggccagggaaccctggtcacgtcncctnacgcctcaccacggcccagtccgtccttcccctcggccacccctcctccaacgcgaccaccctcgtcggggccacgacggccggccccgtcgggccgtcgccgtggtaccaacggtaccttaccgttccgagttacgtacgacgtcggacggccgggacgtcggacgaagggcgcgagtacgg

SEQ ID NO: 250211 - DNA, 579 bp, Homo sapiens
  misc_feature: GYAE6OF01EDC9Y.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgcaaatgaacagtctgagagtcgaggacacggccatatattactgtgcgaagcgggaattggtggcggtgactgctattgactacgtgggccagggaaccctggtcaccgtctcctcacgcctccaccgaacggcccacgtccggtccttccccgtcggccaccctccctaccaacgacgcacccgtcgtcggggcacgacgccggcccgtcgggcctcgcccgtcggtacgaacggtacttaccgtaccggtacgtacgtaccacgtcggacggccgggcgtcgggacgaagggcgcgagtacg

SEQ ID NO: 250212 - DNA, 573 bp, Homo sapiens
  misc_feature: GYAE6OF01C9MQY.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaatccaagaacacgctgtatttgcaaatgaacagtctgagagtcgaggacacggccatatattactgtgcgaagcgggaattggtggcggtgactgctattgactacgtggggccagggaaccctgggtccaccgtctcctcacgcctcccaccgaacgggcccagtccggtccttcccccgtggcccacccctcctaccaacgcgccaccctcgtcggggcacacggcccggccctgggctcgcctcggtacgaacggtacctaccgttccgaggtacgtacacgtggacggccgggcgtcgggacaagggccgcgagtacg

SEQ ID NO: 250213 - DNA, 534 bp, Homo sapiens
  misc_feature: GYAE6OF01EBQVA.16.37.D04.1.454.CMB.1.raw
  modified_base (529)..(530): a, c, t, g, unknown or other
  misc_feature (529)..(530): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaacgggcccatcggtcttccccctggccaccctcctccaagacgccacctcgtggggcacgagcggcccgtgggctgcctggtcaaggactactccgagtacgtacacgtgagcgggctggacaaggcgnngtag

SEQ ID NO: 250214 - DNA, 598 bp, Homo sapiens
  misc_feature: GYAE6OF01A5VKX.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgagcgggaattggtggcggtgactgctattgactacgtgggccagggaaccctggtcaccgtctcctcagcctccaccacgggcccagtccggtccttcccccgtcggccacccctccctcccaacgacgccaccgtccgtcgggggccaccgacggccggcccgtcgggcctcggcccgttcgggtccgaacgggaccttaccgttcccggtacggttacgtaccaccgttggacggtcggggccgttcggggaccgaacgggccggtcgagtacgg

SEQ ID NO: 250215 - DNA, 596 bp, Homo sapiens
  misc_feature: GYAE6OF01BMV5D.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtgactgctattgactacgtggggccagggaaccctggtcaccgtctcctcacgcctccaccaacgggcccactccggtccttccccctggcccacccctccctcccaagacgccaccctcgtcggggccacgacggccggcccgtgggcctcggcccttgggtaccgaaagggtaccttaccgttcccggaagttacggtaaccacgtcggacggtccggggaccgttcgggacgaacggggccgcgtagtacg

SEQ ID NO: 250216 - DNA, 600 bp, Homo sapiens
  misc_feature: GYAE6OF01DMS21.16.37.D04.1.454.CMB.1.raw
  modified_base (389)..(389): a, c, t, g, unknown or other
  misc_feature (389)..(389): n is a, c, g, or t
  modified_base (592)..(592): a, c, t, g, unknown or other
  misc_feature (592)..(592): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagacacgctgtatttgcaaatgaacagtctgagagtcgaggacacgacatatatactgtgcgaagcgggaattggtggcggtgactgctattgactacgtggggccagggaccctgggtcaccgtctcctcncgcctccaccgaacgggcccacgtccggttccttcccccgtcggccctacccctccctacccgaacgacgcctacccgtcgtacgggggccaacgacggccgggcccgtgggccgtcgcccgtgggtaccgaacggtaccttaccgttccggacggttacgtaactacgtggaacgggccggggcgtcgggacgaagggccgngagtacgg

SEQ ID NO: 250217 - DNA, 619 bp, Homo sapiens
  misc_feature: GYAE6OF01CINZR.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaaacagtctgagagtcgaggacacggccatatattactgtgcgaagcgggaattggtggcgtgactgctattgactacgtggggccagggaaccctggtccaccggtctcctcacgcctccaccaacgggcccacgtccggtccttcccccgtcggcccacccctccctcccgaacgacgccaccctccgtcgggggccacgacggcccggcccgtcgggcctcgccgtcgggtaccgtaaacgggaccttaccgttacccgaacggttaacgtaaccgtaccgttcgggaacggtccgggggtccgtacgggaccggaaagggcccggcgaagtaacgg

SEQ ID NO: 250218 - DNA, 578 bp, Homo sapiens
  misc_feature: GYAE6OF01BDTV1.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgagacacggccatatattactgtgcgaagcgggaattgggtggcggtgacgtgctagttgactacgtggggccagggaaccctgggtccaccgtctcctcacgcctccaccaacggcccacgtcggtccttccccgtcggccaccctcctccaacgcgcacctcgtcggggcaccgacggccggcccgtcgggtctcggccgtcggtaccgaaggaccttacgttaccggacgtacgtacacgttggacggcggggccgtcgggacgaagggcgcgagtacgg

SEQ ID NO: 250219 - DNA, 603 bp, Homo sapiens
  misc_feature: GYAE6OF01EZU17.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacactctgtatttgcaaaatgaacagtctgagagtcgaggacacggccatatattactgtgcgaagcgggaattggtggcggtgactgctattgactacgtggggccagggaccctggtccaccgtctcctcacgcctccaccgaacgggccccacgtccggttcccttcccccgtcggcccacccctccctaccaacgacgcccaccgtccggtcgggggccaccgacggcccggccccgtcggggtcctcggcccgtgggtaccgaacgggtaccttaccgttcccggtaggttacgtaccacgtcggacgggcgggcgtacgggacgaagggcgcgagtag

SEQ ID NO: 250220 - DNA, 834 bp, Homo sapiens
  misc_feature: GYAE6OF01DJQUI.16.37.D04.1.454.CMB.1.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
tcagtgtactactccacgaccggtgctcgatttagtagcatactgtgggtttgggggagacttagtaccagccggggggtccctgacgactcttcctgtgcagcctctggattcacctttagtgcctatgccatggagtcgtgggtccgccaggtcgttccgaggggagggctagaattgggtactcaagtatcacaagcagtagtagtaccgcagtgggtacncagacctccggtggaacggtccttcacctntctccagacacaagttccaagactacgctagtattgacaaatgaacgtagtcctaggagtacgtcggagggacgcggactagttagttacgttactggtaacggacgaaggacgggtaagttgggtaggtacggtagacgttgtacgttagtcggaacgttacggtacggggaccctaacggggtaaccccttgggtacccaccggttcctacccgtacgtaacccggtaccctaacccgacccgggtaacggggtcccctaacggttccccggttacccgttacccccgtacgggtaccccctaccccgttacccgtaacccgaaacgtacccgtacccgtaccccgttccgggtaccggggtacctaaacccggacgggtacccccgggtaccccggttacggggtccgttacgggttaccccggttacgggtacccggtaaaaccggggttacccgtttaaacccgggttacccgggtaacggttaaccgttaaccggtaccgggttacggaaccggggtccggggttaccgttacgggggaacccggtaacggggtaccgtacggtaacgtacggg

SEQ ID NO: 250221 - DNA, 614 bp, Homo sapiens
  misc_feature: GYAE6OF01C7ZA8.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcccgtttcaccatctccagagacaattccaagacacgctgtatttgcaaatgaacagtctgagagtcgaggacacggccatatattactgtgcgaagcgggaattggtggcgtgactgctattgactacgtggggccagggaaccctgggtccaccgtcctcctcacgccctcccaccgaacgggccccacgttcccggttccttccccccgtcgggccctacccctccctcccaacgacgcctaccctcgtcgggggccaccgacggccgggcccgtggggcctcggcccgttgggtaccgaacggtaccctaccgttcccggaaggttaccggtaccgtaccgtggacggccggggcgttacgggacgaagggccgcgagtacg

SEQ ID NO: 250222 - DNA, 574 bp, Homo sapiens
  misc_feature: GYAE6OF01CCEYP.16.37.D04.1.454.CMB.1.raw
  modified_base (567)..(567): a, c, t, g, unknown or other
  misc_feature (567)..(567): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggcagggaaccctggtcaccgtctcctcacgccctccaccaacgggcccagtccggtccttccccctggccacccctcctcccaacgacgccaacccgtcgtcggggcacgacgccggcccgtgggcctcgcccgtggtaccgaaacggtacctaccgttcccgaagtcgtaacacgtggacggccgggctcgggacgaaggccggnagtacgg

SEQ ID NO: 250223 - DNA, 565 bp, Homo sapiens
  misc_feature: GYAE6OF01ATNIM.16.37.D04.1.454.CMB.1.raw
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatctccagagacaattccaagacacgctgtatttgcaaatgaacagtctgagagtcgaggacacggccatatattactgtgcgaagcgggaattggtggcggtgactgctattgactacgtggggccagggaaccctggtcaccgtctcctcacgccctccaccacgggcccagtccgtccttccccctggccnccctcctccaacgcgaccnccctcgtcggggcacgacggccggcccgtgggcctcggcctcgggtacaacggtacctaccgttccggacgtcgtacacgtcggacggcgggcgtggcgaaggccgngntagg

SEQ ID NO: 250224 - DNA, 611 bp, Homo sapiens
  misc_feature: GYAE6OF01B5J8T.16.37.D04.1.454.CMB.1.raw
  modified_base (204)..(204): a, c, t, g, unknown or other
  misc_feature (204)..(204): n is a, c, g, or t
tcagtgtactactccacgaccggtgctcgatttagtagcatactgtgggtttgggggagacttggtacagccgggggggtccctgagactctcctgtgcagcctctggattcacctttagtgcctatgccatgagctgggtccgccaggctccagggaaggggctagaatgggtctcaagtatcacaagcagtagtagtaccgnatggtacgcagactccgtgaagggccgtttcaccatctccagagacaattccaagaacacgctgtatttgcaaatgaacagtctgagagtcggaggacacggccatatattactgtgcgaagcaggtaattggtggcggtgactgctattgactacgtgggccagggaccctggtcaccgtctcctcacgcctccaccgaacggcccactccggtcccttccccgtgcccacccctcccgtaccaacgacgccctaccgtccggtcgggccaaccgacggccgggtccccgtcggggcttccggccgttcggaccgtaacggtacccttaccggttacccgtagttaacggtaccgtaccgtcggacgggccgggtcggtacgggacgaacgggccgaacgtaacgg

SEQ ID NO: 250225 - DNA, 715 bp, Homo sapiens
  misc_feature: GYAE6OF01CADNS.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgcatggtacgcagactccgtgaagggtcctttcaccatctcagagacaatccaagaacacgctgtatttgacaaatgaacagtctagagagtcggagacgacggccaatatattactgtgacgaaggcgggtaattgggaggcggtagactggcttaattcgacttacggtggggacctaacgggaaccctggtccaaccggttcctcccgtacacgtcccgtacccaacccggaaccgggcccacgttacccggttccctttcccccgtcggccctacccctccccgtaccgaaaccgtaccgacccgtaacccgttcgggtaccgggggcctaaccggaccgggtccccgggtaccccgggtcggggtcccgtccggtacccggttacgggtaaccggtaaacgggttaacccttaacccggttacccggtaaggttaaccgtaacccgacggttcgggaccgggtccggggaccgttcggggaaccgaagggaccgtacggaacgtacg

SEQ ID NO: 250226 - DNA, 610 bp, Homo sapiens
  misc_feature: GYAE6OF01AC2DF.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctggtccaccgtctcctcacgcctccaccaacgggcccacgtccggtccttcccccgtcggccacccctccctccaacgacgccacccgtcgtcggggcacgacggcccggcccgtcgggccgtcggccgtcgggtaccgtaacgggtaccttaccgttacccggtaacggttacgtaaccgtacgtcgggaaccgggccggggtaccgtcgggaccgaacgggccgcgaagtacgg

SEQ ID NO: 250227 - DNA, 609 bp, Homo sapiens
  misc_feature: GYAE6OF01CS2CD.16.37.D04.1.454.CMB.1.raw
  modified_base (340)..(340): a, c, t, g, unknown or other
  misc_feature (340)..(340): n is a, c, g, or t
tcagtgtactactccacgaccggtgctcgatttagtagcatactgtgggtttgggggagacttagtacaggccgggggggtccctgagactctcctgtgcagcctctggattcaccttttagtgcctatgccatgagctgggtacgccaggctccaggggaaggggctagaatgggtctcaagtatcacaagcagtagtagtaccgcatggtacgcagactccggtgaagggccgtttcaccatctccagagacaattccaagaacacgctgtatttgacaaatgaacagtctgagagtcgaggacacggcatatatactgtgcgaagcgggaattgggnggcggtgactgctaattgactacgtgggccagggaaccctggtccaccgtctcctcacgcctaccaccgaacgggccctagtccggttccttcccccgtcggacccaccccgtccctaccgaaacgacgccacccgtcggtccgggggcaaccgacggccggaccccgtcgggccgtcgtcccgtacggtaccgaacggtaccgtaaccgttccggaaggtacgtaacacgtcggaaggccgggcgtcgggacgaagggcgcgtagtag

SEQ ID NO: 250228 - DNA, 666 bp, Homo sapiens
  misc_feature: GYAE6OF01BTYC4.16.37.D04.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (546)..(546): a, c, t, g, unknown or other
  misc_feature (546)..(546): n is a, c, g, or t
  modified_base (645)..(645): a, c, t, g, unknown or other
  misc_feature (645)..(645): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
tcagtgtactactccacgaccggtgctcgatttagtagcatactgtgggtttgggggagacttagtacagccggggggtccctgagactctcctgtgcagcctctggacttcctaccttttagtcgcctatcgccatgagcgtgggtccgccaggctccgaggggaagggctaggaatgggtctcagttattgaaaatgagtggtgacacaatcgtacgccgactccgagaacggccgattcacatcncaganacaattccaaagaacaggtataacttcttacaaatagaacagccagacggaaccgaggaccgacgggtacctaattattaagttagtaagttaggtttaagtggtaggtaacgttccggggccccgtaggggaccaacggggtaaccgtggttaccgaccgtctccgtcacgtccctcccgaacggaacggccctacgtcccggttacccttcccccgnggcccncccgtacgcctaccgacggacacctacccgaccgaacgacgcccacgaccggccggtcccgtaggccncgtccgtacgtaccgaacggtacctaccgtttaccggaagttaacgtacgacgtcgacgggccggcgtacgggtaccgaaggggcccgaagtaccggancgacgacgactgancngngcg

SEQ ID NO: 250229 - DNA, 566 bp, Homo sapiens
  misc_feature: GYAE6OF01E5CPK.16.37.D04.1.454.CMB.1.raw
  modified_base (562)..(562): a, c, t, g, unknown or other
  misc_feature (562)..(562): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtgactgctattgactactggggccagggaccctggtccaccgtctccctcacgcctcccaccaacgggcccatccggtccttcccccgtggcccacccctcctcccaagacgccaccctcgcggggcacgacgccggcccgtgggcctcggccctggtaccaacggtactaccgttccgaggtacgtacacgtggacgcgggcgtcgggcgaaggcgcgngtag

SEQ ID NO: 250230 - DNA, 570 bp, Homo sapiens
  misc_feature: GYAE6OF01AJ6LT.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtccaccgtctcctcacgcctccaccagggccccatccggtccttcccccgtgccaccctcctccaacgacgccacctcgtggggccacgacggccggcccgtgggcctcgccgtcgggtccaacggtcctaaccgttcccggagttacgtaccactcgacggccgggcgtcgggacaagggccgcgagtacgg

SEQ ID NO: 250231 - DNA, 615 bp, Homo sapiens
  misc_feature: GYAE6OF01CICRC.16.37.D04.1.454.CMB.1.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccgagggaagggctagaatgggtctcaagtatcacaagcagtagtagtaccgnatggtacgcagactccgtgaagggccgtttcaccatctccagagacaattccaagaacacgctgtatttgcaaatgaacagtctgagagtcgaggacacggccatatatacngtgcgaagcgggaattggnggcggtgactgctatgactacgtgggccagggaaccctggtccaccgtctcctcacgccctccaccgaacgggccccacgttcccggtaccttccccccgttcggcccacccctcctacccgaaacgacgacctacccgtcgtcgggggacaccgacggcccggacccgtcgggcctcggtcccgtcggtaccgtaacggaccttaccgttaccggacggttacgttaccgacttcggaccggcgggtccgtacgggaccgaaagggccgacgtagtacgg

SEQ ID NO: 250232 - DNA, 599 bp, Homo sapiens
  misc_feature: GYAE6OF01A0H8Y.16.37.D04.1.454.CMB.1.raw
  modified_base (360)..(360): a, c, t, g, unknown or other
  misc_feature (360)..(360): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaaacagtctgagagtcgaggacacggccatatattactgtgcgaagcgggaattggtggcggtgactgctattgactacgngggccagggaaccctggtccaccgtctcctcacgccctccacccgaacgggccccacgtccggtccttcccccgtcggcccaccccttccctacccaacgtacgcctacccgtcgtcggggacaccgacgcccggtccccgtcgggccgtcgcccgtcggtaccgaacggtacctaccgttccgaacgttacgtacacgtcggacgggtcgggccgtgggacgaagggccgcgacgtag

SEQ ID NO: 250233 - DNA, 729 bp, Homo sapiens
  misc_feature: GYAE6OF01EF82T.16.37.D04.1.454.CMB.1.raw
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccgagggaaggggctagaatgggtctcaagtatcaacaagcagtagtagtaccgnatggtacgcagacctccggtgaacgggtccgtttcaccatcctccagagacaattccaanaacacgctgtatttgactaaatgaacagtctagagngtacgaggacacggctatatattacngtgacgaaggcggtaattggtggcggtgactgcttagtgactcggtgggccgaacggtaccctggtacacccggtctcccagccgtccctacccaaccgaaccgggtcccctaacgttcccggttacccttcccccgtcggtaccccctacccccttaccccgtacccgaaaccgtaccgtaccccgtaaccccggttcgggtcccgggggtaccaacccgggccgggtaccccggggtcccccggttcggggtcccgttcccgggtaccccgttacgggtaacccgtaaaaccgggtaccccgtttacccggttacccgggtaacggtttaaccgtacgtaaccggttacgggaccgggtcccgggtacgtacgggaaccgtaacgggcgaccgtagtacg

SEQ ID NO: 250234 - DNA, 618 bp, Homo sapiens
  misc_feature: GYAE6OF01DBXKZ.16.37.D04.1.454.CMB.1.raw
  modified_base (610)..(610): a, c, t, g, unknown or other
  misc_feature (610)..(610): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaacgggccgtttcaccatctccagagacaattccaagaacacgctgtatttgacaaatgaacagtctgagagtcggaggacacggccatattattactgtgacgaaggcgggtaattgggtggcggtgactgctattgactacgtggggccagggaaccctggtccaccgtctccctcacgccctcccgaccgaacgggccccacgttcccggttccgttcccccgtcggcccctacccctccctacccgaacgcgccacccgtccgtcgggggcaccgcggacccggtccccgtgggccgtcgtccgtcgggtaccgaacgggtacctaccgttacccggacgtacgtaccacgtcggacgggccgggcgtcgggacgagggccgngaagtacg

SEQ ID NO: 250235 - DNA, 580 bp, Homo sapiens
  misc_feature: GYAE6OF01BMXU2.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaaggccgtttcaccatctccagagacaattccaagaacacgctgtatttgcaaatgaacagtctgagagtcgaggacacggccatatattactgtgacgaagcgggaattggtgcggtgactgctagtgactacgtgggccagggaccctggtcaccgtctcctcacgccctccaccgaacgggcccacgtccggtcccttcccccgtggcccacccctcccgtaccaacgacgccaccgtcgtcggggcaccgacggccggcccgttcgggcctcgtcccgtggtaccgaaggtcctaccgttccgtacgtacgtaccgacgtggacggcgggcgtcgggacaagggcgcgagtacg

SEQ ID NO: 250236 - DNA, 583 bp, Homo sapiens
  misc_feature: GYAE6OF01B8SZY.16.37.D04.1.454.CMB.1.raw
  modified_base (290)..(290): a, c, t, g, unknown or other
  misc_feature (290)..(290): n is a, c, g, or t
  modified_base (579)..(579): a, c, t, g, unknown or other
  misc_feature (579)..(579): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgngagtcgaggacacggccatatattactgtgcgaagcgggaattggtggcggtgactgctattgactacgtggggccagggaaccctgggtacaccggtctccctctagcccttcccaaccgaacgggccccaagtccggttcctttccccccgtggcccaccccgtccctacccaagacgacacctcgtcggggcacgacgccggcccgtgggcctgccgtggtccgaaacggtactacgttaccgaggtacgtacacgtcgaggtccggacgtggacgaagggcgcgngtag

SEQ ID NO: 250237 - DNA, 579 bp, Homo sapiens
  misc_feature: GYAE6OF01EAKYL.16.37.D04.1.454.CMB.1.raw
  modified_base (574)..(574): a, c, t, g, unknown or other
  misc_feature (574)..(574): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctggtcaccgtctcctcacgcctccacccaacgggccccacgtcggtccttcccccgtcggccaccccgtcctccaacgacgccacctccgtcggggcacgacggccggcccgtcgggcctcgccgtcggtcgaacggtaccttaccgttcccggaggtacgtacaccgttggacggcgggcgtcggacgaaggccgcgngtacg

SEQ ID NO: 250238 - DNA, 586 bp, Homo sapiens
  misc_feature: GYAE6OF01ADHX7.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctggtcaccgtctcctcacgccctccaccgaacgggccccagtccggtccttcccccgtcggccacccctcctacccaacgacgccaccgtcgtcggggccacgacgccggcccgtgggcctcggcccgtggtcgaacggtacctaccgttccggtacggtacgtaccacgtcggacggccggggtcgtcgggacaagggccgcgagtacgg

SEQ ID NO: 250239 - DNA, 623 bp, Homo sapiens
  misc_feature: GYAE6OF01CZ4Q3.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatctccagagacaatccaagaacacgctgtatttgacaaatgaacagtctgagagtcgaggacacggcatatatactgtgcgaagcgggaattgggtggcggtgactgctattgactacgtcgggccagggaaccctggtcaccgtctcctcgacgcctcccgaccgaacgggccccacgtccggtccttccccgtcgccctacccctccctaccgaacgcgacccgtaccgtaccggtcgggggaccaccgacggtcccgggccccgtgggcctcggtcccgttcgggtaccgtaaacgtaccgttaccgttacccggtaacggttaacgtaaccgacgtggaccgggccgggacgtcgggacgacgggtcgacgtagtacgg

SEQ ID NO: 250240 - DNA, 588 bp, Homo sapiens
  misc_feature: GYAE6OF01BGS7J.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgcgaagcgggtaattggtggcggtgacgtgctatgactagtgggccagggaaccctggtccacgtctcctcacgcctccaccgaacggccccaagtcccgtcccttccccgtcggaccctacccctccctaccgaacgaccgccgtaccctcggtccggggcaccgacggccggcccgtgggcctcgccgtcggacgtaagacttacctccggaagtcgtaaccacggtcggacgggccgggcgtcgggaccgaaggccgcgagtacg

SEQ ID NO: 250241 - DNA, 566 bp, Homo sapiens
  misc_feature: GYAE6OF01ET86F.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgcaaaatgaacagtctgagagtcgaggacacggccatatattactgtgcgaagcgggaattggtggcggtgactgctattgactacgtgggccagggaaccctgggtccaccgtctcctcacgcctccaccaacggcccatccggtccttccccgtcggccaccctcctccaagacgccacctcgtcggggcacgacgccggcccgtcgggcctcgcccgtcggtaccgaacggtactaccgttccggagttacgtacacgtcgaggcgggcgtggacgaaggcgcgagtag

SEQ ID NO: 250242 - DNA, 630 bp, Homo sapiens
  misc_feature: GYAE6OF01CKML2.16.37.D04.1.454.CMB.1.raw
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (390)..(390): a, c, t, g, unknown or other
  misc_feature (390)..(390): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggngcggtnactgctattgactagtgggccagggaaccctggtccaccgttctacccncacgccctccaccgaacgggacccacgttccggtcccttcccccgtcggccctacccctcccttacccaaaccggacgcccgacccgttccggtcgggggccaaccgacggcccggccccgttcggggccgtcgcccgttcggtaccgaacggtaccgttaccgttcccggtaaggttaccgtaccgaccgttcggacggtccggggtccgtcgggtaccgaagggccgcgtaacgtagg

SEQ ID NO: 250243 - DNA, 581 bp, Homo sapiens
  misc_feature: GYAE6OF01ANE0A.16.37.D04.1.454.CMB.1.raw
  modified_base (576)..(576): a, c, t, g, unknown or other
  misc_feature (576)..(576): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggaattggtggcggtgactgctattgactacgtgggccagggaccctggtcaccgtctcctcacgcctccaccaacgggccccacgtccggtccttcccccgtcggcccacccctccctacccaacgacgccaccctcgtcggggccaccgacgccggcccgtcgggcctgcccgtggtccgaacggtacctaccgtcccggtacgtacggtacacgtcggacggcgggacgtcgggacgaaggcgtacgngtacg

SEQ ID NO: 250244 - DNA, 576 bp, Homo sapiens
  misc_feature: GYAE6OF01B2YGQ.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagacgtcgaggacacggaccatatattactgtgacgaagcgggtaattgggtgcggtgactggctattgacgtacgtgggccagggaccctggccaccgtctcctcacgcctccaccgacggcccagtccgtccttccccgtcggccaccctcctccaacgcgaccaccgtccgtcggggcacgacggccggtcccgtgggcctcgccgtggtacgaacggtcttaccgtccggtaagtacgtacgacgtcggacgccggggctagggaccgaaggccgcgagtacg

SEQ ID NO: 250245 - DNA, 583 bp, Homo sapiens
  misc_feature: GYAE6OF01CPGJW.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggggaattggtggcggtgactgctattgactacgtgggccagggaaccctggtcaccgtctcctcagcctccaccaacgggcccacgtccggtccttccccctcggccaccccgtcctccaacgacgccacccgtcgtcgggggcaccgacggccggcccgtgggcctcgccgtcggtccgtaacggtacctaccgttccggacggttacgtacacgtcgaacggccgggcgtcgggacgaagggcgcgaagtacgg

SEQ ID NO: 250246 - DNA, 610 bp, Homo sapiens
  misc_feature: GYAE6OF01EROQ8.16.37.D04.1.454.CMB.1.raw
  modified_base (317)..(317): a, c, t, g, unknown or other
  misc_feature (317)..(317): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattacngtgcgaagcgggaattggtggcggtgactgctattgactacgtggggccagggaaccctggtccaccgtctcctcacgcctccaccaagggcccactccggtccttcccccgtcggcccacccctccctccgaacgacgccacccgtcgtcggggcacgacggccggcccgtcgggcctcggtcccgttcgggtaccgaaacgggtaccttaccgttacccgtacggttacggttaaccgacgttcggacgggtccgggacgttcgggaccgtaaagggccgcgtagtaacgg

SEQ ID NO: 250247 - DNA, 564 bp, Homo sapiens
  misc_feature: GYAE6OF01BOCNH.16.37.D04.1.454.CMB.1.raw
  modified_base (319)..(319): a, c, t, g, unknown or other
  misc_feature (319)..(319): n is a, c, g, or t
  modified_base (471)..(471): a, c, t, g, unknown or other
  misc_feature (471)..(471): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaaggaccgtttcaccatctccagagacaattccaagaacacgctgtatttgcaaaatgaaacagtctgagagtcgaggacacggccatatattacngtgcgaagcggaattggtgcggtgactgctattgactacgtggggccagggaaccctggtcaccgtctcctcacgcctccaccaacgggcccagtccggtccttccccgtggccgccctgctcccgaggctccacctccggacgacgccacncggccggccctggggcctggcctggtaccaacggtactaccgttccgagtacgtaccacgtggacggccgggactcgggcaaacgggcgtacg

SEQ ID NO: 250248 - DNA, 619 bp, Homo sapiens
  misc_feature: GYAE6OF01CCW00.16.37.D04.1.454.CMB.1.raw
  modified_base (349)..(349): a, c, t, g, unknown or other
  misc_feature (349)..(349): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgagacacggccatatattactgtgacgaagcgggaattgggtggcggtgactgntagttgactacgtggggccaggtaaccctggtccaccgtctcctcgacgccctaccaccgaacgggcccctacgtccggttcccttcccccgtcggccctacccctccctaccgaacgacgccacccgtcggtccggggccacgacggcccggcccgtgggtcctcggtcccgtcggtaccgaaacggtacccttacccgttacccgaaggttaccgtaccacggttcggaacgggtccgggcgtacgggaccgaaggccgacgtagtag

SEQ ID NO: 250249 - DNA, 581 bp, Homo sapiens
  misc_feature: GYAE6OF01D6PFU.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctggtcaccgtctcctcacgcctccaccgaacgggcccacgtccgtccttccccgtcggcccacccctccctccaacgacgccaccgtcgtcggggcacgacggccggcccgtgggcctcgcccgtcggtacaacggtacctaccgttccgacggttacgtaccacgtcggacggcgggccgtcgggacgaagggccgcgagtacgg

SEQ ID NO: 250250 - DNA, 574 bp, Homo sapiens
  misc_feature: GYAE6OF01EFENA.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgcgaagcgggaattggtggcggtgacgtgctattgactacgtggggccagggaccctggtcaccgtctcctgacgccctccaccgacgggcccacgtccggtccttcccccgtggcctacccctccctaccaacgacgcctacccgtcgtcggggaccacgacggcccggcccgtgggcctcggcctggtacaacggtcctacgttccgacgtacgtacacgtgacggcgggctgggacaagggcgcgagtacg

SEQ ID NO: 250251 - DNA, 568 bp, Homo sapiens
  misc_feature: GYAE6OF01BKOEF.16.37.D04.1.454.CMB.1.raw
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (561)..(561): a, c, t, g, unknown or other
  misc_feature (561)..(561): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggnggcggtnacgtgctattgactagtggggccagggaccctgggtcaccgtctcctcacgcctccaccgaacgggccccagtccggtccttccccgtcggcccaccctcctccgaacgcgccaccctcgtcggggcaccgacgccggcccgtgggcctcgccgtcggtacaggaccttccgtccgagtacgtacacgtcggacggcgggcgtcgggcgaagggccgngagtacg

SEQ ID NO: 250252 - DNA, 635 bp, Homo sapiens
  misc_feature: GYAE6OF01CPEOB.16.37.D04.1.454.CMB.1.raw
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
  modified_base (629)..(629): a, c, t, g, unknown or other
  misc_feature (629)..(629): n is a, c, g, or t
tcagtgtactactccacgaccggtgctcgatttagtagcatactgtgggtttgggggagacttagtacagccggggggggtccctgagactctcctgtgcagcctctggattcacctttagtgcctatgccatgagctgggtccgccaggctccgaggggaaggggctagaatgggtctcaagtatcacaagcagtagtagtaccgcagtggtacgcagacctccgtaggaacgggtccgtttcaccatcctaccagagactaacttccaaagaaccacgcttgttaatttgacaaaagtgaacagtcngagagtcgaggacacgcatatatactgtgcgaagcggaattgggnggcgtgactgctagttgacgtacgtcgggaccgagggaacccttggtaccaccgttctacctcacgccctccaacgaaccggccctacgtcccggttcccttccccgcggccctacccctccctacccgaagaccgtccgtaacccgtcggtaccggggacaccggacggcccggtcccgtacgggcgtcgtccgttcggtaccgaacgggtaccttaccggtccgaaggttacgtaccgacggttgacgggcggtacgtcgggacgaggccganagtacg

SEQ ID NO: 250253 - DNA, 585 bp, Homo sapiens
  misc_feature: GYAE6OF01B9SED.16.37.D04.1.454.CMB.1.raw
  modified_base (576)..(576): a, c, t, g, unknown or other
  misc_feature (576)..(576): n is a, c, g, or t
  modified_base (579)..(585): a, c, t, g, unknown or other
  misc_feature (579)..(585): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacggtgaatcttacaaatgaacagcctgagaaccgaggacacggccgtatattattgtataggttatggtggtaattcgggccctggggccagggaccgtggtcaccgtctcctcagcctccaccgaacgggcccatccggtccttcccccgtggccgcccctcgcctcccagggacgccaccgtccgagacgccacacggccggcccgtgggcctcggcccgtgggtaccaagggaccttaccgttaccggaggttaacgtaccaccgtaggacggcgggcgtcgggaccgtaaacgggccgacgagtacggncgnnnnnnn

SEQ ID NO: 250254 - DNA, 676 bp, Homo sapiens
  misc_feature: GYAE6OF01C5DDS.16.37.D04.1.454.CMB.1.raw
  modified_base (257)..(257): a, c, t, g, unknown or other
  misc_feature (257)..(257): n is a, c, g, or t
  modified_base (436)..(436): a, c, t, g, unknown or other
  misc_feature (436)..(436): n is a, c, g, or t
  modified_base (545)..(545): a, c, t, g, unknown or other
  misc_feature (545)..(545): n is a, c, g, or t
tcagtgtactactccacgaccggtgctcgatttagtagcatactgtgggtttgggggagacttggtacaggccgggggggtccctgagactctcctgtgcagcctctggattcacctttagtgcctatgccatgagcgtgggtccgccaggctccgaaggggaaggggctagaagtggggtctacaagtatcaacaagcagtaagtacgtaccgcagtggtacgcagactccgtaggaagggccattccaaccatcncagagacaattcccaagaacacactgtatctgacaaatcgaacaggcctagaagaactaggaggaacacggctacgtaatacttactgtgcggagggacggggggccgggttgggacgccgtacccgtccggacgggggtaccaagtcgaccgtccgtggggaccacgggtctcccggngttccaccggttcctccgtccacgcccctacccgaccgaacgggccctacgtcccggttcccgttcccccgtcgggcccgtccccgtcgacccgttaccgagggtaccncccgaccgtaccggacgaccgccaaccggacggcccggtcccggtacgggtcctacggcccgtacggtacggaaccggtacttaccgttaccgaagtacgtaactcgtacggacggcgggcgtggaaccgg

SEQ ID NO: 250255 - DNA, 716 bp, Homo sapiens
  misc_feature: GYAE6OF01A9LNJ.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccgagggaaggggctagaatgggtctcaagtatcacaagcagtagtagtaccgcatggtacgcagactccgtgaagggccgtttcacatctccagagacaattccaagaacacgctgtatttgacaaatgaacagtctgagagtcgagacacggccatatattactgtgacgaagcgggaattgggtggcgtgactgctattgactacgtcggggaccacggtaacccgtgtccgaccgttcctcctcgacgtccctacccgtaaccgaaccgggtcccctacgttcccggttacccgtttccccccgtacgggacccctacccccgttacccctacccgtaaacgaccgacccgtaacccggttccggtaccgggggtacccaaccggtaccgggaccccgggtccccgggtaccggggcccgttacggccccggttacgggtacccgtaaaccgggtaacccgtttacccgttaccggtaacggttaacccggttaacctaccggttagggaccggtaccggggtccgtacgggacggaaaccggggccgtaccggaagtacgg

SEQ ID NO: 250256 - DNA, 853 bp, Homo sapiens
  misc_feature: GYAE6OF01DT58Z.16.37.D04.1.454.CMB.1.raw
  modified_base (204)..(204): a, c, t, g, unknown or other
  misc_feature (204)..(204): n is a, c, g, or t
tcagtgtactactccacgaccggtgctcgatttagtagcatactgtgggtttggggagacttagtacagccgggggggtccctgagactctcctgtgcagcctctggattcacctttagtgcctatgccatgagctgtgtccgcagctcgagggagggctagagtggtctacaagtatcacaagctaaggtagtacgtacccgntagtggtacgacagtaccgttccggtagggaacggggttcccttttaccaacctactcctacccgaggaacgaactaaacttaccaaacgaaacaccgtcttagttagttttcgaactaaaagtagaaactacgttactaggaaggtaggtcggaacgggaaccgaaccgggacctaattattaagtttacgtggtcgaaccgggaaggtacgggtaagttgggtcgggacggtagacgtgtacttagttcgaaccgttacggtcggggacccgaaacggggtaccccgttgggtacccgtacccggttccttacccgtacgtaccgtcccctaccccgaacccggaacccgggtacccccgtaccccggtttaccccgtttccccccggttaccggacccccgtacccccgttcccgtaaccccgaaacggaacccgtaccctacccgtccgggtcgggggacccaaccggtccgggtaccccggtccccgggttcggggcccgttcggtccccggttcgggttaaccggtaaaaccggttacccgttaacccgttacccggtaacggttaaccgtaaacccgtccggttacgggaccgggtcccggggtacggttcgggaaccggtaacgggcccgccgttagacgg

SEQ ID NO: 250257 - DNA, 669 bp, Homo sapiens
  misc_feature: GYAE6OF01CLY41.16.37.D04.1.454.CMB.1.raw
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
tcagtgtactactccacgaccggtgctcgatttagtagcatactgtgggtttgggggagacttagtacagccgggggggtccctgagactctcctgtgcagcctctggattcatcttcagcggtttcgctatgcactgggtccgccaggctccaggaaagggactggaatatgttcagctattagttataagtgggggtaacacatactacgcagactcagtgaagggcagattcacatctccagagaacaacttccagaacacgctaggatcttacaaatgagcagtcngagagctagaggcacggctgtcgttattacgtgtgtagaagtactttcgnggtactacgtacgaactacgtactacggtataggtacgtcgtgggaccgaacggggtaccgaccggttccaaccgtcctccgtacgaccgaccctacccgaacccgaaaccgggtcccaaccgttccggtaccccgtttcccccgtacggtcccctaaccccttccccgtacccaaggaccacccgtaacccgtcggtccggggaccaccgtacggcccggtcccgtcggggcctacggtccgtagggtaccgaaacggtacctttaccgtaccggtaaggtaccgtaaccgtacgtacggacggaccgggcgtgggaacgtaaccggg

SEQ ID NO: 250258 - DNA, 662 bp, Homo sapiens
  misc_feature: GYAE6OF01B98ZN.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtcgacggaaaggcgggtaaagtttgggtgggcgggttagaccgttggtccttaagtttggaaccttacggttacggggggaccctaacgggggtaaccccttgggtaccctaacccggttcctccccgtcacggtccctacccacccgaacgggcccctacgttcccggttcccttcccccgtcggacccctacccctccctacccaacgacgccaccgtcggtcggggccacgacggccggccgtcgggcctcggccgtcgcgaacggtacttaccgtaccggacgttacgtaccgtacggtcggacggtcgggcgtcgggacgaagggcgtcgagtacgg

SEQ ID NO: 250259 - DNA, 618 bp, Homo sapiens
  misc_feature: GYAE6OF01DGZ7Q.16.37.D04.1.454.CMB.1.raw
  modified_base (322)..(322): a, c, t, g, unknown or other
  misc_feature (322)..(322): n is a, c, g, or t
  modified_base (341)..(341): a, c, t, g, unknown or other
  misc_feature (341)..(341): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagaacaattccaagaacacgctgtatttgacaaaatgaaacagtctagagagtcgaggacacggccatatattacngtgcgaagcgggaattggnggcggtgactgctattgactagtggggccagggtaacccctgggtccaccgtctcctacacgccctcccaccgaacgggccccaagtcccggttcctttcccccgtcgggccctaccccctccctacccgaaacgacgcctacccgtccgtcgggggaccaccgacggcccgggtcccgtcggggccgtcggcccgttgggtaccgaacggtacctaccgttccggagttaacgtactacgtggacggcgggcgtcgggacgagggcgcgtcgtacg

SEQ ID NO: 250260 - DNA, 747 bp, Homo sapiens
  misc_feature: GYAE6OF01EUGOY.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccgagggaggggctagaatgggtctcaagtatcacaagcagtagtagtaccgcagtggtacgcagacctccgtaggaacgggtccgtttcacctatctaccagacgactaacttccaaagaacacgctagttatttgacaaatgaacagtctagagagtcggagacgacggacatatattctgtgacgaagcgggtaagttgggtgcggtgacgtgtcgttagtcgacgtacggtcggggaccgacgggtacccttcgggtaccctaccggtccttcccgtaccgacgttcccctacccgaacccggaaccggggtcccctaacggttccccggttacccctttccccccggtcgggtaccccctacccccgtttaccccgtaaccgaaacgaccggtacccgacccggttacgggtaccgggggacccaccggtaaccgggtcccgggtcccccgttggggtacccttcggtacccggtacgggttaaccgaaacgggttaccccgtttacgttaacccggaggtttaaccgtaacgacggttacgggacggtcccgggtacggtaccgggacgaagggcccgtaagtcggtag

SEQ ID NO: 250261 - DNA, 568 bp, Homo sapiens
  misc_feature: GYAE6OF01BWPLD.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaaatgaacagtctgagagtcggaggacacgggccatatattactgtgcgaagcgggaattgggtggcggtgactgctattgactacgtggggccaggggaaccctggtcaccggtctcctcacgcctccaccgaagggccccagtccggtccttccccgtcggcccaccctcctccaacgacgccaccgtcgtcggggcacgacgccggcccgtgggctcgccgtggtacgaaggaccttacgtccgagtacgtacacgtgacgcgggcgtcgggacgaaggcgcgagtacg

SEQ ID NO: 250262 - DNA, 578 bp, Homo sapiens
  misc_feature: GYAE6OF01EUQMI.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgacaaaatgaacagtctgagagtcgaggacacggccatatattactgtgcgaagcgggtaattggtggcggtgactgctattgactacgtggggccagggaaccctggtccaccggtctcctcacgccctccaccgaacgggccccacgtccggttccttcccccgtcggcccacccctccctaccaacgacgccacctcgcggggcacgacggccggcccgtcgggctcgccgtcggacgaaggtacctaccgtccgaggtacgtacacgtggacggccgggcgtcggacgaaggcgcagtag

SEQ ID NO: 250263 - DNA, 594 bp, Homo sapiens
  misc_feature: GYAE6OF01B5B3I.16.37.D04.1.454.CMB.1.raw
  modified_base (181)..(181): a, c, t, g, unknown or other
  misc_feature (181)..(181): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagaatgggtctcaagtntcacaagcagtagtagtaccgcagtggtacgcagacctccgtgaagggccgtttcaccatctccagagacaattccaagacacgctgtatttgcaaatgaacagtctgagagtcgaggacacggccatatatactgtgacgaagcgggtaagttggtcgggcggtgactgctattgactacgcggggccagggaaccctggtccacgtctcctcacgcctaccaccgacgggcccagtccacgtcccttccccgaggccctaccctcctaccaacgtacgccacccgtcgtggggcctacgacggccggtacccgtgggcctcgaccgtcggtccaaacgggtcccttacgttacccggacgttacgtaacctcggtacggtacggccgggtctaggaccgacggcgctaagg

SEQ ID NO: 250264 - DNA, 585 bp, Homo sapiens
  misc_feature: GYAE6OF01E3TTB.16.37.D04.1.454.CMB.1.raw
  modified_base (312)..(312): a, c, t, g, unknown or other
  misc_feature (312)..(312): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgcaaatgaacagtctgagagtcgaggacacggccatanattactgtgcgaagcggaattggtggcggtgactgctattgactacgtgggccaggaaccctggtccaccgtctcctcacgccctccaaccgaacgggcccacgtcccggttccttcccccgtcgccacccctcctaccaacgacgccacctcgtcgggcaccgacgccggcccgtgggcctcggccgtcggtacctaacgggaccttaccgttccgaacgttacgtaccgacgttcggacggcggggcctcgggacgaagggcgcagtaacg

SEQ ID NO: 250265 - DNA, 575 bp, Homo sapiens
  misc_feature: GYAE6OF01BI6K7.16.37.D04.1.454.CMB.1.raw
  modified_base (339)..(339): a, c, t, g, unknown or other
  misc_feature (339)..(339): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatctccagagacaattccaagaacacgctgtatttgacaaatgaacagtctagagagtcgaggacacggccatatattactgtgcgaagcgggaattggnggcggtgactgctatgactacgtggggccagggaaccctggcaccgtctcctcacgcctccaccgaacggcccagtccgtccttcccctggccaccctcctccaacgacgccacctcgtcggggccacgacggccggcccgtcgggcctcgcccgtcggtaccgaaggtaccttaccgttaccggacgtacgtaccacgtcggacggccgggcgtgggacgaagggcgcgagtacg

SEQ ID NO: 250266 - DNA, 934 bp, Homo sapiens
  misc_feature: GYAE6OF01EDIMO.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccgaggggagggctagaagtgggtctcaagtatcacgaagcagtagtagtaccgcagtcggtacgcagacctccggtagaacgggtccgtttcaccatcctccagagactaacttaccgaaagaacacgcttagttaactttgaacaaagtcgaactagtctaggagacgtacggaggacgacggaccaattatacttacgtggtaggacgaagggcggtaagttcgggtggaccggtagacgtacggtacttagttacggtaccgtaacgggttcggggaacccgtaacgggggaaccccctttagggaccccgtaacccggttcctacccgttaccccggaacgtcccccgttaacccgaaaacccccgggtaacccggggtacccccttaccggggtttaacccccggtttccccccgttttaacccccccgggtacgggtacccccccttacccccccgttacccccgttaaaccggaaaccggtacccgtacccggtaccccggttaccggggttacccggggggaaccctaaccggggtaccccgggtaccccgggtcccccccggggttacggggtcccttaacccggggtccccccggtttaacggggttaaccggaaaacgggtttaaccccggtttaaccccggttttaccggaaaacggggtttaacccgttaacccgaacgggttcccgggggaaccggggttaccccgggggtacggttaacgggggaacccccgaaaccggggggacccgttaacgtaaaggttacgg

SEQ ID NO: 250267 - DNA, 592 bp, Homo sapiens
  misc_feature: GYAE6OF01C95X0.16.37.D04.1.454.CMB.1.raw
  modified_base (339)..(339): a, c, t, g, unknown or other
  misc_feature (339)..(339): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatcctccagagacaattccaagaacacgctgtatttgcaaaatgaacagtctgagagtcgaggacacggccatatattactgtgcgaagcgggaattggnggcggtgactgctattgactacgtgggccaagggaaccctggtcaccgtctcctcacgccctccacccgaacgggccccacgttcccggttcccttcccccgtcggccctacccctccctaccaagacgcctacccgtcgtcgggggcaccgacggccggcccggtgggcctcgccgtcggtaccgaacggtaccttaccgttcgacgtacgtacgacgtggacggcgggcgtggaccgaagggcgcgagtag

SEQ ID NO: 250268 - DNA, 583 bp, Homo sapiens
  misc_feature: GYAE6OF01BEDL4.16.37.D04.1.454.CMB.1.raw
  modified_base (433)..(433): a, c, t, g, unknown or other
  misc_feature (433)..(433): n is a, c, g, or t
  modified_base (574)..(574): a, c, t, g, unknown or other
  misc_feature (574)..(574): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgcgaagcgggtaattggtggcggtgacgtgcttagtgactcgtcgggccacgggaaccctgggtccaccgtctcctcacgcctccaccgacggcccagtccgtccttccccgnggccaccctcctaccaagcgccaccgtcgtcggggcaccgacgccggcccgtgggcctcgccgtcggtaccgaacggtaccttaccgtccgacggttacgtacacgtcggacgggccgggtcgtacgggacgaagggccgngtacgtagg

SEQ ID NO: 250269 - DNA, 553 bp, Homo sapiens
  misc_feature: GYAE6OF01BWED6.16.37.D04.1.454.CMB.1.raw
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (518)..(518): a, c, t, g, unknown or other
  misc_feature (518)..(518): n is a, c, g, or t
  modified_base (547)..(547): a, c, t, g, unknown or other
  misc_feature (547)..(547): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcccgttttcaccatctccagagacattccaagaacacgctgtatttgacaaatgaacagtctagagagtcgaggacacggccatatattacngtgacgaagcgggtaattgggtggcggtgactgctattgactacgngggccagggaaccctggtccaccgtcnccgtcacgccctccaccgacggcccagtccggtccttcccgnggcccnccctccnccagcncncgtcgngggcacgacgccggcctggcctcgcgtggtaccaagtcctacgtccgagtcgtacncgtggcggcggtcgtagggaccagggccngtgtag

SEQ ID NO: 250270 - DNA, 581 bp, Homo sapiens
  misc_feature: GYAE6OF01E2LMZ.16.37.D04.1.454.CMB.1.raw
  modified_base (389)..(389): a, c, t, g, unknown or other
  misc_feature (389)..(389): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggaattggtggcggtgactgctatgactacgtggggccagggaccctggtccaccggtctccncagcctccaccgaacggcccatcccggtccttcccctcggcccaccctcctaccgaacgacgccaccgtcgcggggcacgacgccggcccgtcgggctcgccgtcggtaccgaacgggaccttaccgttaccggtacggttacgtacaaccgttggacgggtcgggccgtcgggacgaagggcgcgagtacg

SEQ ID NO: 250271 - DNA, 552 bp, Homo sapiens
  misc_feature: GYAE6OF01ELS34.16.37.D04.1.454.CMB.1.raw
  modified_base (546)..(547): a, c, t, g, unknown or other
  misc_feature (546)..(547): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctgggccaccggtctcctcacgtccctccaccgaacggccccagttccggtccttcccccgtcggcccaccctcctccaacgacgccacctcgtggggcacgacgccgcccgtcgggctcgccgtggcaacggctacgtccgagtcgtacactgacgcggcgtcggcaggcgnngtacg

SEQ ID NO: 250272 - DNA, 703 bp, Homo sapiens
  misc_feature: GYAE6OF01DKERH.16.37.D04.1.454.CMB.1.raw
  modified_base (342)..(342): a, c, t, g, unknown or other
  misc_feature (342)..(342): n is a, c, g, or t
tcagtgtactactccacgaccggtgctcgatttagtagcatactgtgggtttgggggagacttagtacaggccgggggggtccctgagactctcctgtgcagcctctggattcacctttagtgcctatgccatgagctgggtccgccaggctccgaggggaagggggctagaatgggtctcaagtatcacaagcagtagtagtaccgcatggtacgcagactccgtgaagggccgtttcaccatctccagagacaattccaagacacgctgtatttgacaaatgaacagtctgagagtcgaggacacggcatatattactgtgacgaagcgggtaattgggnggcggtgactgctattgactacgtggggaccagggtaaccctgggtccaccggtcctccgtcacgccctcccgaccgaacgggccccaacgttcccggttcccttcccccgtacggccctaaccccgtcccttaacccgaacgaccgtacccgtacccgttaccggtcggggggtaccaaccgaccgggccccgggtccccggttaccggggcccgtttacgggtacccccggtcgggttaccggaaaccgggttaacccttacccggtttacccggtaacgggttaacgtaacccgtaacggttcgggaacgggtccgggtaccggtaccgggaccggaacgggtccgaccgtagtacgg

SEQ ID NO: 250273 - DNA, 576 bp, Homo sapiens
  misc_feature: GYAE6OF01EMR2Q.16.37.D04.1.454.CMB.1.raw
  modified_base (397)..(397): a, c, t, g, unknown or other
  misc_feature (397)..(397): n is a, c, g, or t
  modified_base (471)..(471): a, c, t, g, unknown or other
  misc_feature (471)..(471): n is a, c, g, or t
  modified_base (572)..(572): a, c, t, g, unknown or other
  misc_feature (572)..(572): n is a, c, g, or t
tcagtgtactactccacgaccggtgctcgatttagtagcatactgtgggtttggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgcaaatgaacagtctgagagtcgaggacacggccatatattactgtgcgaagcgggaattggtggcgtgactgctagttgacttacgtggggaccagggtaacccctgggtcaccggtcttcccncacgccctccgacccgaacgggccccagttccgtccttccccctaggcccaccctcctacagacgccacctcgnggggcacgacgtccggcccgtgggctcgccgtggtcgaacggacttaccgttccgaggtacgttacgacgttgacgggcgggtcgtgggacaagggcgtcngtag

SEQ ID NO: 250274 - DNA, 594 bp, Homo sapiens
  misc_feature: GYAE6OF01B0GVI.16.37.D04.1.454.CMB.1.raw
  modified_base (589)..(589): a, c, t, g, unknown or other
  misc_feature (589)..(589): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctagagagtcgaggacacggccatatattactgtgcgaagcgggaattggtggcggtgactgctatgactacgtgggccagggaaccctggtccaccgtctcctcacgccctccaccgaacgggccccacgtccgtcccgttcccccgtcggcccacccctccctacccaacgacgccgacctcggtcggggaccaccgacggccggcccgtgggcctcgcccgtcggaccgaacggtacctaccgttaccggacgtacgtacacgtcggacggcgggccgttcgggacgaacgggccgcgngtacg

SEQ ID NO: 250275 - DNA, 593 bp, Homo sapiens
  misc_feature: GYAE6OF01CJFWD.16.37.D04.1.454.CMB.1.raw
  modified_base (555)..(555): a, c, t, g, unknown or other
  misc_feature (555)..(555): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagacctccgtgaacgggtccgtttcaccatctccagagacaattccaagaacacgctgtatttgacaaatgaacagtctgagagtcgaggacacggccatatattactgtgcgaaggcgggaattggaggtcggtgactgctagttcgactacgtggggccaacgggaaccctggtccgaccgtctccgtcacgcctccaccgaaccgggcccaacgtcggttcccttccccgtcgccacccctccctaccgaacgacgcctaccgtcgtcggggccacgcggccggcccgtgggctcgccgtcggtacgacggtacctaccgttccgacggttacgtaccncgtcggacgcgggtcgtcggtacgaggacggcagtacg

SEQ ID NO: 250276 - DNA, 617 bp, Homo sapiens
  misc_feature: GYAE6OF01A18WW.16.37.D04.1.454.CMB.1.raw
  modified_base (337)..(337): a, c, t, g, unknown or other
  misc_feature (337)..(337): n is a, c, g, or t
  modified_base (450)..(450): a, c, t, g, unknown or other
  misc_feature (450)..(450): n is a, c, g, or t
  modified_base (475)..(475): a, c, t, g, unknown or other
  misc_feature (475)..(475): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgcgaagcgggtaattggnggcggtgactgctattagactacggtcgggacgacggtaacctcggtaccctacgtcctcctacgaccgccctacccgaacggaccgggccctaggttccgtcccttccccgngcccctaccctcctacgaacgaccnccgtaccttcgggtacgggcacgtacggcccggtccgtcggactccgtccgtacggtaccgtacggtaccttacccggtaccgtagggtaacctacgacgtggacgggtccgggtacgtcggacgaagggccacgtagtacg

SEQ ID NO: 250277 - DNA, 934 bp, Homo sapiens
  misc_feature: GYAE6OF01AUFFR.16.37.D04.1.454.CMB.1.raw
  modified_base (204)..(204): a, c, t, g, unknown or other
  misc_feature (204)..(204): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaagggctagaatgggtctcaagtatcacaagcagtagtagtaccgnatggtacgcagactccggtaggaacgggtcctttcaaccatcctaccgaagacgaacctaacttaccaaaagaaccaccgtcttagttaacttttacgactaaaattcggaacctaagttcgtagaggtacggtacggaagggaaccaccgggtaccctaattaaacttagtttaccgtaggttacggaaccggtaaagggtccgggtaaagtttgggggtcgggtacggttacgtaaccgttggtacctttaagtttacggaaaccgttaccgggtacgggggaccctaaacggggtaacccccgttgggtacccgtaaccccggttcctaccccgttacgaacccggtaccccttaccccgaaacccggtaaccggggtacccccttacccggtttaccccggtttacccccgtttacccccccggtacgggtaccccctaaccccccgtttaccccggttaaaccccgaaacgtaccccgtacccgtaaccccggttccggggtaccgggggtacccgaaccgggacccggggtccccgggtacccccgggttcggggcccgttaccgggtaccccggttacgggttaacccggtaaaccggttaacccgttacccgtttaacccgggtaacggttaacccggttaaccgaccggttacggggtacccgggacccggggttccggtaacgggaacccggaaacgggtccgtaacggtacggtaacgg

SEQ ID NO: 250278 - DNA, 580 bp, Homo sapiens
  misc_feature: GYAE6OF01EH4KM.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgcaaatgaaacagtctgagagtcgaggacacggccatatattactgtgcgaagcgggaattggtggcggtgactgctattgactacgtgggccaagggaaccctgggtcacccggtctcctcgacgccctcccacccgaacgggcccacgtccggtccttccccctcggcccaccctccctccaacgacgccaccgtcgtggggcacgacgccggcccgtcgggcctcgccgtcggtacgaacggtacctaccgttccggagtacgtacacgtcggaggccgggcgtcggcgaaaggcgcgagtag

SEQ ID NO: 250279 - DNA, 616 bp, Homo sapiens
  misc_feature: GYAE6OF01B8WQG.16.37.D04.1.454.CMB.1.raw
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggtccgtttcaccatctccagagacaattccaagaacacgctgtatttgacaaatgaacagtctgagagtcgagacncggccatatattactgtgacgaagcggggtaattgggnggcggtgactgctattgactacgtggggaccaagggaccctggtaccaccgtctcctcgacgccctccaccgacgggccctagtcccggtccttccccgtcggccctaccccgtcctaccaacgacgcccaccgtcggtcggggcaccgacggccggcccgtgggcctgacccgtggtaccgaacggtaccctacgttaccggacggttacgtaaccgtcggtacggtacgggaccggggtcgtacgggacgaaaccggggcctacgaagtacgg

SEQ ID NO: 250280 - DNA, 821 bp, Homo sapiens
  misc_feature: GYAE6OF01D5L1U.16.37.D04.1.454.CMB.1.raw
tcagtgtactactccacgaccggtgctcgatttagtagcatactgtgggtttgggggagacttagtacaggccgggggggtccctgagactctcctgtgcagcctctggattcacctttagtgcctatgccatgagctgggtccgccaggctccgaggggaagggctagaagtgggtctacaagtatcacaagcagtagtagtaccgcatggtacgacagactccggtggaacgggtcctttcacccattcctaccgaagacgaactaacttaccaaagaaccacgtccttaggttatttgacaaaatgaacagtctagagagtcgaggacacggctatatattactgtgacgaaggcgggtaattgggtaggcggtagactcgcttaagttgacgtacggcggggaccgaaggtaacccgtggtccaccgtctcccgtacacgggtccctacccgtacccgaacggggtccccgtaacgttccccggttaccgttccccccctacgggtcccctaacccccgttccccgtaacccgtaaccggtaaccgtcccggtaaaccccggttcccggttaccgggggggacccgtaaccccggtaacgggtcccccgggggtcccccgttacggggggtcccttaccggggtacccccgttacgggggttaccccgtaaaacggggttaaccccgttaaacccggttttacccccggtaaagggttaccggttaacccgtacccggttacggggtaacccgggtacccgggggtaccggttacggggacccggtaaacggggcccgtaaccgggtacttaacggg

SEQ ID NO: 250281 - DNA, 723 bp, Homo sapiens
  misc_feature: GYAE6OF01DS201.16.37.D04.1.454.CMB.1.raw
  modified_base (718)..(718): a, c, t, g, unknown or other
  misc_feature (718)..(718): n is a, c, g, or t
tcagtgtactactccacgaccggtgctcgatttagtagcatactgtgggtttgggggagacttagtacaggccgggggggtccctgagactctcctgtgcagcctctggattccaccttttagtgcctatgccatgagcgtgggtccgccaggctcgaggggagggctagaatgggtctacaagtatcacaagcagtagtacgtaccgcagtggtacgcagacctccggtagaacgggtccttacacatctaccagacgacaattccaagaaccacgtcttgtatttgaactaaatagaactagtctgagtagtacggaggaccgacggaccatatattcgtgtcgacgaaggtcggtaagttgggtgggcggtagtacgtgtcttagttagaccgtacggtcggggaccacggggtaacccgtgtacccgtaccgtccttcccgtaccgacgtacccctcccaacccggtaaccgggacccccgtacgttccccggtttccccttccccccggtcggtacccctacccccgtcctaaccccgaacgaccgtacccgtacccgtcggtaccgggggaccaacccggcgggaccccgggtcccggtacgggcccgttcggtcccgttacggaccgtaacggttaaccctaccgttaccggaacgttaccggtaaccacggttcggaccgggcggtaccggtcgggacgaacggcgacgngtacg

SEQ ID NO: 250282 - DNA, 734 bp, Homo sapiens
  misc_feature: GYAE6OF01DCOGE.16.37.D04.1.454.CMB.1.raw
  modified_base (338)..(338): a, c, t, g, unknown or other
  misc_feature (338)..(338): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgtcaggctccgaggggaaggggctagaagtgggtctacaagtatcacaagcagtagtagtaccgcatgggtacgcagactccgtggaacgggtcctttcaccatcctaccagagactaattaccaaagaacacgtactgttaatttgacaaaatgaacagtctaggagagtcgaggacacggcatatattatggngacgaaggcgggtaattgggtaggcggtagactgtactagtttacgacgttacggtcggggacctacggggtaaccctgggtaccgaccgttcctaccgtacacgtaccctaccccgaaccggaaccgggtcccctaccgttcccggttccccgttccccccgtccggtaccccgtacccccgttaccctacccgaacgtaccgacctacccgtccgggtacgggggaccaaccggtaccgggacccgggtccccgggttcgggccgttccggacccgttcgggtaaccgtaacgggtacccgttacccggttaccggtaacggtaaccgttaaccgacggttacgggacgggaccgggtaccggttcgggaaccgacgggtacggacgtagtacg

SEQ ID NO: 250283 - DNA, 597 bp, Homo sapiens
  misc_feature: GYAE6OF01EMSHL.16.37.D04.1.454.CMB.1.raw
  modified_base (390)..(390): a, c, t, g, unknown or other
  misc_feature (390)..(390): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccctttcaccatctccagagacaattccaaagaacacgctgtatttgacaaatgaacagtctgagagtcgaggacacggcatatattactgtgcgaaggcggaattgggtggcgtgactgcttagtgactacgtggggccaggaccctgggtacaccgttcncctcacgtcctaccaccgaacgggccctacgtccggtccttcccccgtggccctacccctcctaccgaacgtacgccctaaccgtcgcgggggccacgacggccggcccgtgggcctgccgtcggtaccaacggtaccgttacgttacgacggttacgtacgaccgtggacggtccgggaccgttcggaccggtaaggcgctgtacg

SEQ ID NO: 250284 - DNA, 733 bp, Homo sapiens
  misc_feature: GYAE6OF01CQQFT.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacagcagtagtagtaccgcatggtacgcagactccgtgaagggccgtttcaccatctccagacgacaattccaagaacacgctgtatttgcaaatgaaacagtctagagagtcgaggacacggccatatattacgtgtgacgaaggtcgggtaagttgggtgggcggtagacttgcttagttcgacgttacggtggggccacggggtaaccctgggtaccaccggtctcccgtcacgcctccgaaccgaacgggccccagtcccggttcccttcccccgtcggccctaccccgtccctacccgtaacgacggccctaacccgtccgggtacggggggccctaaccggacggccccgggtcccccggttcggggtacccggttccggccccggttgggttaccccggaaacggggttaaccctttaccccggtttacccgggtaacggtttaaacccggttaacccgtaaccggttcggggtaaaccggggcccgggggtacccgtacggggtacccggaaaggggtcccggtaccgaacggttaacgg

SEQ ID NO: 250285 - DNA, 834 bp, Homo sapiens
  misc_feature: GYAE6OF01EYB3E.16.37.D04.1.454.CMB.1.raw
  modified_base (833)..(833): a, c, t, g, unknown or other
  misc_feature (833)..(833): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctggtcgtcccgcgaggcctccggaaggggaagggtctaagaagttcgggtcctacgaagttactaccaacgaacgacgtaaggttaacggtaaccgtaccgactaggttacggtaccgacgaacgtaccgttccggtaagggaaccgggttcccttaccacctactcctacgagaacaactaacttaccgaaagaacctcgtcttagttattacgaactaaagtacgaacgtagttacgaggaagtacggtacggaacggaccgacggacctaattattacgttacgtgacgaacggacgggtacggtaagttggggtacggacggtacgtacgtacgttacttagttacggtaccgttacggggtccgggaaccggtaacgggtacccgtcggtaccccgaccgtttcctacccgttacgacccgtcccccgtaacccggaaaccgggaccccgggtaccccccgttacccgggtttaccccctccccggacgtaccccctaccccgttaccgaacccgaaacggcctaccccgtaccggtccggggtacgggaacctccgggacccggtcccggcccgggttggcccgttcggtacccgtacgggtaacctaaacgggtccctttaccgaaccggtagtaacccgtacgaggttcggccgggtacggcggtaacggacgtaccgggctagtaagng

SEQ ID NO: 250286 - DNA, 591 bp, Homo sapiens
  misc_feature: GYAE6OF01CK5IF.16.37.D04.1.454.CMB.1.raw
  modified_base (338)..(338): a, c, t, g, unknown or other
  misc_feature (338)..(338): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgcgaagcgggtaattggnggcggtgactgctattgactacgtgggaccagggaaccctggtccaccgtctcctcacgccctccaccgaacgggtccccacgtcccggttccttcccccgtcggccctacccctccctacccaacgcgcctaccctcggtggggccacgacggcccggcccgtgggcctcgccgtggacgaacggaccttaccgttccgaagttacgtaccacgtggacggccgggtcgtcgggacgaagggccgngngtag

SEQ ID NO: 250287 - DNA, 668 bp, Homo sapiens
  misc_feature: GYAE6OF01BBDGY.16.37.D04.1.454.CMB.1.raw
  modified_base (667)..(667): a, c, t, g, unknown or other
  misc_feature (667)..(667): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatcctccagagacaattccaaagaaccacgctgttatttgacaaatgaacagtctgagagtcgaggaccacggccatatattactgtgacggaaggtcgggtaagttggtggcggtgacgtgtacttagttgaccttacggtcggggacccgaagggtaaccccgttgggtccaccccggttctcccgttcgacgtcccgtccccgaaccggaaccgggcccctacggttccccggttccccttcccccgtcgggacccctacccctcccctaccgaacgaccgacctacccgtcggtacggggccacgacgcccgggacccgtcgggcctcggtccgtacggtcgaacggtaccttacccgttaccggtaacgtacggtaccacggtcggaacgggcgggtcgtacgggacgtaacgggcgcgtaagng

SEQ ID NO: 250288 - DNA, 696 bp, Homo sapiens
  misc_feature: GYAE6OF01B2LCV.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttaggagccatgccatgagctgggtccgccaggctccgagggaaggggctggagtgggtctctactattactgctagtggtaatcatgcatactatgcagacctccgtggaacgggccgttcacccttcaccagagacaattccaagaaccacgctctatctgacaattcgaccacgcctgacggccgccggaggaccgaccggccagttgtattactagtactaaagtcggtcgggtcggcccggcggcccggtaccgtcggtagtttgggtttagtacttttcggtcggggtaccgaaggggtactaagttcggtcctaaccggttccttcctttacgaccgtcccctacccgaacccgaaccgggtcccctacgtcccgggttccctttccccccgtcggtacccctaccccctcccgtacccgaacgcccgtaccgtacccgtccggtcgggggaccaccggaccgggtcccggcccggttcgggccgtcgtccggttcggtaccgaccggtaacctaccgttccgagtacggtacacgtagggtacgccggggtctaggggacgagggtcgtacg

SEQ ID NO: 250289 - DNA, 585 bp, Homo sapiens
  misc_feature: GYAE6OF01AC73P.16.37.D04.1.454.CMB.1.raw
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (580)..(580): a, c, t, g, unknown or other
  misc_feature (580)..(580): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgcagtggtacgcagacctccggtgaacgggtcctttcaccatctaccagagacaattccaagaacacgctagtattgacaaatgaacagtctgagagtcgaggacacggccatatattacngtgacgaggcgggtaattgggnggcggtnacgtgacttagtcgacttaggcgggccgtacgggaccctggtaccaccgtctcctcgacgccctaccaccgacggccctacgtcccgtcccttccccgngaccctccctcctaccgacgcncctccgtcggcgggacacgcgccggccgtggcctcgccgtggaccacggtaccttaccgtacgacgtacgtacgacgtcggacggtcggcgtacggacgaggccgnagtcg

SEQ ID NO: 250290 - DNA, 684 bp, Homo sapiens
  misc_feature: GYAE6OF01BIWDF.16.37.D04.1.454.CMB.1.raw
  modified_base (208)..(208): a, c, t, g, unknown or other
  misc_feature (208)..(208): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (424)..(424): a, c, t, g, unknown or other
  misc_feature (424)..(424): n is a, c, g, or t
tcagtgtactactccacgaccggtgctcgatttagtagcatactgtgggtttgggggagacttagtacaggccgggggggtccctgagactctcctgtgcagcctctggattcacctttagtgcctatgccatgagcgtgggtccgccaggctccgaggggaaggggctagaatgggtctcaagtatcacaagcagtagtagtaccgnatggtacgcagactccggtagaacgggcccgtttcaccatcctccagagacaattccaaagaacacgctagtactttgactaaatgaacagtctagagagtacggaggacacggccaatataattactgtgacgtaagcgggtaagttggnggnggtcgactgacttattgacgtacggtcgggacgacgggaaccctggtaccgaccgttctccncacgccctaccgacgaccgggccctagttccccgtccttacccccgtcgacccctaccccttcccaccgaacgaccgtccaacccggtcgggtaccggggaccaaccggtccggaccccgggccccgtggggcccttcggacccgttacggaaccgtaaccggtaaccttaccgttacccggaacggttaacggtaacctacggttacgggacgggtccgggtacggtcggaaccggaacgggtccgaaacgtgtaacgg

SEQ ID NO: 250291 - DNA, 583 bp, Homo sapiens
  misc_feature: GYAE6OF01E1TF6.16.37.D04.1.454.CMB.1.raw
  modified_base (336)..(336): a, c, t, g, unknown or other
  misc_feature (336)..(336): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggnggcggtgactgctattcgactacgtggggccaacgggaacccttggtaccaccgtcctccctcacgccctcccgaccgaaccgggcccaactccggttccctttcccccgtggcccaccccttcctaccgaacgacgccaccgtcggtcggggcaccgacggccggcccgtgggcctcgccgtggtacgaacggacttaccgtccgagtacgtacacgtgacggcgggctggacaaggcgcagtacg

SEQ ID NO: 250292 - DNA, 668 bp, Homo sapiens
  misc_feature: GYAE6OF01DUNKS.16.37.D04.1.454.CMB.1.raw
  modified_base (144)..(144): a, c, t, g, unknown or other
  misc_feature (144)..(144): n is a, c, g, or t
  modified_base (350)..(350): a, c, t, g, unknown or other
  misc_feature (350)..(350): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccnccaggctccgaggggaaggggctagaagtgggtctcaagtatcacaagcagtagtagtaccgcatggtacgcagactcgtgaacgggtccgtttcaccatcctccagagacaacttccaagaacacgctgtattgacaaatgaacagtctagagagtcggagacgacggctatatattacgtgtgacgaggcgggtaagtttgggngggtacggtgtacgtgtacttagttagaaccgttacggtcgggaccgtaacgggaacccctgggtaccctaccgtctaccgtcgaccgccctacccaccgaccggaccctacgtccgtcccgtccccgtcggccctaccccgtccctaccgaacgaccgccgtacccgtcggtacggggtaccaccggacgcccgggtcccgtcgggccttacggtccgttcgggtaaccgaaccggtaccgttaccgttaccggtacgttaacgtacccggtagttcgggaccggtcgggaccgtcgggaccgaaggcggatagtcg

SEQ ID NO: 250293 - DNA, 702 bp, Homo sapiens
  misc_feature: GYAE6OF01DQDK0.16.37.D04.1.454.CMB.1.raw
  modified_base (353)..(353): a, c, t, g, unknown or other
  misc_feature (353)..(353): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccgagggaaggggctagaatgggtctcaagtatcaacaagcagtaagtagtaccgcagtggtacgcagactccgtgaacgggtcctttcaccatcctccagagacaattaccaagaacacgctgtatttgacaaatgaacagtctagagagtcgaggacaccggctaattatattactgtgacgaaggcgggtaattgggnggcggtgactgcttagtgactacgcggggaccacgggtaaccctgggtaccacccgttctaccgtacacgccctaccgaacccggaaccgggacccctacgttccccggttcccttaccccccgtcgggacccctacccccgtcccgtaacccgaaaggacccgacccgtacccgttcgggtaccgggggacctaaccggaccgggtcccgggtccccgggttacgggcccgttcggtacccggttacgggtaaccgtaaaccggtaaccttacccggttaccgtaaggttaacgtacacggttcgggacgggtccggacggtacgggaccgaagggcgacgtagtacg

SEQ ID NO: 250294 - DNA, 597 bp, Homo sapiens
  misc_feature: GYAE6OF01ETJ24.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaacgggcctttcaccatcctccagagacaattccaaagaacacgctgtatttgacaaatgaacagtctgagagtcgaggacacggccatatattactgtgacggaagcgggtaattggtgggcggtgctggcttatgactacgtggggaccagggtaaccctggtactaccgtctccgtcacgcctaccaccgacggccactcgacgtccttccccgtcggcctaccctccctaccgaacgcgccacccgtcgtcggggccacgacggccgtacccgtgggctcggccgtcggtacgaacggtaccttaccgttaccggacgttacgtaaccgcgtacggacggccgggtactgggaaccgagggccgagtacg

SEQ ID NO: 250295 - DNA, 760 bp, Homo sapiens
  misc_feature: GYAE6OF01D931V.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgcaaggctccgaggggaaggggctagaatgggtctcaagtatcaacaagcagtagtagtaccgcagtggtacgcagacctcgtaggaacgggtccgtttacacctatcctccagacgacaattaccaaagaacacgtctgtatttgacaaatgaactagtctaggagagtcggaggaccacggcctaatatattacgtgtggacgtaaggcgggtaattgggtgggcggtgacgtgtacgttagtagtactacggtcggggaccgtaacggacccgttggtaccaccgtcctcctcgaccgccctacccgaacccgacgggtcccctacggttcccgtccccgtttcccccgtcgggaccccttacccccgttaccccgtacccgaaacggtacccgtaccccgtacccggtttccgggtaccgggggaccctaacccgggtaccggtcccccggggtccccgttacggggtccgttacccgggtccggttaccgggttaaccgtaaaccgggttaaccctttaacccggttccgggtaaacgttaccgtaaccgacggttacgggaccgggtccgggtacgtaccggggacggaagggtcccggacgtaggtacg

SEQ ID NO: 250296 - DNA, 593 bp, Homo sapiens
  misc_feature: GYAE6OF01BMGKS.16.37.D04.1.454.CMB.1.raw
  modified_base (585)..(585): a, c, t, g, unknown or other
  misc_feature (585)..(585): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatcctccagagacaattccaaagaacacgctgtatttgcaaatgaacagtctgagagtcgaggacacggccatatattactgtgcgaagcgggaattgggtggcggtgactgcttatgactagtgggccagggaccctggtccaccgtctcctcacgtccctccaccaacgggccccagttcccggtccttccccctcggcccaccctccctccaacgacgccaccgtcgtcggggcaccgacgccggcccgtgggccgttcgcccgttgggtaccgaacggtaccttaccgttaccggacgttacgtaccacgtcggacggcgggtaccgtgggaccgaagggccncgagtacg

SEQ ID NO: 250297 - DNA, 637 bp, Homo sapiens
  misc_feature: GYAE6OF01CDTVZ.16.37.D04.1.454.CMB.1.raw
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (629)..(629): a, c, t, g, unknown or other
  misc_feature (629)..(629): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgcatggtacgcagacctccgtgaacgggtccgtttcaccatctccagacgacaattccaagaacacgctgtatttgacaaatgaacngtctagagagtcgagacgacggccatatattacngtgacgaaggcgggtaattgggtcggcggtgactgcttagtgactacgtcggggaccaacgggaaccctggtaccaccgttcctccctacgacgtcccctacccgaacccgaccgggacccctacgttcccgggttccctttcccccgtcggcccctaccccctccctacccgaaacgccgtacctaacccgtcgggtacggggccaccgcggtacccgggcccgttgggcctcgccgttcggaccgaaggtacctaccgttccgagtacgtacacgtcggacggcgggcgtcgggacgagggcncgagtacg

SEQ ID NO: 250298 - DNA, 564 bp, Homo sapiens
  misc_feature: GYAE6OF01BUPTL.16.37.D04.1.454.CMB.1.raw
  modified_base (334)..(334): a, c, t, g, unknown or other
  misc_feature (334)..(334): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagacacgctgtatttgcaaatgaacagtctgagagtcgaggacacggccatatattactgtgcgaagcgggaattggnggcggtgactgctatgactacgtgggccagggaccctgggtcaccgtctcctcacgcctccaccgaacgggccccacgtcccggtccttcccccgtcggccctacccctccctacccaacgacgccaccgtcgtcggggcacgacgccggccctgggctcgccgtggtcgaaggtacctacgtccgtagtacgtacacgtgacgcgggctcggacgaaggcgcgagtacg

SEQ ID NO: 250299 - DNA, 587 bp, Homo sapiens
  misc_feature: GYAE6OF01E26EF.16.37.D04.1.454.CMB.1.raw
  modified_base (548)..(548): a, c, t, g, unknown or other
  misc_feature (548)..(548): n is a, c, g, or t
  modified_base (581)..(581): a, c, t, g, unknown or other
  misc_feature (581)..(581): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccatggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaaccctggtcaccgtctcctcacgcctccaccgaacgggccctagtccggtccttcccccgtcggcccaccctccctcccgaagacgccaccctcgtcggggccaccgacggccgggtcccgtgggcctcggtcccgtggtccaagggtaccctaccgttcccggaagttagtaaccncgtggacggccgggtctagggaccaacgggccncgtaag

SEQ ID NO: 250300 - DNA, 556 bp, Homo sapiens
  misc_feature: GYAE6OF01EVEFB.16.37.D04.1.454.CMB.1.raw
  modified_base (550)..(550): a, c, t, g, unknown or other
  misc_feature (550)..(550): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgacaaatgaacagtctgagagtcgaggacacggccatatattactgtgcgaagcgggaattgggtggcggtgactgctattgactacgtgggccaggaaccctggtccaccgtctctcacgcctccaccaggcccagtccgtccttccccctgcccaccctcctcccaagacgccacctcgtcggggcacgacggccgcccgtgggctcgccgtcggtcgaaggtacctaacgttccgacgttacgtacacgtggacgcgggcgtcggacaaggcncgagag

SEQ ID NO: 250301 - DNA, 536 bp, Homo sapiens
  misc_feature: GYAE6OF01BCKER.16.37.D04.1.454.CMB.1.raw
  modified_base (360)..(360): a, c, t, g, unknown or other
  misc_feature (360)..(360): n is a, c, g, or t
  modified_base (429)..(429): a, c, t, g, unknown or other
  misc_feature (429)..(429): n is a, c, g, or t
tcagtgtactactccacgaccggtgctcgatttagtagcatactgtgggtttgggggagacttggtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaaatgaacagtctgagagtcgaggacacggccatatattactgtgcgaagcgggaaattggtggcggtgactgctattgactacngggccagggaaccctggtcaccgtctcctcagcctcaccaagggcccatcggctcccctgcaccctccnccagacgcacctcgtcgggcacacgccgccgtggctcgcctggacaaggacctaccgttccgagtacgtacacgtggacggccggcgtcggacgaaggcgcgtagag

SEQ ID NO: 250302 - DNA, 662 bp, Homo sapiens
  misc_feature: GYAE6OF01DOAQ0.16.37.D04.1.454.CMB.1.raw
  modified_base (521)..(521): a, c, t, g, unknown or other
  misc_feature (521)..(521): n is a, c, g, or t
  modified_base (643)..(643): a, c, t, g, unknown or other
  misc_feature (643)..(643): n is a, c, g, or t
tcagtgtactactccacgaccggtgctcgatttagtagcatactgtgggtttgggggagacttagtacaggccgggggggtccctgagactctcctgtgcagcctctggattcacctttagtgcctatgccatgagcgtgggtcccgccgaggctccgaggggaaggggtctaagaagtgggtctacaagtatcaacaagcagtaagtagtaccacatggtacgcagacctccggtagaacgggtcctttcaccattccaccaagacgacaacttccaaagaccacgtcttgttatttcgaacaaagtagaactgtctagagtaggtcggagaccgacgacattaatattacgtggtcgagaaggcgggtaattgggtacgggcggtgacgtcggtactatttacgacgttacggtcggggacccgtaacgggtaacccgtcgggtacctacccggtccttcccgtacgaccgcccctaaccaacccggaacggtcccacggttcccgttccgtaccccgngcccctaccctcctaaccgaagtacgcctaccggtccggtcgggctaacgccggccgtcccggtggcctacgcgtacggtacgaacggtctacgtacgtagtactacgagcggacgcgggtntcgggacaggtcagtgacg

SEQ ID NO: 250303 - DNA, 928 bp, Homo sapiens
  misc_feature: GYAE6OF01A6RZI.16.37.D04.1.454.CMB.1.raw
  modified_base (420)..(420): a, c, t, g, unknown or other
  misc_feature (420)..(420): n is a, c, g, or t
  modified_base (869)..(869): a, c, t, g, unknown or other
  misc_feature (869)..(869): n is a, c, g, or t
  modified_base (921)..(921): a, c, t, g, unknown or other
  misc_feature (921)..(921): n is a, c, g, or t
tcagtgtactactccacgaccggtgctcgattttagtagcatactgtgggtttgggggagacttagtacagccggggggtccctgagactctcctgtgcagcctctgggtactaccttacgtttgcgtaccttagtcgacagtaggcgtcgggttccgggcccaccggacggtcccgtacgggaaaggggggacgggtagtaaaggtagggttcgggttcctaaggtaacgttacaccaagacgagtaaggtagtaaccgtaccgataggttacggaccgacgaacgtccgtttacgggaacgggtaaccgggttttcccttaaccaactacgttccgacgaagaacgaacttaaccgaacgaaacgaaccgtcgtacggtttatttaagttacgaaacgtaagtaacgaaacgttcggngtaaggacggttaacggacggaaccggaccggtaacctactaagttaactttagttcgtaggaacggaacggtagggtaaggtttagggtgggtacggtacgggtaactaccggttagttaacgtttaggtaccgtaaccggtaccggggtacgggaaccggttaaacccgggtacggtttcgtacccccgttacgtttccccgtacgttaaccgaccccggtaccccgttaaccggaacccgggtaccccggtacccgtttccggttccccccgttacccgttccccgaccgtacccccttcccgtaacccgtaacgaaccggtccctaccggtacccgtcggggtaacccgacgtaacccggggccgttccccggccgggttcgtccgtccggttacccgtacggaaccggtaaccgttacggttacccgttaacgacggttaaacnccggttaggaccgggcgggtaccgacgggtaccgaaacggtacggcctaagnggtaccg

SEQ ID NO: 250304 - DNA, 631 bp, Homo sapiens
  misc_feature: GYAE6OF01CJ2EJ.16.37.D04.1.454.CMB.1.raw
  modified_base (205)..(205): a, c, t, g, unknown or other
  misc_feature (205)..(205): n is a, c, g, or t
  modified_base (626)..(627): a, c, t, g, unknown or other
  misc_feature (626)..(627): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgnatggtacgcagacctccgtgaacgggtccgtttcaccatctaccagacgaacaattaccaagaacacgtctgttaattgacaaaatgaacagtctgagagtcgagacacgcatatatactgtgacgaagcgggaattggtaggcggtgactgacttagttaggacctacgggtcggggtaccgaacgggtaacccgtgggtaccaacccggttcctacccgtcacgtccctaacccgaaccggaacgggcccctacgttcccggttcccttccccgtcgccccacccctcctaccgaacgcgacgtcccgtcggtacggggcctaaccgacggcccggcccgtcgggcctcggtaccgtcggtacgaacgtactaccgtaccgtagtacgtacacgtgacggccggactcggaacgagcgnngtac

SEQ ID NO: 250305 - DNA, 678 bp, Homo sapiens
  misc_feature: GYAE6OF01ADH75.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccggtgaaggccgtttcaccatctccagagacaattccaagaacacgctgtatttgacaaatgaacagtctgagagtcgaggacacggaccatatattactgtgcgaaggcgggtaagttgggtacggcggtagaccgtgtcttagttcgaccgtacggtcgggggacccaaggggtaacccctcgggtacccacccggttccgtcccgtccgacgacccctacccgaaccgaaccgggacccctacgttcccggttcccttcccccgtcggacccctacccctcccgtacccgaacgacgcccgacccgtcggtcgggccgaccgaccgggtcccggtcccgtcgggacctccggtcccgttacgggtaccgaacggtaccgttaccgttacccggtacggttacgtacgtacgtcgggaccgggtcgggcgttacgggcgaaacggcggacctagtcg

SEQ ID NO: 250306 - DNA, 621 bp, Homo sapiens
  misc_feature: GYAE6OF01A5GTM.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagatgggtctcaagtatcacaagcagtagtagtaccgcatggtacgcagactccgtagaagggccgtttcaccatcctcagagacaattccaagaacacgctgtatttgacaatagaacagtctgagagtacgaggacacggcatactattactgtagcgaagcgggaagttggtaggcggtgactgcttatgacgtagtcgggacgacgggtaaccctggtcgaccgtctccgtcacgcctacccgaccgaccggcccgtacgttcccggtcccttccccgtaccgtccctacccctacctacccgaagaccgaccaccgtcggtcggggccacgacggccggtacccgtcgggcctcggtccgtacggtaccgaacgtaccgtaccgtccggtaacggtacgtaccgacgttcgggacggccgggtacgtcgggacgaacggcgacgtagtacgg

SEQ ID NO: 250307 - DNA, 590 bp, Homo sapiens
  misc_feature: GYAE6OF01BZ2AW.16.37.D04.1.454.CMB.1.raw
  modified_base (561)..(561): a, c, t, g, unknown or other
  misc_feature (561)..(561): n is a, c, g, or t
  modified_base (586)..(586): a, c, t, g, unknown or other
  misc_feature (586)..(586): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaaccacgctgtatttgacaaatgaacagtctgagagtcgaggacacggcatatattactgtgacgaagcgggtaattgggtggcggtgacgtgctatgactacgtggggccagggaaccctggtaccaccgtcctcctcacgtccctaccgaccgaacggggcccctagtcccggttcccttacccccgtggtcccctacccctccctacccaacgtacgccaacccgtcggtcgggggaccacgacggccggcccgtgggctcggccgtggtcgaacggtctaccgttccgagtacgtacncgtggacggcggctgggacaaggcngatg

SEQ ID NO: 250308 - DNA, 590 bp, Homo sapiens
  misc_feature: GYAE6OF01CG6N8.16.37.D04.1.454.CMB.1.raw
  modified_base (318)..(318): a, c, t, g, unknown or other
  misc_feature (318)..(318): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatactattacngtgacgaagcgggaattggtggcggtgactgctattgactacgtggggccacgggaaccctgggtcaccgttctcctcacgccctaccgaccgaacgggccctacgtcccggttccttcccccgtggcccacccctccgtaccaacgcgcctaccgtcgtcgggggtcacgacggccggcccgtcgggctacggccgtcggtacgaacggtcgtacctccggaggttacgtactacgtggacggcgggcgtcgggacgaagggcgcagtacg

SEQ ID NO: 250309 - DNA, 792 bp, Homo sapiens
  misc_feature: GYAE6OF01CNY1U.16.37.D04.1.454.CMB.1.raw
  modified_base (786)..(786): a, c, t, g, unknown or other
  misc_feature (786)..(786): n is a, c, g, or t
tcagtgtactactccacgaccggtgctcgatttagtagcatactgtgggtttgggggagacttagtacaggccgggggggtccctgagactctcctgtgcagcctctggattcacctttagtgcctatgccatgagcgtgggtccgccaggctcgagggaagggctagatgggtctacaagtatcacaagcaggtagtacgtaccgctagtgggaacgcagaccgtccggtaggaaacggggtccctttacacctattcctaccgaaggaacgtaacctaaacttacccgaaaaggaaaccacggtcttaggttaattttcggaactaaaagttcggaaactaggttcgaaggacggtaacggtacggaacggaaccgaccggtacctaagtttaacttaaagtttacgttgggtacggaaccgggaaaaagggtccgggggttaaaagttttggggacggggtccgggttaactaaccgttgggtaccttaaagtttcgggaaccgttaacggcggggggaaccctaaacgggggtaacccctggggttaacccaacccggttcttacccgtacgacccgtaccctacccgaaacccggaaccggggtccccacggttcccggttcccctcccgttaccggccctaacccctccgtaacgaacggacgccctaccgtgggccgggacaaccggcgccggacccgtgggctcgaaccgtggaacacgtcctacgttcgaacgtcgtaccgacgtggaccggtcgggtacgacggacgacggcctanaggtag

SEQ ID NO: 250310 - DNA, 614 bp, Homo sapiens
  misc_feature: GYAE6OF01B0R3H.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctcagagacaattccaagaacacgctgtatttgacaaatgaacagtctgagagtcgaggacacggccatatattactgtgcgaagcgggaattggtggcggtagacgtgactattcgactacgtcgggaccgacgggtaaccctggtcctaccgtctccgtcacgccctccaccgacggccctacgtccggtccttcccccgtcgcccctaccccgtccctcccgaaacgcgacccgtacccgtcggtaccggggacaccgaccggcccgggtccccgtacggggccgtcggccgttacggtaccgaacggtaccttaccgtcccggtagtacgtacacggtcgaggccggacgtggaccgaaggcgcgtgtag

SEQ ID NO: 250311 - DNA, 849 bp, Homo sapiens
  misc_feature: GYAE6OF01C4EHQ.16.37.D04.1.454.CMB.1.raw
  modified_base (222)..(222): a, c, t, g, unknown or other
  misc_feature (222)..(222): n is a, c, g, or t
  modified_base (278)..(278): a, c, t, g, unknown or other
  misc_feature (278)..(278): n is a, c, g, or t
tcagtgtactactccacgaccggtgctcgatttagtagcatactgtgggtttgggggagacttagtacagccgggggggtccctgagactctcctgtgcacgcctctggattctacctttagtcgcctatgccatgagcgtgggtacgccaggctccgaggggaaggggctagaagtgggtctacaagtatcaacaagcagtagtacgtaccgcatggtacncgagacctccggtagaacgggtccttcaccatctccagacactaatccaaacgacncgtcttagttatttgactaaagtgaactagtcgtagacgagtacggaacggacgaccggacctaattaacttacgttacgtacggtacggaacggaacgggtacggggtaagtttcgggtcggggtaccgggttacgtacggttcgttcgtttaaagtttaccggtaaccggttaacgggggtcccggggaacccgggtaaccggggttaaccccggtttccgggtaccccgttaccccggtttcccttacccccgtacgtaaccccgtcccgtaaccccgtaacccgggtaacccgggtaccccctaccggtttcccccgggttacccctttcccccggtacggacccccttacccccgtacccgtacccgaaaccgtacccgtaccccgtacccggttacggggaccggggaccctaacccgggccgggtccccggtcccggttccgggtaccctccggtaccggtaccggtaaccgtaaccgggtaccttacccgttaccggtagttacccggtacgcggttacggaccgggccggttcggacgggtaacccgagggcctgaacggtg

SEQ ID NO: 250312 - DNA, 875 bp, Homo sapiens
  misc_feature: GYAE6OF01ESQQT.16.37.D04.1.454.CMB.1.raw
  modified_base (211)..(211): a, c, t, g, unknown or other
  misc_feature (211)..(211): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaggggctagaatgggtctcaagtatcacaagcagtagtagtaccgcatggtacncagactccgtgaagggtccgtttcaccatctccagacgactaattccaagaacacgctagttatttgactaaatgaacagtctaggagtaggtacgacggacaccggccaagttattacgttactggtggacggaacggcggggtaatttgggtggtcggtagactgtccttaagttcgaaccgttacgggtcggggaccccgtaacggggtaacccccttgggtacccctacccggttccttaccccgtaccgtaacccgtccccttaacccccgaaccccggtaacccggggtacccccctaacggtttcccccgggtttacccccccgtttacccccccggttaccgggacccccccttaacccccccgtttacccgttaacccccggaaacgggtaccccgtaccccgttaaccccggttacccggggtaccggggggaccccaacccggtaccggggtcccccgggtccccccgggtttacgggggccccctttaccgggtccccgtttacggggaacccggtaaaccgggttaacccctttaaccccggttacccgggtaacggtttacccggtaacccgtaccgggttcgggtaaccgggtcccggggtaccggtaccggggaaccggtaaccggggacccgtaacgtagtaaccgg

SEQ ID NO: 250313 - DNA, 795 bp, Homo sapiens
  misc_feature: GYAE6OF01DL997.16.37.D04.1.454.CMB.1.raw
  modified_base (265)..(265): a, c, t, g, unknown or other
  misc_feature (265)..(265): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaagggctagaatgggtctcaagtatcacaagcagtagtagtaccgcatggtacgcagactccggtagaacggccgtttcaccatctccagagacaattccaagaacncgctgtatttgacaactgaaacagtctaggaagtaggtcggaggaacctaccgggactaagtacttaattacgtgttacggacggaaacggtacggggtaaagtttgggtacgggtccgggtagtacgttcgtaccgtttagtttcgaaccgttacgggtcggggaacccgtaacggggtaccccgtggggtaccctacccggtttccttaccccgttagaacccgtcccgtaaccccaacccgggaacgggtaccccctaaccggtttcccccgttaccccgttccccccggttacggaccccccgttaaccccgtccctaacccgaaccggtacccggtcccgtaaccccgttcccgggtaacccggggggaccctaacccgaccggggtacccccggtcccgggtccggggtaccgttccgtacccgttacggttaccgaacggttacccgtaccgttcccggtaacgtacgttaaccaccggtggacccgggccgggtcgtacgggacaacgggcgtacgagtacg

SEQ ID NO: 250314 - DNA, 636 bp, Homo sapiens
  misc_feature: GYAE6OF01B67RP.16.37.D04.1.454.CMB.1.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
  modified_base (629)..(629): a, c, t, g, unknown or other
  misc_feature (629)..(629): n is a, c, g, or t
tcagtgtactactccacgaccggtgctcgatttagtagcatactgtgggtttgggggagacttagtacaggccgggggggtccctgagactctcctgtgcagcctctggattcaccttttagtgcctatgccatgagctgggtccgccaggctccgaggggaaggggctaagaagtgggtctacaagtancaacaagcagtagtagtaccgnagtggacgcagtactccgtagaacgggtcctttacaccatccacagatacaactccaaagaccacggcttagtatttcgaacaaatagaacagtctaggagtagngaacggacacgtaccaatatattactggacacgaacggtgggtaatttgggaggcggtnaacgtgtactaattggaacctacggtcgggaccaacgggtaaccttggacccacgttctccgacacgcctacaaccgacggaccctacgtaccgttcccttccccgtacggcctacccctccaccgaacgacgccaccgtcggcggggaccacgacgaccggcccgtacggcctcgccgtacgtacgaaccgtaacctaccgttaaccgaggttacgaccgacggttcgacgggcggtacgcggacgaggacngtagacg

SEQ ID NO: 250315 - DNA, 714 bp, Homo sapiens
  misc_feature: GYAE6OF01B6KHO.16.37.D04.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (705)..(705): a, c, t, g, unknown or other
  misc_feature (705)..(705): n is a, c, g, or t
tcagtgtactactccacgaccggtgctcgatttagtagcatactgttggggtttgggggagacttagtaccagcccgggggggtccctgacgactcttcctgtgcagcctctggattcacctttagtgcctatgccatgagcgtgggtccgccaggcttccaggggaagggctagaatgggtactcaagtatcacaagcagtagtagtaccgnagtgggtacncagacctccggtaggaacggtcctttcacctatcctccgaggacgactaattacccaagaacctacggcttagttattttgactaaatgaactgtcctagagacggtacgaaggacgacggacattagtacgttactgtagacgaagtcgggaagttgggaggacggtgacgtgtactagttacggactaggtcggggaccacgggtaaccctggtacctaccggttctccctacgtaccgtacccctaccgaacccggtaacgggacccctacggttccccggttaccctttcccccgaggtacccctaccccgtacccgtaacccgaagaccgacccctaccgttacgggtcggggaccaacgtccgggtacccggtccgtacgggccttacggcccgtagggtaccaacgggtaccttaccggttacggacgttaccgtacgacgttacgggacggtccgggacgtcggaccgaggccncgtaagtcg

SEQ ID NO: 250316 - DNA, 647 bp, Homo sapiens
  misc_feature: GYAE6OF01DCWEH.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagacctccgtgaacgggtcccgtttcaccatcctaccagagacaattccaaagaacacgctgtaatttgacaaatgaacagtctgagagtcgaggacacggcatatattactgtgcgaaggcgggtaagttggtaggcggtagctgtacttagtgaccgttagtcggggccgaacgggaaccccgtggtacctaccggtctccgtcaccgtcctacccaccgaacgggcccctacgttccggtcccttcccccgtcggcccaccccgttccctaccaacgtaccgcctaacccgttccggtcggggccaccgacgggcccggcccgtgggtcctcgggtcctaggtaaccgaacgggtacttaccggttaccgtaaggtacgttacctcgtacggacgggccgggcgtcgggtacgaaacggtcgacgtgtacg

SEQ ID NO: 250317 - DNA, 816 bp, Homo sapiens
  misc_feature: GYAE6OF01BVUPR.16.37.D04.1.454.CMB.1.raw
  modified_base (185)..(185): a, c, t, g, unknown or other
  misc_feature (185)..(185): n is a, c, g, or t
  modified_base (207)..(207): a, c, t, g, unknown or other
  misc_feature (207)..(207): n is a, c, g, or t
  modified_base (281)..(281): a, c, t, g, unknown or other
  misc_feature (281)..(281): n is a, c, g, or t
  modified_base (419)..(419): a, c, t, g, unknown or other
  misc_feature (419)..(419): n is a, c, g, or t
tcagtgtactactccacgaccggtgctcgatttagtagcatactgtgggtttgggggagacttagtacagccgggggggtcctgagactctcctggtgcagcctctggattcacctttagtgcctatgccatgagcgtgggtccgccgaggctccgaggggaagggctagaatgggtctcaagtntcacaagcagtagtagtaccgnatggtacgcagtacctcggtaggaacgggtcctttcacctatccgaccagacgaactaacttaccaaagaaccncgtcttagttactttaggaactaaagtacgaactaggttactaggaaggtacggtacggaaggaccgacggacctaagtaattacgttacggagtcggaacggaagggtcgggttaagttcggggacgggtcgggtanacgtcgtacttaaggtcgtaaccggttacgggtccggggaaccggtaaccgggtaaccgtcggtaacctaccgttcctacccgtagacccgcccttaaccgaaacccgggtacgggtcccctacgggtttccccggtttacccccgttaccccggacgtacccccttaacccccgttcccgaaaccgaacgtacccgtcctaaccccggttggggacccgggcccaacggccccggggcccgttaccgggccggttaccgtccggtacccggtaggaaccgtaccgggttaaacccctttccggtacggttaaacggttaaccctaccggtacgggtacgggtcccgggaccgggtttacgaacccgggttaacgaacgggccctaaacggtagacg

SEQ ID NO: 250318 - DNA, 640 bp, Homo sapiens
  misc_feature: GYAE6OF01CN51G.16.37.D04.1.454.CMB.1.raw
  modified_base (184)..(184): a, c, t, g, unknown or other
  misc_feature (184)..(184): n is a, c, g, or t
  modified_base (214)..(214): a, c, t, g, unknown or other
  misc_feature (214)..(214): n is a, c, g, or t
  modified_base (352)..(352): a, c, t, g, unknown or other
  misc_feature (352)..(352): n is a, c, g, or t
  modified_base (635)..(635): a, c, t, g, unknown or other
  misc_feature (635)..(635): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgaggggaaggggctagaatgggtctcaagtntcacaagcagtagtagtaccgcatggtacncaggacctccgtagaagggtcctttcaccatcctccagacgaactaacttccaaagaacacgtctgttatttgacaaatgaacagtctgagagtcgagacacgcatactatactgtgacgagcgggtattgggtaggnggtagacgtgtactattcgacgtacggtggggccaacgggtaccctcggacctaccgtcctacctacgacgtccctacccgaacgaccgggtaccctacgttccccggttccttcccccggtcggaccctacccctccctaccgaaacgccgaccctacccgtcggtacggggacccacggacggtccgggcccgttcgggcctccgggccgttcggacgtaacggtacctaccgttaccgagtacgtacacgtcgggacggcggcgtacgggacacggggcngagtg

SEQ ID NO: 250319 - DNA, 718 bp, Homo sapiens
  misc_feature: GYAE6OF01EUJS3.16.37.D04.1.454.CMB.1.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
tcagtgtactactccacgaccggtgctcgatttagtagcatactgtgggtttgggggagacttagtacaggccgggggggtccctgagactctcctgtgcagcctctggattcacctttagtgcctatgccatgagcgtgggtccgccaggcctccgagggaaggggctagagtgggtctcaagtatcaacgaagcaagtagtacgtaccgcatggtacncagactccgtgaacgggccgttcacctatcnccagacgacaacttccaagaacacgctgttatttgcaaagtgaacagtctaggacgaggtcgaacggacgacggtcctaatactattacgtcggtgacgaaggacgggtaagttggtggcggtgactggcttagtcgacctaacggtgggacccgaacgggtaacccgtgggtcccaacccggttccttacccgtcgaccgtaccctaccccgacccgtaaccgggcccccgttaacgttccccgggttaccccttaccccccggttcggtacccctaccccgtccccgttacccaaaccggacgtaccccgtacccggtaccggtccggggaccctaccggaaccggcccgggtacccgtcgggtccgtcggtacccgtcggtaccgaaccggtaccgttaccgtaccggtaacggtaccgttacacggtcggacggacggcgtacggacgaggtcgagtacgtag

SEQ ID NO: 250320 - DNA, 701 bp, Homo sapiens
  misc_feature: GYAE6OF01DHXP7.16.37.D04.1.454.CMB.1.raw
  modified_base (145)..(145): a, c, t, g, unknown or other
  misc_feature (145)..(145): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccnccaggctccgaggggaaggggctagaagtgggtctacaagtatcacaagctaagtagtacgtaccgctagtggtacgctagacgtccgaggaacgggtcctttcaccatcctccagacacaattaccaagacaccgtcttagttattcgataaatgaaactgtcgtagagagtacggagacgccgactatattatacgtgtgacggaagtcgggtaattggtacggcggtagacttggattacgttgactacgggcgggtccgaagggtacccttggtaccctaccggttacctcccgttacgaccgttcccgtaacccctaaccggaaacccggtcccctaacgggttccccgttttacccccgttcccccgtaccggaccctaccccctccgtaacccgaacgtacgcccgtaccgtccgggtaccggacgacgaccggccggtcccgtagggtccgtcggtacccgtcggtaaccgtaacgggttcccttaccgtacgtaccggttacgtacacgttcgggaacgtcggacgcgtaacgcgctacgtagtacg

SEQ ID NO: 250321 - DNA, 971 bp, Homo sapiens
  misc_feature: GYAE6OF01EAUF6.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagcgtgggtccgccaggctccgagggaaggggctagaagtgggtctacaagtatcaacaagcagtagtacgtaccgcatggtacgcagacctccggtaggaacgggtcccgtttacacctatcctaccgaagacgaactaacttaccgaaacgtaaccgacgtccttagttagttttacgaactaaaagtacgtaaacctacggttacgtaggtaaggtacggttacggaacggaaccgtaaccgggtacccttaaagtttaacgttttaacgtttaaccggttagggttacgggaacgggtaaacgggtaccggggttaaagggttttcgggggtacggggaccgggtttacggtaaccgttcggtaacgtttaacgttacgggtaaccgttaccgggtaccgggggtacccgtaaccggggtaccccgttacgggtacccgtacccggttcccttaacccgtaccgacccgtccccgtacccgtaaaccccggtaaccggggtccccctaaccggtttccccggtttaccccctttccccccggtaccgggtacccccctaaccccgttacccccgtaaaccgtaaaccggtacccgaccccgttacccggttaccgggggtccggggaaccctaacccgggtaccgggtcccccgggtaccccgggttacggggtacccgttacccgggttaccccgggttacgggtaaacccggtaaccgggttaacccgttaccccggttaacgggtaacggtttaacccggtaccgtaacgggttcgggaaccggggtccgggtacccgtacgggaacggaacgggtccgtaacgtacgtagg

SEQ ID NO: 250322 - DNA, 601 bp, Homo sapiens
  misc_feature: GYAE6OF01C4YUB.16.37.D04.1.454.CMB.1.raw
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
  modified_base (461)..(461): a, c, t, g, unknown or other
  misc_feature (461)..(461): n is a, c, g, or t
  modified_base (571)..(571): a, c, t, g, unknown or other
  misc_feature (571)..(571): n is a, c, g, or t
  modified_base (584)..(584): a, c, t, g, unknown or other
  misc_feature (584)..(584): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccgaggggaaggggctagaatgggtctcaagtatcacaagcagtagtagtaccgcatggtacgcagactccggtgaacgggtccgtttcaccatcctccagagaacaattaccaagaacacgctgtatttgacaaatgaacagtctgagagtcgaggacacgcatatattacngtgacgaagcgggtaattgggnggcgtgactgctattgactacggtgggccgaacgggaccctggtaccacccgttctccctcgacgtccctacccgaaccggaaccgggccccacgttcccgttcccttccccgngcccctaccctcccgtaccaacgacgccaccgtcggtcggggccaacgcggcccggccgtgggcctcgccgtaggtaccgaacggtacctaccgtccggaagtacgtacncgtagacggcggntcgggacaggcngntag

SEQ ID NO: 250323 - DNA, 1023 bp, Homo sapiens
  misc_feature: GYAE6OF01BLVTN.16.37.D04.1.454.CMB.1.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
tcagtgtactactccacgaccggtgctcgatttagtagcatactgtgggtttgggggagacttagtacaggccgggggggtccctgagactctcctgtgcagcctctggattctaccttttagtcgcctatgccagtgagcgtcgggtcccgccgaggcctccggaaggggaacggggctaaggaagtgggtctacgaagtactcaacaagctaagtacgtacgtaccgnagtcggacgcagtaccgtccggtaggaaccgggtcctttcaacctcttccaccgaagacgaactaactaccaaagaacacgtnttacgttattacgaactaaatacgaaactcgtacgtaggaggtacgtacggaacgaccgacggaccttaagttacttaacttacggtaggtaccggaacgggtaaacgggtacgggttaacggtttcggggtacgggtccggttaacgtacggttacggttaacgtttaaggttaccggtaacccggttaccggggtacccggggggaaaccccttaaccgggggttaaccccgtttcgggtaaaccccgttaccccggtttccttaaccccggaccggtaaccccgttaccccgtaaccccggaaacccgggtacccgggttacccccgttaacccggtttacccccgggtttccccccgttacccccgggtacccggtacccccccttaacccccgttacccgtaaaaccccgggtaaccggtaccccggttaaccccggttaccccgggtttccgggggtaacccggggaccccgtaaaccccgggttacccggggtccccccggggttacccgggttcccggggtcccgtttacccggggtaaccccgggttacgggttaaaccccggtaaacccgggtttaacccggttaacccggttaacccggttaacgggttaacccgttaaaccggtccgggttacgggggaaccggtacccgggtaccgggtaacggtaacgggaacccggtggtaaacccgtaggacgg

SEQ ID NO: 250324 - DNA, 787 bp, Homo sapiens
  misc_feature: GYAE6OF01EOXR2.16.37.D04.1.454.CMB.1.raw
  modified_base (304)..(304): a, c, t, g, unknown or other
  misc_feature (304)..(304): n is a, c, g, or t
tcagtgtactactccacgaccggtgctcgatttagtagcatactgtgggtttgggggagacttagtacagccgggggggtccctgagactctcctgtgcagcctctggtattctacctttagtcgccttatgccatggagcgtgggtccgccgaggcctcgaggggaagggctagagtgggtctcaagtatcacgaagcagtagtacgtaccgctagtggtacgcagtaccgtccggtaggaacgggtccgttttaccaacctattcctaccgaaggtacgaactaacttaccgaaaagaaccncggtcttacggttaatttggaactaaagtcgaaactcggttctaggaggtacgtacggaacggaaccgtaccggcctaagttaactacgtttacgtggtacggacgtaagggcggttaaagtttcgggtacgggcggttagaaccgttggtacttagttacggacgtttacggacgggggtacccaacggggtaacccttcggggtacctaccggtcctaccgtacgaccgtccctacccggaaccgtaccgggccctacggttccccggttcccttaccccggcggacccctaccccgttcctacgaacgtccgacctccgtcgggtccgggacacgtaccggacccgtacccggtggtaccgtcgtccggtacgggttaaccacgggttaccgtttaccggtaccgtagtttaaacggtacacggttaccggacgggtccgggtaccgtacgggaacgaaccgggtctaacggtgtacggg

SEQ ID NO: 250325 - DNA, 864 bp, Homo sapiens
  misc_feature: GYAE6OF01CUB60.16.37.D04.1.454.CMB.1.raw
tcagtgtactactccacgaccggtgctcgatttagtagcatactgtgggtttgggggagacttggtacaggcccggggggggtccctgagactctcctgtgcagcctctggattcacctttagtgcctatcgccatgagcgtgggtccgccgaggctccgaggggaggggctaggaatgggtctacaagtatcaacaagcaggtagtacgtacccgcagtggtacgcaggacctccggtaggaacgggtcccgtttaccaacctatcctccaagacgaacctaacttaccaaagaaccaacggcttaggttaatttagaacctaaaagtacgaaacgtaagtcgtaaggaaggtaggtaccggaaggaccgaaccggacctaattaattaacttaacgtggtacggaaccgggaagggtacggggttaaaggttggggtacggggtcgggttagacgtggtacgttaagtttcggaaccgttaccgggtcgggggaacccgaacggggtaacccttcggggtacctaacccggtccttacccgtacgaccgtacccctacccgaaccgaacccggggtcccctaacggttccccggttaccccgttcccccggtaccggtacccccttacccctacccgttacccgaaacggacccgtcccgttaacccggtccgggtaccgggggacctaacccggccggggtccccgggtacccggtcggggtcccttccgggaccccggtttacgggaaccggtaacccgggtaccctttaccggttacccggtaacggtaaaccgtacggtaccgtacgggacggggtcccgggacgtaccggggaacgtacgggaccgccgaagtacgg

SEQ ID NO: 250326 - DNA, 957 bp, Homo sapiens
  misc_feature: GYAE6OF01B9105.16.37.D04.1.454.CMB.1.raw
tcagtgtactactccacgaccggtgctcgatttagtagcatactgtgggtttgggggagacttagtacagcccgggggggtccctgagactctcctgtgcagcctctggattcacctttagtgcctatgccatgagctgggtccgccaggctccgaggggaaggggctaagaagtgggtctcaagtatcaacaagcagtagtagtaccgcagtggtacgcagactccgtgaaggccgtttacaccatctccagagacaattaccaagaaccacgtcttagttaagtttacgaactaaaaagtacggaaaacctaggttacctaggtaacggaagggttaccgggaaagggaacccgaaccgggaccctaagtttaacttaaactttaaccgtgggttaggaccggaaaagggtccgggggtaaaagttttgggggtacgggtccgggttagtaaccgttggtaacctttaagtttacggaaccgttaacgggtccggggggaacccgtaaacgggggtaaacccctttggggtaccctaaccccggttcccttacccgtacccgtaccgtacccccgttaccccgaaaccccggaaacccggggtcccccgtaaacccgggtttccccgggttacccccccgttttaccccccccggtacgggtaccccccttaaccccccgttacccccgttaaccccgaaaccggtaacccgtaccccgtaacccccgttcccggggttaccggggggacccaaaccccgggaccgggtacccccggggtcccccggtacggggtacccgttccgggtaccccggtttacgggtaacccggtaaacggttaccccgttaacccgtttaaccccggtaacggttaaccggttaaacgtaaccggttacgggaaccgggcccgggggtacgtaccggggacccgtaacgggaccggtcgagtaacgg

SEQ ID NO: 250327 - DNA, 673 bp, Homo sapiens
  misc_feature: GYAE6OF01CFKIF.16.37.D04.1.454.CMB.1.raw
  modified_base (358)..(358): a, c, t, g, unknown or other
  misc_feature (358)..(358): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacattccaagaacacgctgtatttgactaaatgtaacagttcgtagaggaggtacggaggaccgaccggaccataactattacgtggtgacggaaggcgggtaattgggnggcggtagactgctagttcgtactacgtggggaccgaacgggtacccgtggtcctaccggtcctccctacgacggtcccctacccgaacccgtaacgggccccctagttcccggttacccctttcccccgtcggtcccctacccctccctacccgtaacgaccgtcctaacccgtcggtcgggggacccacgaccgggcccggcccgtacgggcctccgtccgtcgggtaccgtaaacggtccgtaaccgttaccgtacgtacgtaccgaacgttcggacggtaccggggtcgcggtacgagggccgagtgtagg

SEQ ID NO: 250328 - DNA, 761 bp, Homo sapiens
  misc_feature: GYAE6OF01CIT5V.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccgaggggaagggctagaatgggtctcaagtatcacaagcagtagtacgtaccgcagtggtacgcgagacctccggtaggaacggggtccctttcacctatcctaccaggacgaactaacttaccaaagaaccacgtacttaggttattttcggactaaaagtgaaaccagtcgtaggagtaggtacggaacggaaccacggacctaattattacttacgtggtcggacggaagggacgggtaagttcgggtcgggtcggtgtacgtcgtacttagttcggaacgttacgggtcggggaccgtaacggggtaacccgtggtaccctacccggtcctaccgtccgacgtccccgtaccgaaccgaaccgggtacccctacggttccccggtttaccccttccccggtcgggtaccccctaccccgtaccccgttaaccgaaccggtactaccccgtaccggtccgggtacgggggaccaaccggtacgggccccgggtaccgggtcgggtccgtaccgtcccggtacggaaccgtaacggtaccttaccggtacgtacgtaacgtacacggtgacgggtcggtcggtcgggaacgtcggacgtcgagtcg

SEQ ID NO: 250329 - DNA, 685 bp, Homo sapiens
  misc_feature: GYAE6OF01DMF5X.16.37.D04.1.454.CMB.1.raw
  modified_base (181)..(181): a, c, t, g, unknown or other
  misc_feature (181)..(181): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagaatgggtctcaagtntcacaagcagtagtagtaccgcatggtacgcagacctccgtgaacgggcctttcacctatctccagagacattaccaagaacacgctgtatttgacaaatcgaacagtctagagagtcgagacacgcatatattacngtgngaagcggaatggtggagtgactgactagtacgactacggngggtacccagggtaacccctggtaccacccggttctcccttacgacgccctacccacccgaacgggaccctacgtcccggttcccttcccccgtcggcccctaccctccctaccccgaacgacgaccctacccgtcggtcggggaccaaccgcggtacccgggtccccgtcggggtcccgtacggtcccggttacgggtaacccggtaaaccggtacccgttacccgttacccgggtaacgttaaaccggtaacccgtaccggttcgggaacggggtcccgggtacggttacgggacggaacggggaacccgcgtaacggtag

SEQ ID NO: 250330 - DNA, 821 bp, Homo sapiens
  misc_feature: GYAE6OF01EKSFJ.16.37.D04.1.454.CMB.1.raw
  modified_base (361)..(361): a, c, t, g, unknown or other
  misc_feature (361)..(361): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgcatggtacgcagacctcgtgaacgggtccgtttcaccatcaccagacgacaattccaaagaacacgctagttatttgacaaaatgaaacagtctagacggagtacgaggaccaccggcctaagtatattcgtagtgacgaaggcgggtaagttgggnggtcggtagtacgtgcttaagttcgaccttacggtacgggacccgtaacggggtaaccccttggaccgtacccggtccttacccgtccgacgtcccgtacccgaacccgaaccggggtacccctacggttcccggttacccctttcccccccgtcgggtacccccgtaaccccccgtttccccgtaacccgtaaacgtaaccggccccgtaacccgttaccggggtacgggggacccgaacccggaccggggtacccccgggtccccgggttccggggcccggttacccggaccccggtttacggggtaacccgtaaaccggggttaaccccgtttaaccggttacccccggtaaacgggtttaccggttaacccgtaacccggttccggggaccggtaccccgggggtcggtacccggggtaacggaaaccggggtacccgaaccggtaagtaaccggg

SEQ ID NO: 250331 - DNA, 607 bp, Homo sapiens
  misc_feature: GYAE6OF01ESE2K.16.37.D04.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (406)..(406): a, c, t, g, unknown or other
  misc_feature (406)..(406): n is a, c, g, or t
  modified_base (601)..(601): a, c, t, g, unknown or other
  misc_feature (601)..(601): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagaatgggtctcaagtatcacaagcagtagtagtaccgnatggtacgcagactccgtgaacgggtcctttcaccatcctccaagagactaattccaaagaactacgcttagtatttgacaaatgaacngtctagagacgtacgaggacacggcaattatattactgtgacgaagtcgggaattggnggcgtgactgacttatgactacgcgggaccaggtaaccctggtaccaccgtctccnctaccgcctaccgaaccgaacggtccctacgtccggttcccttccccgtcggccctaccctccgtaccaacgacgcctaccgtcgacgggactacgacgccggccgtcggccgtcgtccgttacggtacgaacggtaccttaccgttacgtaacgtacgtacacgtggacggcgggacgtcgggacgaaggcganagtacg

SEQ ID NO: 250332 - DNA, 1008 bp, Homo sapiens
  misc_feature: GYAE6OF01CK1D9.16.37.D04.1.454.CMB.1.raw
  modified_base (973)..(973): a, c, t, g, unknown or other
  misc_feature (973)..(973): n is a, c, g, or t
tcagtgtactactccacgaccggtgctcgatttagtagcatactgtgggtttgggggagacttagtacaggccgggggggtccctgagactctcctgtgcagcctctggattcacctttagtgcctatgaccatggagcgtcgggtccgccgaggctccggaaggggaaggggctaagaagtgggtctacgaagtatacacagctaggtagtacgtaccgctagtacggtccacgagtaacccgtccggtaggaacgggtccgttttaccaacctacttcctaccgaaggtaactaacctaaaccgttaccgaaaggaaacctagtccgtttagttaagtttacggaacctaaaaagttcgaaaaccgtaggttaccgaggaaggtacggtacgggtaacgggaacccggaaccgggtacctaaagtttaatttaaccgtttaacgttgggtaaccggaacggtaaaacggacccggtaacccgggtacttaaacgggtttacccgaacccttaaacccccgttaatttaaacccgttttacggttttaacgggaacccgtttaacggggtacccggggaacccggtaaacccggggttacccgttcgggtaaaccccttcccgttaccctccgttaccgaccgtcccccgttaacccgaaccccggtaaccggggtacccttacccggtccccggtttaaccccccgttttccccgccgggttaaccccttaccccccgtaacgtaacccggtaacggtacccgtaccccgtaaccggttcccgggggtacgggaccctaacccgggacccggggtcccccgggttacccggtacggggttccgtaccccggttaccggggtacggttaacccgggtaccgggttaaaccccctttagggttaacccggttaaaccgggttaccgtaaccccgggtaagggttccccggggaaccgggtcccggggtaaacncccggggaaaaccggcggttaccggacgtaacgtg

SEQ ID NO: 250333 - DNA, 878 bp, Homo sapiens
  misc_feature: GYAE6OF01C9W8Y.16.37.D04.1.454.CMB.1.raw
  modified_base (147)..(147): a, c, t, g, unknown or other
  misc_feature (147)..(147): n is a, c, g, or t
  modified_base (221)..(221): a, c, t, g, unknown or other
  misc_feature (221)..(221): n is a, c, g, or t
  modified_base (268)..(268): a, c, t, g, unknown or other
  misc_feature (268)..(268): n is a, c, g, or t
tcagtgtactactccacgaccggtgctcgatttagtagcatactgtgggtttgggggagacttagtacaggccggggggtccctgagactctcctgtgcagcctctggattcctacctttagtgcctatgccatgagcgtcgggccnccgaggcctaccggaaggggaagggctaggaagtgggtcctacgaagtatacacaagcgagtagtacgtaccgngagttggacgacaggcctacggtaggaacgggtcctttacaaccgtnttccaccgagacgtaactaactaccgaaagacctacgcgttagttagttacgaacttaaagacgaactagtcgtacgaaggtacgtacggaacggtaaccaccggtcctaatattacgttacgaggtacggacggtaaggtacgggtacgttagggcggggtaccgttaagaccgttagtaacgttacgttacgtaaccggttaagggtccggggaaacctaacgggtaacccgtttccgaaccgtaccccgttacctaccgtacggtaaccccgtcccgtacccgaaccggtaccggaccccgttacgttccccggttcccttacccccggtacggtacccctacccgttaccccgtaacgtaaccgtacccggtacccctaaccgggtttacccgggaccggggtaaccctaaccgggtacccgggtacccccgggtccgttaccggggacccgttaccggggtaccgtaccgggttaaacggtaaacccgggttacccgttaaacccgtaaccgggttacgggtaaaccgttaccggtaaccggttacgggccgggtttaaccccgggagtaacccggggacgttaacggggtacccaggtagacgg

SEQ ID NO: 250334 - DNA, 802 bp, Homo sapiens
  misc_feature: GYAE6OF01A5WVQ.16.37.D04.1.454.CMB.1.raw
  modified_base (121)..(121): a, c, t, g, unknown or other
  misc_feature (121)..(121): n is a, c, g, or t
  modified_base (762)..(762): a, c, t, g, unknown or other
  misc_feature (762)..(762): n is a, c, g, or t
tcagtgtactactccacgaccggtgctcgatttagtagcatactgtgggtttgggggagacttagtacagccgggggggtccctgagactctcctgtgcagcctctggattcacctttagngcctatgccatgagcgtgggtccgccaggctccgaggggaagggctagtaatgggtctcaagtatcgaacaagcagttagtacgtaccgcagtcgggtacgcagtacctcgtaggaacggggtcctttaccgactacgttcctaccgaagacgaacctaacgttacccgaaaaggaaccctaccgtcgttacggtttaacgttttacgaaccttaaaagtacgaaactacggtttacctaggaacggtacggtacggaacggacgaccggtcctaatacttagtttacgtgtacgggacgtaagggacgggttaagtttggggtacgggtcggtagaccggttagtacttacgtacggtacgttacggtaccggggtaaccacggggtacccgttcggtacccgttcccgttaccgtcccttacgacccgtaccctaccggaacccggtaccggtcccctagggtttccccgttcccgttacccgcggtacccctaccccgtaccctaaccggacgtacccgcccgttacccgggacgggtcgggaaccctaggcccggtccccgggtcggttaccggtccggtcccgtacggtacggtacccggacggttaccttacccggtagtaacggttaccgtacncgggtgaccgggtcccgtaggcgaggtacggcctgaagcg

SEQ ID NO: 250335 - DNA, 812 bp, Homo sapiens
  misc_feature: GYAE6OF01AJD4D.16.37.D04.1.454.CMB.1.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
tcagtgtactactccacgaccggtgctcgatttagtagcatactgtgggtttgggggagacttagtacagccgggggggtccctgagactctcctgtgcagcctctggattccacctttagtgcctatgccatgagctggggtcccgccaggctccgaggggaaggggctagatgggtctacaagtancacaagcagtagtacgtaccgnagtggtacgnagtacctccggtgaacgggtccttcaccatccnccagagactaatccaaagaaccacgctagttatttgactaaatacgaacagtctagagacgtacgaggaccgacggaccatacttagttactggtgtacggaaggcgggtaagttgggtagggtcggtagactggtacttagttacgacgttaccggtcggggacccggtaaccggggtaaccccgttcggttacccgtaccccggttaccttccccgtaccgaacccgtccccttacccggaaacccggaaccggggtaccccctaccgtttcccccgggttaccccctttaccccccggtccgggtacccccctaccccccgttacccctaaccccgtaaacggaccccgtacccgtaacccggtttcccgggggtaccgggggtacccacccggggtaacccgggtcccggggtacccccgggttcgggcccgtttccgggtccccgttacggggtaaccgtaacggtaccccggtttaccgttaccggtaacggttaaccggtactacggtcggacggggtccgggtccgtagggaccggacggtcgactgacgg

SEQ ID NO: 250336 - DNA, 825 bp, Homo sapiens
  misc_feature: GYAE6OF01C9X65.16.37.D04.1.454.CMB.1.raw
  modified_base (824)..(824): a, c, t, g, unknown or other
  misc_feature (824)..(824): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggcctccgaggggaaggggctaagaagtgggtctacaagtatcaacaagcagtagtagtaccgcagtggtacgcagactccggtaggaacggggtcctttcaaccattcctaccagacgaactaacttaccaaagaaccacgtctagttatttgactaaagtagaactagtctagaggaggtacggacggaccgtacggcctattattattacgtggtacgacggaagggtacgggtaagttcggggtagggccggtagacgttcgtacttagtttacgacgttacggcggggacccgaacgggtacccgttcggtacccgtacccgttccttacccgtaccgacccgtaccccgtaccccgaacccgggtaacccggggtcccccttaacggttcccccggtttcccccgttaccccccgtacggtacccccctacccccgttaccctaacccggaaacgtacccgaccccgttaaccccggttccggggtacggggacccctaaccggccgggtccccgggtacccggtggggtccctccggttacccggtagggtaacccgaaaccgggttccgtttaaccccgttacggtaacgggttaaccgtaaccgtacgggtggggaaccccgggtccggggtacgtcgggaaccggtaacggcccggtaataacggng

SEQ ID NO: 250337 - DNA, 726 bp, Homo sapiens
  misc_feature: GYAE6OF01AEW1W.16.37.D04.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagaatgggtctcaagtatcacaagcagtagtagtaccgnagtggtacgcagactcgngaggccttcacatcncagagacaatccaagaacacgctgtatttgacaatgaacagtctagagagtacgacggaccgaccggccaatattacttacgtggtgacggaaggtacgggtaagttgggtggtccggtgacttgacttagttcggactacggtcggggacctaacgggaccctggtaccgtaccgtcctccctcaccgtccctaccgacccgacggccctacgtcccggttcccttccccgcgtcccacccctcctaccgaacgcgtccctaccggtcgggtaccggggtacccacggaccgggtcccggtccccgggttcggggtcccgttcggtacccgttacggggttaaacccgaaacccggttccggtttaaaccccgttaccgggtaaacggtttaacccggtacccgtaaaccgggttcgggaacccggggttacccgggggccgttaagggggaacccccggtaacgggccgtaacggtaaggtacccggg

SEQ ID NO: 250338 - DNA, 769 bp, Homo sapiens
  misc_feature: GYAE6OF01ATHD6.16.37.D04.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
tcagtgtactactccacgaccggtgctcgatttagtagcatactgtgggtttggggggaggacttagtacagccggtcggggtcccctgagactctcctgtgcagcctcgtggattcacctttagtcgcctatcgccatgagcctgggtccgccaggcctccgaggggaaggggctagaagtgggtctacaagtatcacaagcagtagtacgaccnagtggacgcaggactccggtaggaagggtcctttcaccatcncgagagacaacttaccaagaacacgtcttgttatttagacaaaatcgaanagtcagagatcgaggacacgtcatatacttacgngagacgaagtaccgggggtaatttgggaggtcccgggtgtaacctggactttagtcgtaccgttaacgngggggacccaacggggtttacccncggggtttaaccaccgttccgtccccttagacccggtaccctacccgaaccgaaacccggggtacccctaggtttaccccgggttccctttaccccccggttcgggaccccttaaccccccttcccgggtacccaaaacgggacaccccttaacccggttcgggtacgggggccaaccggttccggaccccgggccccgtttaaggggccccttaggccccggtttaggaccggaaaacggtccttaacccgttacccgggtgttaaacggttaccaaacgttcgggaacgggttcccggggtagttcccgggaaagacggaccgcggtttaaa

SEQ ID NO: 250339 - DNA, 904 bp, Homo sapiens
  misc_feature: GYAE6OF01A3PUI.16.37.D04.1.454.CMB.1.raw
  modified_base (211)..(211): a, c, t, g, unknown or other
  misc_feature (211)..(211): n is a, c, g, or t
tcagtgtactactccacgaccggtgctcgatttagtagcatactgtgggtttgggggagacttagtacagccgggggggtcctgagactctcctgtgcagcctctggattccacctttagtgcctatcgccatgagcgtgggtccgccaggctccgagggagggctagagtggtactacgaagtatacacgaagcgagtagtacgtaccgntagtggtacgcagacctcggtagaacggtcctttacacctagtcctaccgaagacgactaacgttaccgaaagaaccgacgtacttagttaagttttacggaacctaaaagtacgaaaccgtaggttaccgtaggaacggtacgtacgggacggaaccgaccggaccttaagttaacttacgttacgtaggtacggacggtaagggcgggttaaggtttcgggtacgggtacggttacggtaaccgttcgtacgttaacgttgtaacccgttacggggtaccgggggtaaccctaaccggggggtaacccttcgggtacccgtaccccggtttacctacccgttaccgtacccggtaccccgttaacccggaacccggtaaccggggtacccctaccggttaccccggtttccccgttacccccgttccggaccccttaacccccgtcccgtaacccgtaaaccggtacccgtacccggtaccccggtacggtaccggggtacccaacccggtaccgggtccccggtacccgggtttcgggcccgttaccgggtacccggttaccgggttaacccggtaaacgggttacccgttaacccggttaacggtaaccgggttaacgttaccggtaaccgggttacgggacggggtccgggtacggtacgggtaaccggaccgggaactgtaacggtg

SEQ ID NO: 250340 - DNA, 647 bp, Homo sapiens
  misc_feature: GYAE6OF01BLDL5.16.37.D04.1.454.CMB.1.raw
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
  modified_base (344)..(344): a, c, t, g, unknown or other
  misc_feature (344)..(344): n is a, c, g, or t
  modified_base (394)..(394): a, c, t, g, unknown or other
  misc_feature (394)..(394): n is a, c, g, or t
  modified_base (445)..(445): a, c, t, g, unknown or other
  misc_feature (445)..(445): n is a, c, g, or t
  modified_base (474)..(474): a, c, t, g, unknown or other
  misc_feature (474)..(474): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtcgggtccgccaggcctccgaggggaaggggctagaatgggtctacaagtatcaacaagcagtagtacgtaccgcatcggtacgcagacctccgtggacgggtccttcaccatcctcaganacaacttccaagacncgctagtattgacaatgaacngtctagagagtcgaggacacggcatatatctgtgacgagcggtattgggngcgtgactgactatcgactcggcgggaccacggacctggtcacccgttcncgtacacgtccctacgaccgaacggccctacgttcccgtacccttccccgnggaccctaccccgtctaccgaaggtaccncctacccggtcgggtccgggacaccggtaccgggcccggtacccggttgggcctcgtcccggttacggtaccgggaaaccggtaccgttaccggttaccggtaacggtacggttaacctacggttacgggacgggtaccgggcgttacggaccgaagggtccgacgagtacgg

SEQ ID NO: 250341 - DNA, 661 bp, Homo sapiens
  misc_feature: GYAE6OF01CPU56.16.37.D04.1.454.CMB.1.raw
  modified_base (185)..(185): a, c, t, g, unknown or other
  misc_feature (185)..(185): n is a, c, g, or t
  modified_base (267)..(267): a, c, t, g, unknown or other
  misc_feature (267)..(267): n is a, c, g, or t
  modified_base (297)..(297): a, c, t, g, unknown or other
  misc_feature (297)..(297): n is a, c, g, or t
  modified_base (655)..(655): a, c, t, g, unknown or other
  misc_feature (655)..(655): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggcctccgaggggaaggggctagaatgggtctcaagtntcacaagcagtagtagtaccgcatggtacgcagacctccgtgaacgggtcctttcaccatctccagagactaatcaagaacncgctgtattgacaaatgaacagtctagagngtcgagacgacggctatatattactgtcgcgaaggcgggtaattgggcggtcggtcacgtgtacttagttgaccgtacgggtcggggaccgtaacggggtaacccctggtacccacccggttcctccgtaccgacgtcccctacccgaaccgaacccgggtccccgtacgttcccggttcccttcccccggtccggacccctaccccgtacccgtacccgaacgccgtacccacccggttcggaccggggccaccgaccggcccggcccgtgggtcctcggtccgtcggtacgacgtaccgtaccgttacgacgtaccgtactacggtcggacggtcgggccgtacggacgaggacgngagtag

SEQ ID NO: 250342 - DNA, 845 bp, Homo sapiens
  misc_feature: GYAE6OF01AUO12.16.37.D04.1.454.CMB.1.raw
tcagtgtactactccacgaccggtgctcgatttagtagcatactgtgggtttgggggagacttagtacaggccgggggggtccctgagactctcctgtgcagcctctggattctacctttagtgcctatgccatgagcgtcgggtccgccaggcctcgaggggaaggggctagaatgggtctacaagtatcacaagcaagtagtacgtaccgcagtacggtacgcagtacccgttccggtaggaaccggggttccgtttaccaacctacttcctccaagtacgaacctaacttaccaaagaaacctacgtctagttatttacggaactaaacgtagaaacgtacgtacttagacggtacggtacggaacggaccgacggacctaattaacttaacgtttactggtaggacgggtaagggtacgggtaaggtttggggtacgggtcggttacggtacgttcgtacgtttaagttacgaaccgttaccgggtccggggaacccggtaaccgggggtaacccttcgggtacccgtacccgttcccgttaccctccgtacccgcccgttaccccggaaaccccggaaccggtaccccgtaccggtttccccggttccccgttcccccggtaccgtaccccgtacccctaccccgtaaccgaaaccgtccgtacccgtacccgttacccggggtccgggaccgtacccggaaccggtccccgggtcccgggtaccgggtccgtccggtcccggtacggtaccgtaacggtaccttaccgtaccggtacgtacccgtacgtacggtacggacgggtcccggcggtacggaccggaggcgtacgtacggtag

SEQ ID NO: 250343 - DNA, 575 bp, Homo sapiens
  misc_feature: GYAE6OF01EEM5Z.16.37.D04.1.454.CMB.1.raw
  modified_base (337)..(337): a, c, t, g, unknown or other
  misc_feature (337)..(337): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgtagactccgtgaagggccgtttcaccatctccagagacaattccaagaacacgctgtatttgcaaatgaacagtctgagagtcgaggacacggccatatattactgtgcgaagcgggaattgggnggcggtgactgctattgactacgtgggggcccaaggggaacccctgggtccaccgtctcctcacgccctccaccaacgggcccacgtccggtccttccccctcggcctacccctccctacccaacgacgccaccctcgtcgggggaccacgacggccggcccgtgggctcggcctggtcaacggacttacttccgagtacgtacatgaggcgggctcgggacaacggacgacagtagc

SEQ ID NO: 250344 - DNA, 977 bp, Homo sapiens
  misc_feature: GYAE6OF01D1LHG.16.37.D04.1.454.CMB.1.raw
tcagtgtactactccacgaccggtgctcgatttagtagcatactgtggggtttgggggagacttagtacaggccgggggggtccctgagactctcctgtgcagcctctggattcctacctttagtgcctatgccatggagtcgtcgggtccgccgacgggtcctaccggaaggggggaacgggggacttaaggtaaagttcgggggtaccttaacgaaaggttaactaccgaaaccgaaggtaccgtaaaggtttaacgggttaaccggtaacccggactacggttacggggttaaccgacgtaacggtaccgttacccgggttagggaaaaccgggggtttccccttttaccaaacccgttacttacccgtaccgaagggtaacctaaacctaaacctttaaacccgaaaaacggaaccgtaaccggtaccgtttaaggtttacgttacggaaactaaagtacgtaacgtagtacgtagtaagacggtacgacggacgaccggactattaattagtcgtagtacggacggtaagggtacggttaaggttcggggtacgggtcgggtacggacgttcggtaacgtttaacgtttaccgggtaacgttaaccgggggtaccggggaccggtaaccggggtaaccgtttccgggaccctaacggtttcccctacgtacccgtaccggtacccgaacccgtaacccggaccggtccccgttaaccgttccccggttacccgttccccggtacccggttaccccctacccttccgaacccgaaccgtacggtacccgtacccggtcgggtacccgggacgacccgggtaccggccccggttacgggtccggtaccgtcggtacccggtacggttaacccggaccgttaaccggttaccgtaaccgggtacgttaaccggtaccggtacggcggtaccgggtccgaacggggtcccgtaacggaccgggtactagcgttacg

SEQ ID NO: 250345 - DNA, 809 bp, Homo sapiens
  misc_feature: GYAE6OF01BUIZ9.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatcgccatgagctgggtccgccaggctccgagggaagggctagaatgggtctcaagtatacacaagcagtagtagtaccgctagtgacgcagacctccgtggaagggtccgttcacctatcctccagacgactaactaccaagaacacgctagtatttcgactaaatacgaactagtcgtaggagacggtcggaacggaaccacgggacctaattacgttaactttaacgtggtacggacggtaaagggacggggttaaagttttcggggtacgggtacgggtacggtacgttcggtacctttaacggttacggtaacctaaccggggttacgggggacccgtaacccgggggttaaccccgttcgggtaaccccgtaccccgtttcccgttaccccgtccgacccgtaccccgtaccccgaaacccggtacccggggaccccttacccgggttccccggttccccgtttccccccgttacgggacccccttaccccgtacccctaaccgaacggaccgtacccctacccgggttacggtccgggggacccgacccgtaccgggccccggtacccgtccgggcgttacccggtcgtacgggtacgaacgtaccgttaccgtaacgtacgtaacgtacgacgttcggacggccgggtacgcggaccggtaggccgacgtggtacg

SEQ ID NO: 250346 - DNA, 941 bp, Homo sapiens
  misc_feature: GYAE6OF01A71CV.16.37.D04.1.454.CMB.1.raw
tcagtgtactactccacgaccggtgctcgatttagtagcatactgtgggtttgggggagacttagtacagccggggggggtccctgagactctcctgtgcagcctctggattcacctttagtgcctatgccatgagctggggtccgccaggctccgaggggaagggggctagaagtgggtctcaagtatcacaagcagtagtagtaccgcagtggtaacgcagacctccggtaggaacggggtccgtttaccaccactcctccaagacgacaacttaccaaagaaccacgcttgtatttgacaaatagaaactagtcgtagagacgtacggacggacacgggaccaattaattattaacgtggtaggacggtaaagggtacggggtaagtttggggtacgggtcgggtacggtaccgttaggttacctttaaggtttacgtaaacccgggtttaacggggtccggggggtaaccccgtaaaacccgggggggttaaaccccccgtttcggggttaacccccgttaacccccggtttaccccgttttccccgtacccgttaacccggtaccccccgttaacccccgaaaccccggggtaaaccccggggtcccccgtaacccgggtttacccccgggttcccccctttcccccccgggttacccggcccccgtttaaccccccctaccccgttaacccgtaaaccggaacccggtccccgtaaccccggtttaccggggtacccgggggtacccaacccgggtaccgggtcccccgggtccccgggttccggggtccggtaccgggttcccggttaccgggtaaccggtaacccggtaacccgtttacccggtaacccgggttaacggttaaccggttaaccgtaccgggtaggaccgggtaccggggttacgtaccgggacggtacgcggacgtagtacgg

SEQ ID NO: 250347 - DNA, 681 bp, Homo sapiens
  misc_feature: GYAE6OF01C8K3J.16.37.D04.1.454.CMB.1.raw
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgaggggaaggggctagaagtgggtctcgaagtatcacaagcagtagtagtaccgcatggtacgcagaccttccgtggaagggcccgtttcacctatcctccagagactaattaccaagacacgctntatttgacaaatgaacagtctagagngtcgagaccacgccatatattactgtgcgaagcggtaagtggtagggcgtgactgtctattcgactacgtcgggacgacgggtaaccctgtaccaccgtcctcgtcacggccctaccgaccggaaccgggccctaggttcccggttccctttacccccgcgtacccccgacccctcccgttaaccgaacgacgtaccctaccccgtcgggtccggggacaaccgtcgggccccggtacccggtgggtcccgcggtccccgttgggtaaccgtaaaccgggtactaccccgtttccggtaaacgttaccggtaacctacggttacgggaacccgggtcggacggtacccggaacggttacggaccgtcgtaaggtac

SEQ ID NO: 250348 - DNA, 679 bp, Homo sapiens
  misc_feature: GYAE6OF01CI70V.16.37.D04.1.454.CMB.1.raw
  modified_base (215)..(215): a, c, t, g, unknown or other
  misc_feature (215)..(215): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggcctccgagggaagggctagaagtgggtctcaagtatcacaagcagtagtagtaccgctatggtacncaggacctccggtggaacggggtcccgttttacaaccctagttcctaccgaagaacgtaacctaacttacccaaagaccaccgcttagttatttgactaaatgaactagtcagagagtcggagacacggcatatattactgtgacgaggcggtagtgggtcggcgtagctgcttattcggacttacggcgggtaccgacggtacccgtggtccaccggttctcctcgacgccctccgaaccgaccggaccctacgttcccggtcccttcccccgtcggtcccctaccctcccgacctacgtacgccctccgtccggtacggggccctacgaccggcccggtacccgtcgggccgtcggtccgtcgggtaaccgtacggtacccttaccgttaccggtacgttaaccggtacctacggtcggtaccgggcgggtacggtcggaacggtacgacggcctaaggtcg

SEQ ID NO: 250349 - DNA, 583 bp, Homo sapiens
  misc_feature: GYAE6OF01C2E8K.16.37.D04.1.454.CMB.1.raw
  modified_base (349)..(349): a, c, t, g, unknown or other
  misc_feature (349)..(349): n is a, c, g, or t
  modified_base (476)..(476): a, c, t, g, unknown or other
  misc_feature (476)..(476): n is a, c, g, or t
tcagtgtactactccacgaccggtgctcgatttagtagcatactggtgggtttgggggagacttagtacaggccgggggggtccctgagactctcctgtgcagcctctggattcacctttagtgcctatgccatgagctgggtccgccaggctccgaggggaaggggctagaagtgggtctacaagtatcacaagcagtagtagtacccgcagtggtacgcagacctccgtgaacgggtcctttcaccatccgtcagagactaatccaagaccagctgtattgactaaaatgaacagtcagagagtcgaggacacggctatatatactgtgacgaagcgggaattgggnggcggtgactgactattgactcgtcgggcacgggacctggtcaccgtctcctacacgtccaccaccgacggtcccacgtcccggttcctaccccgtacggcccctaccctcccctaccgaacggtcncccctaccgttcgggcggggacaaccgtcggcccggtcccgtgggctcgccgtcgtacgaacgctacctcgaagtacgtacagcggagcggctcggacaggccatgc

SEQ ID NO: 250350 - DNA, 843 bp, Homo sapiens
  misc_feature: GYAE6OF01BPWK4.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtagaacgggtccgtttcaccatcctccagagaccaattccaaagaccacgctgtatttgacaatgaacgcctgagagccgaggacacggccgtatacttactgtcgcccggtagggtacgttttacgtatacgtaagttacttaacgtaggtttaaaccgaaaaaacggttcgttaaccgtttaggtaaccgttaacggtacggggtacccgtaaccgggggtaacccgttacgggtacctaaacccggttcccttcccttaaccgaccgtacccctccccgtaaacccgaaccggggtccccctaacggtaccccggtttccccgtttaccccccggttacgggtacccccggtcccccgtttacggacccttccccggtaacgggtaccgaccccgtaacccgtccccgaaaacggtaacccgtaacccgaccgggtacccccggggtccccggttacggggtacccgtaccgggtcccggttaaccgggtaccggtaaaccgggtaaccccgtttaacccgttaccggtaaacgttacggtaacccgtacggttacggaaaccggggttcccggggaccgtttacggggaacccggttaacgggcccgaaggtaaccgg

SEQ ID NO: 250351 - DNA, 924 bp, Homo sapiens
  misc_feature: GYAE6OF01BO3RT.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccgaggggaagggctagaagtgggtctcaagtatcaacaagcagtagtagtaccgcagtggtaccgcgacgaccttccggtaggaacgggtcccgttttcaaccctattcctacccgaagaacgaacctaaacgttacccgaaaagaaaccgaccgtccgttaggtttaattttacggaacctaaaaagttacgaaaaccgtagttaccgtaggaacggtacggtacggaacgggaccgaacccggacctaagttaagttaactttacgtaggtacggaacggaagggtacggggttaagtttcggggtacgggtcggtacgtacgttcgtacgttagttcggaaccgttacgggtccgggggacccgtaacggggtaaccccttgggtaccctacccgtccctccctaccgaccgtacccctacccgaacccggtaaccgggtaccccctacggttccccggttaccccgttcccccggtacgacccccttacccccttcccgtaacccgaacgtacccgacccgtacccggttccgggtaccggggaccaacccgggtaccgggtcccccgggtccccgggttacggggtcccgttaccgggtaccccggttacgggttaaacccgtaaaccgggttaacccctttaccccgggttaaccgggttaaccggttaacccggtttaaccgtaccgggttacccggggtacggggtaccccggggttacggtaacggggacccggtaaaccggggccgtaacccggtaagtaggg

SEQ ID NO: 250352 - DNA, 848 bp, Homo sapiens
  misc_feature: GYAE6OF01AEAA0.16.37.D04.1.454.CMB.1.raw
  modified_base (149)..(149): a, c, t, g, unknown or other
  misc_feature (149)..(149): n is a, c, g, or t
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (667)..(667): a, c, t, g, unknown or other
  misc_feature (667)..(667): n is a, c, g, or t
tcagtgtactactccacgaccggtgctcgatttagtagcatactgtgggtttgggggagacttagtacagccggggggtccctgagactctccgtgtgcgagcctctggatttcgaccttttagtgcctatgccatgagctgggtaccnccaggctaccgagggaacgggtctaagactgggtctccaagtntcacaagcagtacgtagtacccnagtcggtacgcaggtacctccggtaggaaacgggtccttttacaaccgtattcctaccgaagagtaaccctaaagttttacccgaaaaggaacctacggtcttacggttaacttttcggaacctaaaaggttcgaaaccgtaggttccgttaaggaacggtaaggttaccggaaacgggtaacccgtaccgggaccctaaagtttaaacgttaagttttaccggtaggtaccggaccggaaacgggtccgggttaaattttcggggcgggtaccggtttcgtaaccgttggttaccgtttaagttaccgggaacccgtttacgggtcgggggaccctaacggggtacccctcgggtacctaccggtctccgtacgaccgccctaccgaccgacggtcccacgttccggtcccttaccccggtcgtaccctacccttccgtaccgaacgtacnccgtacccgttcgggaccgggcctaaccggccggacccggtcccgtaccgggtcctacggtcccggttacggtaaccgtaaccgttaccgtttaacccggtaccggttaaacggtccgttaacaccggttgggaccgggtacgggtacgtaccgggtacgaaccggtccgaagtcggtacg

SEQ ID NO: 250353 - DNA, 759 bp, Homo sapiens
  misc_feature: GYAE6OF01EPXPT.16.37.D04.1.454.CMB.1.raw
  modified_base (181)..(181): a, c, t, g, unknown or other
  misc_feature (181)..(181): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggcctccgagggagggctagatgggtctcaagtntcacaagcagtagtacgtaccgcagtggtacgcagacctccggtaggaacggtccgtttcacctatctaccgagagacaattaccgaagacacgtctgtatttcgacaaatcgaactgtctagagacgtacggagaccacggcctaagttatacgttacgtgtgacggaaggtcgggtaagttcgggtacggtcgggtacacgtggtccttagttgtaaccgtaggtcggggaccgaacgggtaccccgttcgggtaccctaccggtccttaccgtccgtaccgtacccgtacccgaacccggtaacggggtcccctaacggttccccgttacccggtttcccccgtacgggacccctaccccgttaccctaccggtaacggaccgcccgtacccgtcccgggtacgggggacctaacgaccgggtcccggacccggggttccgggtaccgttcggaccggtttccgggtacggtaacggtaacccgttaccgttacccggtaacggttacccgtaacgtaccgtcggacgggtaccgggtccggtacggtacccggacggtacccggcgagtaccgg

SEQ ID NO: 250354 - DNA, 873 bp, Homo sapiens
  misc_feature: GYAE6OF01BKH5I.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaagtgggtctcaagtatcacaagcagtaggtagtaccgcatggtacgcaggacctccggtaggaacggggtcctttcaacctatccgtaccgaagacggactaaacttaccgaaacgtaacaaccgtcgttagttatttacggactaaagtcgaaacgtgttacctggaacgacggttcggaagggaacctaccgggacctaagttacttacttacgtggtacggacggaaacgggtacggggtaaggtttcggggttacgggacggggtttcggaaccttggttaccgtttaacgtttacgggacccgtttaacggggtaccgggggtacccgtaacgggggtaaacccccgttgggtacccctaacccggttccctaccctccgaacccgttcccgttaccccggaacccggtaaccgggtcccccttaaccggttccccggtttcccccgtttaccccgcggtaccccctaaccccgttccttaacccggaacgtacccgacccttcccgggtaccgggtcccgggggtaaccaacggtacccgggcccgggtaccgggtacgggtaccgttccgggacgttccggggtaacgaaaccgggtccgtttacccggttaccggaacggttaacgacccggtacgggtacggtcgggtacccggggtacggtacgggaaccggtaggacccggtgtaaggtccgg

SEQ ID NO: 250355 - DNA, 914 bp, Homo sapiens
  misc_feature: GYAE6OF01A262B.16.37.D04.1.454.CMB.1.raw
  modified_base (210)..(210): a, c, t, g, unknown or other
  misc_feature (210)..(210): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtcgggtccgccaggctccgaggggaagggctagaagtgggtctacaagtatcacaagcagtagtacgtaccgntagtggtacgcagaccgtccggtaggaacggggtccgtttccaacctactacctaccgaaggacgaactaaacttacccgaaagaaccgtacgtccttaggttacttttaggaactaaatagaaacctagtcgtaggaacggtacggtaccggaacgggaaccgtaccggtacctaagttaacgttaacgtttaaccggttggtacgggaaccgggtaaaggggtacggggttaaaggtttcgggggtacgggtacgggttacgtaccggttaggtacttaggttacggtaaccgttacggggtaccgggggaaccggtaaccggggtaaccccgttcgggtacccgtacccggtttccctaccctaccgtcccggtaccccgtaacccgtaacccgggtacccgggtaccccttaccgggtttccccccgtttacccccgttacccccggtcggtaaccccccttacccccggttacccgtaacccggaaaccggtacccgtcccgttacccgggttcggggtaccgggaccctaaaccggcccggggaccccggttccgggtacgggaccctttacgggacccggttacggtaacccggtaacggttacccgttacccgggttaccgttaacggtaccgttacccgacgggttacgggacgggaccggttacgaacgggaccgacggaccgtgtaacggtcg

SEQ ID NO: 250356 - DNA, 777 bp, Homo sapiens
  misc_feature: GYAE6OF01A3K4H.16.37.D04.1.454.CMB.1.raw
tcagtgtactactccacgaccggtgctcgatttagtagcatactgtgggtttgggggagacttagtacagccgggggggtccctgagactctcctgtgtagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagaacaattccaagaacacgctgtatttgacaaatgaactagtctagagagtcgaggacacggccatatattactgtgcgaagcgggtaattcgggtggcggtgactgtactagttgaccgttacggtcgggggacccgtaacggggaaccccgttgggtacccctaacccggttccttcccgtacgaccgtccccttaccccgaaccccgaaaccggggtccccctaacggttccccgggttacccctttcccccccgtaccgggtccccctaaccccccgttcccctaaccccgtaaaccggacccgacccgtaccccggttaccgggttccgggggggaccctaacccgggaccgggtccccggggtacccccggttcgggggtcccgtttacccgggtccccggttacggggtaacccgtaaaccgggtacccgtttaacccggttacccggtaaccggtttaacggtaccgtaacgttcggaccgggtccggggcgtacgggaccgaacgggaccgcgtagtagcg

SEQ ID NO: 250357 - DNA, 996 bp, Homo sapiens
  misc_feature: GYAE6OF01C7Y1C.16.37.D04.1.454.CMB.1.raw
  modified_base (504)..(504): a, c, t, g, unknown or other
  misc_feature (504)..(504): n is a, c, g, or t
tcagtgtactactccacgaccggtgctcgatttagtagcatactgtgggtttgggggagacttagtacaggcccgggggggtccctgagactctcctgtgcagcctctggattcacctttagtcgcctatcgccatggacgcgtcggggtcccgaccgaggtcctaccggaaggggggaaacgggggcttaaggaacgttcggggttcctacgtaaaggttactaccgaaccgaaaggacctaaggttaacggttaaccggtacccggcaacggttggggtaaccgaccgaacggtaacccgttacccggggtaagggaaacccggggggttcccccgttttaaccaaacccctagttccctacccaaaggaacgtaaccctaaacttaacccgaaagtaaccgacgtacgtttagttactttacggaactaaacgtacgaaaaccgtgttcgaggaacggtacggtaccggacggaccggaccgtacatttactacgttacgnggtagaacggtaaggtgggtaagttcggggcgggtacgggtagtactccgttatttacggttacggtaaccgttacggggtcgggggaaccccggaaacggttaacccggccggttaaccctaccccggtttaccctcccgtaccggtaccgtacccccgttaaccccggaaccccgggtaaccgggtaccccgtaccggtttcccccgttaccccctttccccggtacccggtccccccttaacccctaccccgtaacccgtaaacccggtaccggtaccccgttcccggttacccggggtccgggggtaccgaacccgggtaccgggtacccgggtccccgggtcgggttaccggttcggttacccggttacgggtaaccgtaaaccggttaaccgttacccggttacccggtaacggttaaccgtacccggacgggttacggaccggggtccggacgggttcggaaccggtaggacccgtagcggtaac

SEQ ID NO: 250358 - DNA, 837 bp, Homo sapiens
  misc_feature: GYAE6OF01E38XT.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggagggctagaatgggtctcaagtatcacaagcagtagtagtaccgcagtggtacgcagactccgtgaacgggtccgtttcaccatctccagacgacaacttaccaagaaccacgctagttatttgactaatagaacgtagtcgtaggacggacggtacggacggaccgaccggacctaattaacttactttacgtaggtacggacggtaacgggtacgggttaaggttgggtacgggtacggtacggtacgttcgtacttaagttacgtacgttacgggtaccggggtacccgtaaccgggtacccgttaccggtacccgtaacccgttccctcccgtaccgaccgtaccccgtacccgaacccgggtaacccgggtaccccgttaccgggttcccccggtttacccccgttaccccccggttacccggtaccccctaccccccttaccccgtaacccgtaaccggtaccccgtaccccgtacccggttcccggggtaccggggacccgaacccgggaccgggtccccgggtccccgggttcgggtccgttaccggttacccggttaccgggtaaccggtaaccgggtaaccgttacccggttaaccggtaacggttaccgtaacgtaccggtacgggaccgggtccgggacggtacgggacgacgggccgtcgtagtag

SEQ ID NO: 250359 - DNA, 777 bp, Homo sapiens
  misc_feature: GYAE6OF01C1OPH.16.37.D04.1.454.CMB.1.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
tcagtgtactactccacgaccggtgctcgatttagtagcatactgtgggttggggagacttagtacaggccggggggtccctgagactctcctgtgcagcctctggtattctaccttttgtcgcctatcgccatgacgtcgtcgggtccgaccgacggccgtaccggaagggggaaggggaccgttaaggaaggttcgggttacctacgaaagttacnccaaacgaagacgtaggtaagtacgaccgtntaaggtcggtacgagtacgtacgtaccgggtagtaacgggttcctttacaccgtactaccgtaccaaggtaacaaaccgttacgttaccgaaaacgacgtacgtcttagttacgttacgaactaaagttaacggaacgtgttaccgtagaacggtacggacgaacggtaacgaccgtaactagtttaacttacggtttacgaggacggtaaggaaggtacgggtaggtttgggaccgggtacgttcggacgtttacgtactaacggtcgtacgtacggggtccgacggtacggtaccgtcgtcccgtacgttaccgccctagcccttacccgacgaacggtaccgcccgttaccgtccgttcccgcccgtaccgaacccgtcccgtaccgacgacgacccgcctacggtcgggagcctccgaccgggtcccggtcgccgtacgtcgtccggtacgacgtaaccgttcgtaccttacggagtacaccggtagcgggtaccggcgttagacggacgaggacgttagagtc

SEQ ID NO: 250360 - DNA, 774 bp, Homo sapiens
  misc_feature: GYAE6OF01EBH1U.16.37.D04.1.454.CMB.1.raw
  modified_base (249)..(249): a, c, t, g, unknown or other
  misc_feature (249)..(249): n is a, c, g, or t
  modified_base (324)..(324): a, c, t, g, unknown or other
  misc_feature (324)..(324): n is a, c, g, or t
  modified_base (695)..(695): a, c, t, g, unknown or other
  misc_feature (695)..(695): n is a, c, g, or t
  modified_base (771)..(771): a, c, t, g, unknown or other
  misc_feature (771)..(771): n is a, c, g, or t
tcagtgtactactccacgaccggtgctcgatttagtagcatactgtgggtttgggggagacttagtacaggccgggggggtcctgagactctcctgtgcagcctcgtggtacttcctacctttagcgcctatcgccatggacgcgtcgggtcccgccgaggtcctaccgggaagggggaacggggtcttaaggaacggttcgggtacctacgaagtactacaacgacgtactagtacgttaacgaccgntagtcggtacgctaggccttacggtaggaacggttccttcacctagtccacgagtacaactaactacgaagaacngttctacgttattagaactaagacgtaacgtcgttcgaggacgtacggtaacggaacggaccgtaccggaattaacgttacgttaacgtttcggtggtacggaacgggttagggagggttaacggtttcggggacggtccggtacgtacgttagtaacgtttagtacgtacggttacggggaccggtaacccgacggggttacctccggtaccctaccgtcttccgtaccgacgtaccccacgaacggccggtaccgtccgttccccgtcctccccgacgtaccctccaccgtacgaccgcgttacccgcggtacgggaccgacgaccgccgggtcccgtacggttccggtccgcggtccgtaacccggtnaaccggttccttacggtacccggtagtaaccggtcacggtcgcggggtaccgaggtacgacggaggcctaacggtncgg

SEQ ID NO: 250361 - DNA, 682 bp, Homo sapiens
  misc_feature: GYAE6OF01CINUQ.16.37.D04.1.454.CMB.1.raw
  modified_base (674)..(674): a, c, t, g, unknown or other
  misc_feature (674)..(674): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccgagggaagggctagaagtgggtctcaagtatcacaagcagtagtagtaccgcatggtacgcaaggaccttccggtagaaacggggtcccgttttcaaccctatcctaccgaagagaaccaattaccgaagaaccacgcttgtatttgaactaaatagaacagtctagagagtcggaaggaccacggcctaattaagtacttacgtgtggacgaaggcggtaagttggtaggcggtgacgtgcgttattgaactacggtcgggccaacgggtaaccctggtacctaccgtcgtcctcgtaacgtccctacccgaccgaccggcccacgttcccggttcccttaccccgtcgtacccctaccccgttacccgtacccaacgacgcccgtcccgtccggtaccggggctaccgacggcccgggcccgtcgggcgtccggcgtacggtaccgaaacggtaccgttacgttaccgacgttagtaacctcggtcggacgggccggacgtcgggtacgacggtccgngtacgtag

SEQ ID NO: 250362 - DNA, 576 bp, Homo sapiens
  misc_feature: GYAE6OF01E3AG7.16.37.D04.1.454.CMB.1.raw
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattcaagacacgctgtatttgcaaatgaacagtctgagagtcgaggacacggccatatatttactgtcgacgaagcgggaattgggtggcggtgactgctatgactacgtgggccagggaccctggtcaccgtctcctcacgccctccaccgaacggcccacgtccgttcccttcccccgtcggacccacccctccctccaacgacgccaccgtcggtcggggcaccgacggccggcccgtgggcctcgtcccgtcggtacaacggtactaccgttccgtagtacgtacacgtcggacggccggcgtcggacagggcngngtacg

SEQ ID NO: 250363 - DNA, 811 bp, Homo sapiens
  misc_feature: GYAE6OF01BCA4A.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccgagggaagggctagaagtgggtctacaagtatcaacaagctaggtagtacgtaccgctagtggtaccgcaacggtaccgtccggtaggaacggggtccctttcaacctactccgtaccgaggaacgtaactaacttaccgaaagaaccacgtcttaggttactttgaacctaaaagtgaaactgtctaggagacgtacggaacggaccgtaccggacctaattagttactacgtggtacgaacggaagggtcgggtaagtttgggcggtacggtagacttagtacttagtacggtaccgttacgggtcggggtaaccgtaaccggggtaccccgttgggtacccctaacccggttccgttacccgtaccggaccgtcccccgtaacccgaacccggtaaccgggtccccctaacggttccccggttcccccgttaccccggcgtaccccctaacccccgttcccgaaacgtaacgggtcccctacccgtaacccggtcgggtacgggaacccctacgtaacccggggcccggtacccggttcgggccgtacccggtaccggttacggaccgtaacgtccgttacccggttacgaacggtactaccggtacggtcggaccgggtcgggccgttacggacggaaacgggctaagtcgag

SEQ ID NO: 250364 - DNA, 619 bp, Homo sapiens
  misc_feature: GYAE6OF01DVN5M.16.37.D04.1.454.CMB.1.raw
  modified_base (210)..(210): a, c, t, g, unknown or other
  misc_feature (210)..(210): n is a, c, g, or t
  modified_base (614)..(614): a, c, t, g, unknown or other
  misc_feature (614)..(614): n is a, c, g, or t
tcagtgtactactccacgaccggtgctcgatttagtagcatactgtgggtttgggggagacttagtacaggccgggggggtccctgagactctcctgtgcagcctctggattcacctttagtgcctatgccatgagctgggtccgccaggctaccgaggggaaggggctagaagtgggtctacaagtatcaacagcagtagtagtaccgnatggtacgcgagactccgtagaacgggtcccgtttcaccatcctccaaggacaacaacttaccaaagaccacgcttagtatttggaactaaagacgaacgagtctaggagagtcggaggacgacggacagtatattacgtgtgacggaggacggtaagttggagggcgtgacgtgtacttgtacgacctcgggtcgggaccgtaacgggtccctgggtcccacccgtccgtcctacgccgaccgtacccaacccggacggccctacgttcccgtcccttccccgcgccctaccctcctaccagccgctccgcggtcgggcaccgcgggccgtaccggtggctcgcgcgtacgacggtacctacgtacaggtactagacgtgacgggtcggcgtgggacgaagcngagtg

SEQ ID NO: 250365 - DNA, 962 bp, Homo sapiens
  misc_feature: GYAE6OF01AW89I.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatcgccatgagctcggggtccgccaggcctccgaggggaagggctagaatgggtctcaagtatcacaagcagtagtacgtaccgacagtcgggtacgcacgtacctccggtaggaacggggtccctttccaacctactcctacccgaggaacgaactaaacttacccgaaaagtaaccacggtcttaggttattttacggaccaaaagttcgaaactcggttactaggaacggacggtacgggaacggaaccgtaccggacctaattaacttaactttacgtaggtggacggaaacgggtacggggtaaaggtttgggggtcgggtaccgggtagtaaccggttcgtaccggtttaacgtttacgggaaacccgtttaccggggtccggggggtaacccgtaaaaccgggggtaccccgtttaccgggtacccgtacccccggtttccgttccccctacgtacccgtacccgttaccccgaaacccgggtaacccggggtacccccggtaaccggtttcccccggttccccgtttccccccggtaccgggtaccccctacccccggtttacccctaccgtaaaccggacccgtaccccgtacccggttccggggtaccgggggtcccaacccgggtacgggccccggggtaccccgggttggggtccccgttaccggtcccgggttaacggttacccggtaaacccgggtaacctttacccgggttaacccggtaacgggttaaccggttacccggtaaccgggttaccgggaacccgggggtcccggggtaccgggtacggggtaacccggaaacggggccgtacgtaacggtcgg

SEQ ID NO: 250366 - DNA, 709 bp, Homo sapiens
  misc_feature: GYAE6OF01BPB25.16.37.D04.1.454.CMB.1.raw
  modified_base (321)..(321): a, c, t, g, unknown or other
  misc_feature (321)..(321): n is a, c, g, or t
  modified_base (343)..(343): a, c, t, g, unknown or other
  misc_feature (343)..(343): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaagggctagaatgggtctcaagtatcacaagcagtagtagtaccgcatggtacgcagactccgtgaacgggtcctttcaccatctccagagacaattccaagacacgctgtatttgacaaatgaacagtctagagagtcggaggaccacggccatatattacngtgcgaagcgggtaagttgggngcggtgactgacttattgactacggtcggggaccgacgggtaacccttgggtacctacccggttcctcccgttacaccggtcccctacccgaacccggtaaccggggaccccctacggtttccccgggttccccgtttaccccccggtaccgggtaccccctacccccgttccccgtacccgaaacggaccgtacccgtacccgttccgggtccgggggacccaccggaccggccccgggtccccggtacgggtccgttcggtccccggtaggtaccgaaccgggtacccttaccgttaccggtaagttaccgtaaccgtcgtacgggacgggccgggtacgtcgggacgacggaccgcgtgtacg

SEQ ID NO: 250367 - DNA, 986 bp, Homo sapiens
  misc_feature: GYAE6OF01E4D92.16.37.D04.1.454.CMB.1.raw
  modified_base (207)..(207): a, c, t, g, unknown or other
  misc_feature (207)..(207): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggcctccgaggggaagggctagatgggtcacaagtatcaactagcagtagtagtaccgnaagtcggtacgcagaccgtccggtaggaaccggggtccgtttaccaccgtattccgtaccgaaggaacgtaactaaacttacccgaaaagaaccgtaccgtcttagtttaatttgaacctaaaagttcgaaacgtagttcgtagaacggtaggtacgaacggggaaccgtaccggaacctaaagttataacgtttacgtggttaccggaacggtaaagggccggggttaaagttttcgggtaggggtaccgggttacgaaccggtttcgttaaccgttaacgttttacggggaacccgtttacgggggtaaccccggggggacccgtaaaacccggggggttaaccccgtttacggggtcccccgttaaacccggggttttacccctttccccgtaaggtaaccccccggtacccccgttaaccccggtaaaccccgggtaaacccgggtacccccggtaacgggtttcccccgggtttaacccccccggtttccccccgtacccggttacccccggtaacccccccttacccgtaaacccggaaaccggtaccgtaacccgtaccccggttaccggggttacccggggggacccttaacccggggacccgggtaccccgggttaccccgggtacgggttacccgtacccggggttacccgttacggggtaaccggttaacccggttaaccgttaccccggttaaccgggtaaccgttaccggtaacgtacgggtcggaccgggtcggtaccggtacggacggtagcggtcgaaggtcg

SEQ ID NO: 250368 - DNA, 864 bp, Homo sapiens
  misc_feature: GYAE6OF01EL8CX.16.37.D04.1.454.CMB.1.raw
tcagtgtactactccacgaccggtgctcgatttagtagcatactgtggggtttggggggagacttagtacaggccgggggggtccctgagactctcctgtgcagcatctggtacttcctacctttagtcgccttagtcgccagtggaggtccgtcggggtcccgaccgacgggtcctaccgggaagggggaacggggtctaaggtaaggttcgggtctaacgtaagtactacgacgaagcgtaggtacggtacgtaccgctaggtacggtacgcacggtaccgttccgggtaggtaaccgggttccctttacacctacgtcccgtaccgaagacctaactaacgttaccgaaaataccgtcgtacgtttagttacgttagaaacctaagtacgaacgttagtccgtaaaggtaggaaccggtacggaacggtaccgacggttactaacgttaatttacgttaggtacgggtacgggaaccggtaagggttaacggggttagttcgggggtacggtccggaagttcgacgttacgttagtacgtaccgggtacggcggggtaaccgaccgggttaccgtcgttacccgaccttcgtaccctacgtcccgtaccctacccggaacccggtaccggtacccgttcccggttacccgttccccgtaccccgtcccgtacccgtaccccgtaccgtaccgaccgtaccgtcccggttaccggtcgggacggtaccgacccggtacccgggtcccgggtccggtccggtccggtccggtacgtacggtaccgtaaccggttaccgtaccgttacggtacgtacacggtcggtcggacgggtccgacgggtccgaggtacgacgtagtcgg

SEQ ID NO: 250369 - DNA, 856 bp, Homo sapiens
  misc_feature: GYAE6OF01CFGGR.16.37.D04.1.454.CMB.1.raw
  modified_base (190)..(190): a, c, t, g, unknown or other
  misc_feature (190)..(190): n is a, c, g, or t
  modified_base (322)..(322): a, c, t, g, unknown or other
  misc_feature (322)..(322): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatggagcgtgggtccgccaggcctccgaggggaaggggctagaagtgggtctacaagtancaacaaggcagtagtacgtaccgctagtggtacgcagaccgtccggtaggaacggggtccttttacaacctattccaccgaagacgtaaccaacttaccgaaaagaaccgacgtcgtaggtacttaccttanaaaagtcgaagcgtagttcaggagaggcgtaggacggtaccgacggtcttagtagtttaactttacgttaggtagtaacgtaaagttcgtttaccggacgtacttaaccggtaacgtaccttaacgtacggtaacggttagtacgggtaccgtacggtaccggggaacctaaacggggtacccgtaccggtacccgtacccggttaccttacccgtaccgtacccgtacccctacccccgaaacccgggtaaccccgggacccgttacggttacccccggttccccgttcccccccgtaccgggtaccccctacccccgttacccgtaaccccgtaaccggaccgtaccccgtaccggttcccgggtacgggggaccctaccggaccgggccccgggtcccgggttaccgggcccgtccggtacccggtccggtaaccggtaaccgtacccgtttacccgtacccggttaacggttaccgaccgtacggttacggaaccggggtcgggaccggtacgggaacggtccgggaccg

SEQ ID NO: 250370 - DNA, 871 bp, Homo sapiens
  misc_feature: GYAE6OF01DIEKI.16.37.D04.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (347)..(347): a, c, t, g, unknown or other
  misc_feature (347)..(347): n is a, c, g, or t
  modified_base (403)..(403): a, c, t, g, unknown or other
  misc_feature (403)..(403): n is a, c, g, or t
tcagtgtactactccacgaccggtgctcgatttagtagcatactgtgggtttgggggagacttagtacaggcccgggggggtccctgagactctcctgtgcacgcctctggattccacctttagtgcctatgccatgagtcgtcgggtcccgccgaggcctccgaaggggaaggggcttaaggaagtcgggtctacgtaaagtntacaacgaagcaggtaagtacggtaccgcagttcgggaccncgacgtaccgtaccggtaggaaccgggttccctttccaacctcttcccgtacccgaaggacaactaaccttaccgaaacgaacctaactactgtacttaccngaacctaaagtacaaccacgcctaggacgacggaccccggaacgaccgacccggtntaattacttacgtgtacggtacggaaacgaaccggaccgtaccgagtacttacgacctaccaacgttacttacttacgacgttcgggcggaccgtaacggtccgtcgaccctcgtacctcacgcccgtccctaccgaacccggtacgtacccctcggtttcccgtaccccctttccccggacccgtccctaccccgtaacccccttacggaaccgtacccggttcccgtcccgggttaccgggggccccgggaaaccgtacccgggtaccccgggtcccccgggggttacccggtcgggttcccccggtaccgggttcccggtttaaaccgggtaaccccggaaacggtttaaccccgtttccgggtaacccgggtaacggtttaacccgggtccttaaacccggggcggggtaccgggcccgggtaacggtaccggggacccgtacggggtacccgaacggtaacgg

SEQ ID NO: 250371 - DNA, 1122 bp, Homo sapiens
  misc_feature: GYAE6OF01CMS2B.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagcgtcgggtccgccaggcctccgaaggggaaggggctaaggaagtgggtctacaaagtctcaacaagcgtaaggtacgtaacggtacccgactagttacgggtacgcaggtacccgttcccgggtagggtaaacggggttccccgttttaccaacctaacttcccgtacccgaaggtaaacgtaacctaaacttacccgaaaagaaaccgtaccggtacctttaagttaagttttcggaaaccctaaaagttcggaaaaaccttacggttacgtagggtaacggtacggttaaacccgggaacgggaaccccgtaaccgggtacccttaaaagttaaacgtttaacgtttaaccggttacgggttacgggaacgggtaaaacggggttaccgggggttaaaggtttttcggggacggggtacccgggttagtaccggtttcggaaccgttttacggttaacggtaacccgtttaacggggggttcccgggggtaaccccggtaaaccgggggttaaaccccccgttggggtttaaccccctaaccccggttcccgttcccccgtaccggtaaccccggtacccccgttaaccccggaaaccccgggtaaccccggggtacccccttaccgggtttacccccgggtttcccccctttccccccgggtaaacccgggtccccctttaacccccgttacccccggtaaccgtaaacccgggaccggttaccccggtaaccccggttcgggggtaacccggggtacccgtaaccccggccggggtcccccgggtaccccgggtttcggggtcccgttacccgggtacccgggttacggtaaaccggttaaccccggtaaccgttttaacccggttaaccggttaaccgggtttaccgtaacccgggttaccgggttacgggaccccggggtacccgggggttacggtaacccgggaaccgggaaccgggtacgtaacccggtaggtaccggg

SEQ ID NO: 250372 - DNA, 791 bp, Homo sapiens
  misc_feature: GYAE6OF01C0Y0F.16.37.D04.1.454.CMB.1.raw
  modified_base (220)..(220): a, c, t, g, unknown or other
  misc_feature (220)..(220): n is a, c, g, or t
  modified_base (329)..(329): a, c, t, g, unknown or other
  misc_feature (329)..(329): n is a, c, g, or t
  modified_base (771)..(771): a, c, t, g, unknown or other
  misc_feature (771)..(771): n is a, c, g, or t
  modified_base (778)..(778): a, c, t, g, unknown or other
  misc_feature (778)..(778): n is a, c, g, or t
  modified_base (785)..(786): a, c, t, g, unknown or other
  misc_feature (785)..(786): n is a, c, g, or t
  modified_base (788)..(788): a, c, t, g, unknown or other
  misc_feature (788)..(788): n is a, c, g, or t
tcagtgtactactccacgaccggtgctcgatttagtagcatactgtgggtttgggggagacttagtacaggccgggggggtccctgagactctcctgtgcagcctctggtattccacctttagtgcctatgccatggagcgtgggtacgccgaggcctccggaggggaagggctaggaagtcgggtcctacgtaagtttagttaagaaagtgagttgganactacaatccgtacgccgtacgtccggtaggaacgggcctattaccgacctacttccacgaaggacaactaacttaccgaaaggtaacgacggtataacgttacttaanaagtacggaaaccagtacccgtaaggaaccgaaccggacgaccgtacggtacttaagtattagttagtagtaggttagtaggttacgtaacggtcccgggcccgtaggggacgaacgggtaccgtcgtaccgtaccgtcctaccgtcgaccgtcccgtaaccggaccgaccggtaccctacgttccccggttacccccgttacccggccggtcccgtcccgtcggtacccgtaccggaagggtcccctacccgtacccggttaccgaacggaccgccggtaccgaccgggtccccggtccggtacgggtcccgtacgtccggtaaccgggtaccgtaaccggttaccttaccggttaccggtaacgttaaccggacgttaccggagggtaaccgggccgggtacgtacccgggtaagacccgggtccagttaacgtcggacncgacgtnactacgnngngcg

SEQ ID NO: 250373 - DNA, 801 bp, Homo sapiens
  misc_feature: GYAE6OF01C117K.16.37.D04.1.454.CMB.1.raw
  modified_base (196)..(196): a, c, t, g, unknown or other
  misc_feature (196)..(196): n is a, c, g, or t
  modified_base (538)..(538): a, c, t, g, unknown or other
  misc_feature (538)..(538): n is a, c, g, or t
tcagtgtactactccacgaccggtgctcgatttagtagcatactgtgggtttgggggagacttagtacagccgggggggtcctgagactctcctgtgcagcctctggtaattccaccttttagtcgcctatcgccatgagcgtcgggtccgccgaggcctccgaggggaagggctagaagtgggtctacaagttanacaacaagctagtagtacgtaccgcagtggtacgcaagcctccggtaggaacgggtccctttacacctattccaccaaggactaaacctaacttaaccgaaagaaccacgtcttagttacttttcggaactaaaagttacgaaactacggttcgtaggaaggtacggtacggaacggaaccggaccggtacctaagttatttaacgttacgtggttacggacggaacgggtacggggttaagttcggggtcgggtcggtagtaccgttgtacttagttagtaccgttacggcggggtacccgacggtaacccggttcggtaccgtacccgttctcccgtacnccgtcctaccgaacccgacggtccctacgtccggttccctacccgtcgaccctccctaccgtaccacgcgtacctaccgtccgggtacgggactacggaccggtcccggtccggtcgggtactacccgggtaccgttacgggtaaacccgtacgggttaaacccgttcccggtttaccggaaacgggtttaccgaccggttaaccggttcggggacccggtacggggtccgtaccgggaacggaccggttcgaacgtagtacg

SEQ ID NO: 250374 - DNA, 852 bp, Homo sapiens
  misc_feature: GYAE6OF01A7KNM.16.37.D04.1.454.CMB.1.raw
  modified_base (214)..(214): a, c, t, g, unknown or other
  misc_feature (214)..(214): n is a, c, g, or t
tcagtgtactactccacgaccggtgctcgatttagtagcatactgtgggtttgggggagacttagtacaggccgggggggtccccgagactctcctgtgcagcctctggattcacctttagtgcctatcgccatgagcgtggggtcccgccaggctccgaggggaaggggctaagaagtgggtctcaagtatcacaagcaggtagtagtaccgnagtggacgcagacgtccggtaggaacggtccttcaccatcctaccgagacgacaacttccaaagacctacgtcttagttaagtttcgaactaaatacgaacgtagtctaggagacggtacggaacggacaccggacctaattaagttacgttacgtggacgacgggaaacgggtcggggtaagtttgggtacgggtacggtcgtaaccgttgacgtttaggttacggtaacggttaccggggtaccggggaccggtaaaccggggtaacccgttcgggtaacccgtcccggttacccgttaccctaccgacccggtaccctaacccgaacccgggaacccggtccccgtacggtttccccgttaccccgttcccccggcggtacccccttaaccccgtccctaaccgaaccggtacccgaccccgttaccggtccgggtaccggggtaccaacccgggtaccgggccccgggttcccggccggggtaccttcccgggtacccggttaccgggtaacctaaacccggggttcccgtttaaccccggttccgggtaaacgtttaacccggtaacgccgtttaacgggccggggtaaccggtcgggtacggccggtaaacgggccgtaaccgtggtacgtc

SEQ ID NO: 250375 - DNA, 919 bp, Homo sapiens
  misc_feature: GYAE6OF01CRW6A.16.37.D04.1.454.CMB.1.raw
  modified_base (218)..(218): a, c, t, g, unknown or other
  misc_feature (218)..(218): n is a, c, g, or t
tcagtgtactactccacgaccggtgctcgatttagtagcatactgtgggtttgggggagacttagtacaggccggggggtccctgagactctcctgtgcagcctcgtggattcaccgtttagtgcctatcgccagtgacgcgtgggtccgccaggctccgaaggggaagggctaagaagtgggtctagaagtactcacaagcaagtagtacgtaccgntagtcgggtaccgcaacggtcctacccgggtaggaaccggggttcccgtttaccactacttccaccgaggaactaactaaacttacccgaaaagaaccgcgtacgttagtttaactttcgaacaaaattaacggaaactacggttcgtaaggaagtaaccggtacgggaaaccggaaccgtaaccggtacctaagtttaagtttaacgttaccgttggtaaccggacggtaaacgggtacgggttaaggtttggggcggggttaccggtagtaccgttacggtacttaggttacgtaaccggttacgggtccgggacccggtaacggtaaccccggttcggtaacccgtaccgttcccgttaccgtaccgtaccgacccctaacccgaacccggtaaccgggcccttaccggtccccgtttccccgttaccccggtaccgaccccgttacccctaccctacccgaacggtacccgacccggtcccgttaccggggtccgggaaccgacccggaccgggtccccgggtaccccgggtccgggtacgtcccggaccggttacgggtacccggtaaaccggttacccgttaaacccgggttccggtaaaacgggttacccgttaaaccggggtccgtacggggtacccggtacggggtacccggttacggggaacggacccgggttaacgaccgttaaggaccg

SEQ ID NO: 250376 - DNA, 828 bp, Homo sapiens
  misc_feature: GYAE6OF01CCMW3.16.37.D04.1.454.CMB.1.raw
  modified_base (214)..(214): a, c, t, g, unknown or other
  misc_feature (214)..(214): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctacaagtatcacaagcagtagtagaccgcatcggtacncagtacctccggtggaaacggggtcccttttcaccattcctaccaagacgaactaacttaccaaaggaacacgtctgttattcgactaaatgaacctgttctagacgagtacgaacggtaccgacggtcctaagttactaactttactggtggacgtaagggccgggtaaagtttggggtaggtccggtgtacttgtacttagttcgaccgtacgggtccgggacgtaccgggtaacccgtggtacccctacgttcctacccgtacgaccgtccccgtacccgaacccggtaaccgggtccccgtacgtttcccccgggttccccgtttaccccccgtaccgggttaccccccttacccccgttacccccgtaacccgtaaaccggacccgtacccgtacccgggttccggggtaaccggggggttacccaccgggtaaccggccccgggttaccccggttcggggtacccttacgggtcccgttacgggtaacccggtaacggttaccctttaccgggttaccggtaaacggttccgtaaaccggtccgggtaggtaccgggtcccggggtacggtaacccgggacggtaaccgggtacggaccgtagtacgg

SEQ ID NO: 250377 - DNA, 668 bp, Homo sapiens
  misc_feature: GYAE6OF01AJNX4.16.37.D04.1.454.CMB.1.raw
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
tcagtgtactactccacgaccggtgctcgatttagtagcatactgtgggtttgggggagacttagtacagccggggggtccctgagactctcctgtgccagcctctggattcacctttagtgcctatgccatgagctcgggtccgccaggcctccgaaggggaagggctagaatcgggtctcaagtatcaacaaggcagtagtacgtaccgcatcggtacgcagacttccggngaacgggcctttcaccagtctaccagagacaattccaagaaccacgcttgtacgtttgacaaattggaacacgtctgacggacgtcggaggaaccncggaccagtatacttactgtcgacgaagacgggtacgtttgggtacggtcggtacgaccttgtcgttaagttcgacccgttagtcggggacctacggggaccccgtgtacccaccgttctacccgttcgaccgtccctaccgaccggacggcccctacgtcccggtcccgttacccccgtcgaccccgtacccctccctacccgaacgccgtccctacccgttcggaccggggccaccgacgggtaccggcccgttcggccgttacgccgtacggtccacggtacctacccgttcgacgtagtaccagtcgaggcggcgtcggacgaggacgcaagtcg

SEQ ID NO: 250378 - DNA, 826 bp, Homo sapiens
  misc_feature: GYAE6OF01BW8OH.16.37.D04.1.454.CMB.1.raw
tcagtgtactactccacgaccggtgctcgatttagtagcatactgtgggtttgggggagacttagtacagccggggggtccctgagactctcctgtgcagcctctggattcctacctttagtcgcctatgccagtgacgcgtggtccgccgaggctccgaagggagggctagtaagtggtctacaagtatcgaacaagcagtagtaggtaccgcagttggtacgcgagaccgttccggtaggtaacgggtccctttacgacctaatccgtaccgaaggaacgaacctaaattacccgaaagtaaaccaccgtcttagttacgttttacgactaaaaacggttacgaaaccgtaaggttcctagggtaagaacggtacgggaacgggaaccgacccggtacctaagtttaacttaagtttaccggtggttaccggaacggaaagggtacggggttaacgttttagggggtacggacggttacgaccgttggtacttaaggttaccgtaactaccggggtacgggaccgtaaaccgggtacccgtgggttacccgaccgttcgtacccgtacgaccgtaccctacccgtaacccgaccgggtacccccgtaacgttcccgtaccccgttccccgtacggacccctacccgtacgtaacccgagaccgtaactaccccgtacgggtagggaaccgccgtaaccggggtcccggtcccggtggtaccgtcggtaccgtcggtaaccgaagttaccgtccgtaacgtaacggttacgtacggacggttcggaccggtacggacggtcgggtaaccgacggcgaggtaccag

SEQ ID NO: 250379 - DNA, 806 bp, Homo sapiens
  misc_feature: GYAE6OF01AYK07.16.37.D04.1.454.CMB.1.raw
  modified_base (801)..(801): a, c, t, g, unknown or other
  misc_feature (801)..(801): n is a, c, g, or t
tcagtgtactactccacgaccggtgctcgatttagtagcatactgtgggtttgggggagacttagtacagccggggggggtccctgagactctcctgtgcagcctctggattcacctttagtgcctatgccatgagctgggtccgccaggctccgagggaaggggctagaatgggtctcaagtactcacaagcagtagtacgtaccgcagtcggtacgcacgtacctccggtaggaacggggtccgttttaccaacccgtattccctaccgaagaacgaacctaaacgtttcccgaaaacgaacctaccgcttaggttaacttttacggaaccaaaattacggaaactaacgttcgtaaggaacggtacggtacggaacgggaaccgtaccgggaccctaagttaactttacgtttaaccgttaggttacggacggtaaacgggtaccgggttaaaggtttcggggtacggggtaccggtagtacggttcgtaactttacgtttacggaaccgttacgggtcggggaacccgtaaccggggtaacccctcggtaccgtacccgttcctcccgtcgaccgtccctaccgaccgacggccctacgtcccgtcccttccccgtcgaccctacccctacctacgaacgccgtccgtaaccgtccggtcggggacctaccgaccgggtcccggtcccggtacgggtcctaccggtacccgtacgggtaaccggtaacggtacctaaccggttcgaaccgttacgtaaccgacggtggaccggcggcgtacggacgacgggctacgngtacg

SEQ ID NO: 250380 - DNA, 748 bp, Homo sapiens
  misc_feature: GYAE6OF01EM7VT.16.37.D04.1.454.CMB.1.raw
  modified_base (245)..(245): a, c, t, g, unknown or other
  misc_feature (245)..(245): n is a, c, g, or t
  modified_base (710)..(710): a, c, t, g, unknown or other
  misc_feature (710)..(710): n is a, c, g, or t
  modified_base (743)..(743): a, c, t, g, unknown or other
  misc_feature (743)..(743): n is a, c, g, or t
tcagtgtactactccacgaccggtgctcgatttagtagcatactgtgggtttgggggagacttagtacaggccgggggggtccctgagactctcctgtgcagcctctggattcacctttagtgcctatgccatgagcgtgggtccgccaggctccgagggaagggctagagtgggtctacaagtatcaacaagcagtagtagtaaccgcatggtacgcagaccgtcgtaggacggtccttcactntcctcgagactactacttaccaagacacgtcgttagttatttagacaaagtcgaacagttcagacgagtacggaggaccacggtacctaatttaattacgttacgtcggtcggaacggtaacgggtaccggggttaagttttgggggtacgggtacggttaacgaccgttacggtaccgttaagttcggtaacccgttacgggtaccgggggaacccgtaacgggtaacccgtcgggtaccctaacccggttctacccgttgaaccgtccctaacccgaaccggaccggtccccgtacgttccccggttccctccccgtcggaccccttaccccgtcctaacccgaacgtccgtcctaccgggtcgggccgggtacacccgtacgggcccgtaccggtcgggtacctccgtaccggtacggtaacgtaccgtaccgttaccgtaccggtaacgtacgtacgacgnggtacccgggcgacgtacggaccgacggcacgngaagg

SEQ ID NO: 250381 - DNA, 561 bp, Homo sapiens
  misc_feature: GYAE6OF02H3FEH.16.37.D04.1.454.CMB.1.raw
  modified_base (336)..(336): a, c, t, g, unknown or other
  misc_feature (336)..(336): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggnggcggtgactgctattgactacgtggggccagggaaccctggtcaccgtctcctcagcctccaccaacgggcccatcggtccttcccctcggccaccctcctccaagacgcaccctcgtcgggggcacgacgccggcccgtcggggcctcgcccgtggtccaacggaccttaccgttcccgaggttaacgtaccacgtggacgcgggctggccaagggcgcatag

SEQ ID NO: 250382 - DNA, 572 bp, Homo sapiens
  misc_feature: GYAE6OF02HWG9I.16.37.D04.1.454.CMB.1.raw
  modified_base (572)..(572): a, c, t, g, unknown or other
  misc_feature (572)..(572): n is a, c, g, or t
tcagtgtactactccacgaccggtgctcgatttagtagcatactgtgggtttgggggagacttagtacagccggggggtccctgagactctcctatgcagcctctggattcacctttagtgcctatgccataagctgggtccgccaggctccagggaaggggctagaatgggtctcaagtatcacaagcagtagtagtaccgcatggtacgcagactccgtgaagggccgtttcaccatctccagagacaattccaagacacgctgtatttgcaaatgaacagtctgagagtcgaggacacggccatatattactgtgcgaagcgggaattggtggcggtgactgctattgactacgtggggccagggaaccctggtcaccgtctcctcagcctccaccaaggcccatcggtccttccccctggccaccctcctccaacgacgccaccctcgtcgggggccacgacggccgggcccgtcggggccttcggccctgggtccaagggaccttaccgttcccgaagttacggtaaccaccgttggacgcgggcgtgggccgaagggcgcagtagn

SEQ ID NO: 250383 - DNA, 550 bp, Homo sapiens
  misc_feature: GYAE6OF02I9T9P.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaccctggtcaccgtctcctcagcctccaccaacgggcccatcggtccttcccctcggccaccctccctccaacgacgccaccctccgtcgggggccacgacgccggcccgtcggggcctcgccgtggtccgaaggacctacttccgagtacgtacacgtgagcgggctggcaaggcgcatag

SEQ ID NO: 250384 - DNA, 544 bp, Homo sapiens
  misc_feature: GYAE6OF02INS8R.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaaggcccatcggtcttcccctggccaccctcctccaacgacgccaccctccgtcggggcacgacgccggccctggggcctcggccctggtccaaggaccttacttccggagtagtaccactgagcgggctggcaggcgcatacg

SEQ ID NO: 250385 - DNA, 598 bp, Homo sapiens
  misc_feature: GYAE6OF02I5J0I.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcccatctccagagacaattccaagaacacgctgtatttgacaaatgaacagtctgagagtcgaggacacggcatatattactgtgcgaaggcgggtaagttgggtggcggtgactgctattgactacgtggggccacgggaaccctggtccaccgtcctcctcacgccctcccaaccgaacgggcccacgtccggttcccttccccgtcggcccacccctccctaccgaacgacgccacccgtcgtcggggccacgacggccggcccgtcgggccgtcgtccgtcggtacgaacggtaccttaccgttccgtacggtacgtaccgacgtcggacggcgggcgtcgggaccgacggcgacgagtag

SEQ ID NO: 250386 - DNA, 544 bp, Homo sapiens
  misc_feature: GYAE6OF02HOEFZ.16.37.D04.1.454.CMB.1.raw
  modified_base (537)..(537): a, c, t, g, unknown or other
  misc_feature (537)..(537): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggccagggaaccctggtcaccgtctcctcagcctccaccaagggcccatccggtcttccccctggccaccctcctccaagacgcacctcgtgggggcaccgagccggccctgggcctgcccgtggtccaaggactacttccgagtacgtaccactgacgcgggctgggccaagggcncgatacg

SEQ ID NO: 250387 - DNA, 526 bp, Homo sapiens
  misc_feature: GYAE6OF02F261W.16.37.D04.1.454.CMB.1.raw
  modified_base (501)..(501): a, c, t, g, unknown or other
  misc_feature (501)..(501): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccagtcggtccttccccgtggccaccctcctccaagacgccacctcgtcggggcacacgcggccctgggctgctggcagctactcgagggtatacnctgagcgggctggcaaggcgcatag

SEQ ID NO: 250388 - DNA, 539 bp, Homo sapiens
  misc_feature: GYAE6OF02HSJE3.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggccagggaaccctggtcaccgtctcctcagcctccaccaacgggcccactcggtcttcccctcggccaccctcctcccaagacgcacctctcgggggcacgacgccgaccctcgggctgccgtggtcaaggactacgttccgagtagtacactgagcggcgtcggcgaaggcgacatag

SEQ ID NO: 250389 - DNA, 540 bp, Homo sapiens
  misc_feature: GYAE6OF02GGOGV.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcacatgaacagcctgagaggtgaggacacggctgtgtattactgcgcgagaggtcggcgagaatacacctatgggattcttgacttttactctttggacgtctggggccaagggaccacggtcaccgtctcctcagcctccaccaagggcccatcggtcttccccctggccaccctcctccaacgacgcacctctcgggggccacgacgcggccctgggcctgcctggtcaaggctacttccgagtacgtacactgacgcggctcgg

SEQ ID NO: 250390 - DNA, 595 bp, Homo sapiens
  misc_feature: GYAE6OF02HJI20.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtgggccagggaccctggtcaccgtctcctcagcctccaccaacgggcccacgtccggtccttccccctcggcccacccctccctccaacgacgccacccgtccgtcgggggccaccgacggccgggccccgtcggggcctcggcccgtcggtaccaacgggtacctaccgttcccggtaacggttacggtaccacgtcggacggcgggcgtcgggccgaagggccgtacgagtacgg

SEQ ID NO: 250391 - DNA, 548 bp, Homo sapiens
  misc_feature: GYAE6OF02HJ7YY.16.37.D04.1.454.CMB.1.raw
  modified_base (316)..(316): a, c, t, g, unknown or other
  misc_feature (316)..(316): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattacngtactaaatcgcgggtggccgcggccggtacctcggatggttttgatttctggggccaaggggacaagtggtcaccgtctcttcagcctccaccaacgggcccatccggtcttccccctggccaccctcctccaagacgccaccctctcggggcacgacgccggcccgtgggcctcgccgtggtcaaggactacttccgagtacgacacgtgagcggctggcaggcgcatag

SEQ ID NO: 250392 - DNA, 601 bp, Homo sapiens
  misc_feature: GYAE6OF02GMGSY.16.37.D04.1.454.CMB.1.raw
  modified_base (391)..(391): a, c, t, g, unknown or other
  misc_feature (391)..(391): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaaatgaacagtctgagagtcgaggacacggccatatattactgtgcgaagcgggaattggtggcggtgactgctattgactacgtggggccagggaaccctggtcaccgtctccncacgcctccaccgaacggccccatccggtccttccccctcggccacccctcctacccaacgacgccacccgtccgtcgggggccaccgacgcccggcccgtcgggccttcggcccgtcggtaccgaacgggaccttaccgttcccggtaacggtaacgtaaccaacgtcggacggccgggcgttcgggaccgaagggccggacagtacgg

SEQ ID NO: 250393 - DNA, 553 bp, Homo sapiens
  misc_feature: GYAE6OF02HQJ2Q.16.37.D04.1.454.CMB.1.raw
  modified_base (450)..(450): a, c, t, g, unknown or other
  misc_feature (450)..(450): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacggcctgagagccgaggacacggccgtatattactgtgccccgagggaggttttactatgatattactggttacaaaaaaggtactacttttgactactggggccagggaaccctggtcaccgtctcctcagcctccaccaagggcccatcggtccttcccctggccnccctgcctccaggacgcacctccgagaaccacacgcggccctgggctgcctggtcaaggactacgttccgagtagtacactgagcgggctggcaacggcgcag

SEQ ID NO: 250394 - DNA, 593 bp, Homo sapiens
  misc_feature: GYAE6OF02GRKB9.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtgactgctattgactactgggccagggaacccctggtcaccgtctcctcacgcctccacccaacgggcccactccggtccttccccgtcggccacccctccctcccaacgacgccaccctccgtcgggggccaccgacggccgggcccgtcggggcctcgcccgtcggtccgaacgggtaccttaccgttaccggacgttaacggtaccacgtcggacggccggggctcgggacgaagggccgcgagtacgg

SEQ ID NO: 250395 - DNA, 545 bp, Homo sapiens
  misc_feature: GYAE6OF02G52CO.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggccagggaaccctggtcaccgtctcctcagcctccaccaacgggcccagtccggtccttccccctcggccacccctcctcccaacgacgccacctcgtcgggggcacgacgccggccctgggactcgccgtggtcaaggactacttccgagtacgtacactgagcgggctggcgaaggcgcatag

SEQ ID NO: 250396 - DNA, 571 bp, Homo sapiens
  misc_feature: GYAE6OF02GSW5Z.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccagggaccctggtcaccgtctcctcagcctccaccaacggcccactccggtccttcccctcggccaccctcctccaacgacgccaccctcgtcgggggccacgacggcccggcccgtggggcctcggccctcggtaccgaacgggtacctacgttcccgaggttaacgtacacgtgacggcgggcgtgggacgagggcgacagtag

SEQ ID NO: 250397 - DNA, 576 bp, Homo sapiens
  misc_feature: GYAE6OF02G9KRZ.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgttttcaccatctccagagacaattccaagaacacgctgtatttgcaaatgaacagtctgagagtcgaggacacggccatatattactgtgcgaagcgggaattggtggcggtgactgctattgactactggggccagggaacccctgggtccaccggtctcctcagcctccaccaacgggcccacgtccggtcttccccctcggccaccctcctccaacgacgcacctcgtggggccacgacggccggcccgtgggcctcgccgtggtaccgaacggacctaccgttccggacgttacgtaccacgtcggacggcgggcgtcgggacgaacgggcgcgagtacgg

SEQ ID NO: 250398 - DNA, 528 bp, Homo sapiens
  misc_feature: GYAE6OF02HNY3M.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtgggccagggaccctggtcaccgtctcctcagcctccaccaaggccatcggtcttcccctgccaccctcctccagacgccacctcgtcggggcacgacgcggcccgtgggctgccgtcggtcaacgctacttccgagtacgtacactgagcggctggcaggcgacatacg

SEQ ID NO: 250399 - DNA, 535 bp, Homo sapiens
  misc_feature: GYAE6OF02IXBM8.16.37.D04.1.454.CMB.1.raw
  modified_base (335)..(335): a, c, t, g, unknown or other
  misc_feature (335)..(335): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggnggcggtgactgctattgactactggggccagggaaccctggtcaccgtctcctcagcctccaccaacgggcccatccgtctcccctcggccaccctcctccacgacgccaccgtcgtggggcacgagccggccctgggctgcctggtcaagactacttccgagtacgtacactgacgcgggctcggcaggcgacgatacg

SEQ ID NO: 250400 - DNA, 1027 bp, Homo sapiens
  misc_feature: GYAE6OF02J15WT.16.37.D04.1.454.CMB.1.raw
tcagtgtactactccacgaccggtgctcgatttagtagcatactgtgggtttgggggaggacttagtacaggccgggggggtccctgagactctccgtgtcgcacgcctcgtggtattcctacctttaggtcgcctatcgcccatgacgcgtgggtcccgccgagggcctccggaggggaaggggctaaggacgtggggtctacgaagtactcacgaagtcgtagtagtacggtaccgctagtgggtacgcaggtaccttccggtaggaacgggtcctttcaaccctattccctacccgaaggaacgaaccttaaacgtttaccccgaaaaggaaaccctaccggtcctttaggtttaacgttttcggaaccctaaaaattacggaaaaccgtaggttcccgtaggaacggtaaccggtacgggaacgggaacccaaccggtaacctaagttaacttaactttaaccgtggttccgggaaccggtaaacgggtacggggggttaaactttgggggcgggttacgggtcggtaactcggtacctttaacgtttcggaaccgttaccggggtcgggggaacccgtaaccgggggtaaccccttcgggtacccacccggttccttcccgtacgacccgggtaccctacccgaacccggtaaccgggtaccccgtaccggttacccggtttacccggtttccccccggttaccgggtaccccttaacccccgttaccccgttaacccgaaacggtacccgtacccgtacccgttaccgggttaccggggggacctaacccggaacccgggaccccggggttaccccgttaccggggttacccggttacccggggttccccgggttaccggggtaaacccgggtaaaccgggttacccgtttacccgggtttaccccgggtaacgggtttaacccggttaacccggtaaccggtaaccggggaacccgggtacccggggtcccggttaccgggacccggtaacggggtcccggtaccggtaccggtaaccgg

SEQ ID NO: 250401 - DNA, 541 bp, Homo sapiens
  misc_feature: GYAE6OF02GM655.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggcagggaaccctggtcaccgtctcctcagcctccaccaagggcccatccggtcttccccgtggccaccctcctccaagacgcaccgtctcgggggcacacgccggccctgggctgcctggtcaacggacctacttccgagtacgtacacgtggacgcgggctgggccgaaggcgacagtag

SEQ ID NO: 250402 - DNA, 525 bp, Homo sapiens
  misc_feature: GYAE6OF02HLFUW.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggccagggaaccctggtcaccgtctcctcagcctccaccaagggcccatccggtcttccccctggccaccctcctccaagacgcacctctcggggcacagcgccctgggctgcctggtcaagctacttccgagtagtacactgacgcgggctggcaaggcgcatag

SEQ ID NO: 250403 - DNA, 530 bp, Homo sapiens
  misc_feature: GYAE6OF02HNJ4A.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggccaccctcctccaacgacgccacctctcggggcacgagcggccctgggctcgcctggtcaagactacttccgagtagtacactgacgcgggctggcaggcgcatacg

SEQ ID NO: 250404 - DNA, 557 bp, Homo sapiens
  misc_feature: GYAE6OF02HA0UF.16.37.D04.1.454.CMB.1.raw
tcagtgtactactccacgaccggtgctcgatttagtagcatactgtgggtttgggggaggacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaacgggcccatccggtccttccccgtggccaccctcctccaacgcgcacctcgtggggcacgacgccggccgtcgggcttcgccgtggtccgaacggacctacgttccggaggtacgtacacgtcgacgcgggctcgggcaacgggcgcgagtacg

SEQ ID NO: 250405 - DNA, 607 bp, Homo sapiens
  misc_feature: GYAE6OF02F47YY.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggaattggtggcggtgactgctattgactactgggcagggaaccctggtcaccgtctcctcagcctccaccaacggcccagtccggtccttccccctcggccaccctccctccaacgacgccaccctccgtcgggggccaccgacggccggccccgtcggggcctcgcccgttcgggtaccgaacgggaccgttaccgttcccggaaggttaacggtaaccgaccgttacggacggccggggtccgttcggggaccgtaacggggccggtacgtagtaacgg

SEQ ID NO: 250406 - DNA, 536 bp, Homo sapiens
  misc_feature: GYAE6OF02HPW4H.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctatttgactactggggccagggaaccctggtcaccgtctcctcacgcctcccaccaacgggcccactcggtcttcccctcggccaccctcctccaacgacgcacctctcgggggcacgacgcggccctgggctcgcctgcaggactacttccgagtacgtacacgtgagcgggctcggcaggcgcatag

SEQ ID NO: 250407 - DNA, 582 bp, Homo sapiens
  misc_feature: GYAE6OF02HR24Q.16.37.D04.1.454.CMB.1.raw
  modified_base (337)..(337): a, c, t, g, unknown or other
  misc_feature (337)..(337): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctcagagacaattccaagaacacgctgtatttgcaaaatgaacagtctagagagtcgaggacacggccatatattactgtgcgaagcgggaattggnggcggtgactgctattgactacgtgggcagggaccctggtccaccgtctcctcacgcctccaccgaacggcccagttcccggtccttcccccgtggccctaccctccctaccaacgacgccaccgtcgtcggggcacgacgccggcccgtgggcctcgccgtcggtaccgaacggtacctaccgttaccggacgtaacgtaccgacgtggacggcgggcgtcggaccggaagggcgtacgatacg

SEQ ID NO: 250408 - DNA, 540 bp, Homo sapiens
  misc_feature: GYAE6OF02JFJLO.16.37.D04.1.454.CMB.1.raw
  modified_base (336)..(336): a, c, t, g, unknown or other
  misc_feature (336)..(336): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcctttcaccatctccagagacaattccaagaacacgctgtatttgcaaatgaacagtctgagagtcgaggacaacggccatatattactgtgcgaagcgggaattggnggcgtgactgctattgactatggggccagggaaccctggtcaccgtctcctcagcctccaccaacggcccatcggtcttcccctggccaccctcctaccaagacgcacctcgtcgggggccacgacgccggcccgtcgggctcgccgtggtcaaggacctacgtaccgagtacgtacactgagcggctggcaaggcgcagtacg

SEQ ID NO: 250409 - DNA, 538 bp, Homo sapiens
  misc_feature: GYAE6OF02IMLPW.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtgactgctattgactactgggccagggaaccctggtcaccgtctcctcagcctccaccaagggcccatcggtctcccactcggccaccctcctccaagacgccacctcgtggggcacgagcggcccgtgggcctgccctggtccaaggactacgttccgagttacgtacacgtgagcggctggcgaaggccgctag

SEQ ID NO: 250410 - DNA, 555 bp, Homo sapiens
  misc_feature: GYAE6OF02GWLXJ.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggccagggaccctggtcaccgtctcctcagcctccaccaacgggcccatccggtccttccccctggccacccctcctcccaacgacgccacctcgtcgggggcaccgacgccggcccgtgggccgtcgccgtcggtcaacggactacgttccgagtacgtacacgtgacgcgggcgtggccgaaggcgcgatacg

SEQ ID NO: 250411 - DNA, 549 bp, Homo sapiens
  misc_feature: GYAE6OF02GW6S9.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcacgcctccaccaacgggcccactccggtccttccccctcggccaccctcctccaacgacgccacctcgtcgggggcacgacgccggcccgtcgggctcgcctggtcgaaggactacgttccgagtagtacactgacgcgggctcggcgaggcgcatacg

SEQ ID NO: 250412 - DNA, 640 bp, Homo sapiens
  misc_feature: GYAE6OF02GSMBC.16.37.D04.1.454.CMB.1.raw
  modified_base (420)..(420): a, c, t, g, unknown or other
  misc_feature (420)..(420): n is a, c, g, or t
tcagtgtactactccacgaccggtgctcgatttagtagcatactgttggggtttggggggagacgttggtaccagcccgggggggttcccgtgacgactcttcctgtgcagcctctggattcaccttagtgcctatgccatggagtcgtgggtccgccaggcgttccagggaaggggctagaatgggtactcaagtatcacaagcagtagtagtacgcatgggtacgctaggactccgtgggaacggtcgttcaccatctccagacacaagttccaagaactacgctagtatttgcaaatgaactaggtcctgagagtcgaggacgacggcatagtatactgtagacgagcggattggaggacgtgactgctattcgacgtacgtggggacctagggaaccctggtccaccgtctcctanacgtcctaaccgaccgaacgggtccctacgtccggtaccttccccgtacggccacccctccgtaaccgaacgacgaccgaccgtccgtcggggacctaccgacggtcccggcccgtgggccgttcggcctcggtacgaacggtacgtaccgttaccggacggtacgtacgtacgtggttacggcgggttcgtcgggaccggaacgggcggacgagtacgg

SEQ ID NO: 250413 - DNA, 536 bp, Homo sapiens
  misc_feature: GYAE6OF02JADUF.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggccccatcggtccttcccctggccaccctcctccaagacgcacctcgtcggggcacgacgcggccctgggctgccgtcggtcaacggctacgttccgagtagtaccactgacgcggctggcaggcgcagtag

SEQ ID NO: 250414 - DNA, 575 bp, Homo sapiens
  misc_feature: GYAE6OF02GWHUM.16.37.D04.1.454.CMB.1.raw
  modified_base (344)..(344): a, c, t, g, unknown or other
  misc_feature (344)..(344): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccggggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtnactgctattgactacgtggggccagggaccctggtcaccgtctcctcacgcctccacacggccagtccggtccttcccctcgccaccctcctccaacgacgccacctcgtcgggcacgacgccggccgtcgggcgtcgccgtcggtaccgaacggtacctacgttccgaggtacgtaacctacgtacggacggccgggtcgtacgggacgtaacgggccgcgtagtaggcg

SEQ ID NO: 250415 - DNA, 559 bp, Homo sapiens
  misc_feature: GYAE6OF02IKF3L.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtattttgcaaatgaacagtctgagagtcgaggacacggccatatattactgtgcgaagcgggaattggtggcggtgatgctattgactactggggccagggaaccctggtcaccgtctcctcacgcctccaccgaaggcccatccggtcctttcccccgtggcccaccctcctcccaacgacgccacctccgtggggcacgacgccggaccctgggcctgccgtggtccaaggacctacgttacccgagtaacgtaccacgtcgaggcggcgtggaccgaggcgcatacgg

SEQ ID NO: 250416 - DNA, 529 bp, Homo sapiens
  misc_feature: GYAE6OF02JG05S.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggccaccctcctccaacgacgccacctctggggcacgacgccggccctgggctgcctggtcaggactacttccgagtacgtacactgagcggctggcaggcgcatacg

SEQ ID NO: 250417 - DNA, 602 bp, Homo sapiens
  misc_feature: GYAE6OF02F7QDD.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaccctggtcaccgtctcctcagcctccaccaggcccatccggtcttccccgtcggccaccctcctccaacgacgccacctcgtcgggggcaccgacggccggcccgtcgggcctgcccgttgggtaccaaacgggtaccttacccgttcccggtaacgttaacggtaaccgtaccgttacggaacgggccgggggacgttcgggaccgaacggggcccggaccgtaagtacgg

SEQ ID NO: 250418 - DNA, 552 bp, Homo sapiens
  misc_feature: GYAE6OF02HKXUU.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtgggccagggaaccctggtcaccgtctcctcagcctccaccaacgggcccatccggtccttcccccgtggccaccctcctccaacgacgccacctcgtcggggcacgagccggcccgtgggcctgcctcggtcaacggactacttccgagtacgtactacgtgacgcgggcgtcggacgaagggcgcgatacg

SEQ ID NO: 250419 - DNA, 582 bp, Homo sapiens
  misc_feature: GYAE6OF02HG7CX.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagacacgctgtatttgcaaatgaacagtctgagagtcgaaggacacggccatatattactgtgcgaagcgggtaattggtggcggtgactgctattgactacgtgggccagggaccctggtcaccgtctcctcacgcctccaccaacgggcccatccggtccttccccgtcggccacccctccttacccaacgacgccaccgtccgtcggggccacgacggccggcccgtgggcctcggcccgtcggtaccgaacgggaccttaccgttccgtacggtacgtaccgacgtcggacggcgggcgtcggaccgagggcgacgatacg

SEQ ID NO: 250420 - DNA, 531 bp, Homo sapiens
  misc_feature: GYAE6OF02I75O3.16.37.D04.1.454.CMB.1.raw
  modified_base (442)..(442): a, c, t, g, unknown or other
  misc_feature (442)..(442): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcaggactccgtgaagggccgtttcaccatctccagagacaattccaagaacacgctgtatttgcaaatgaacagtctgagagtcgaggacacggccatatattactgtgcgaagcggaattggtggcggtgactgctattgactactggggccagggaaccctggtcaccggtctcctcacgcctccaccaagggcccactcgtctcccctggccaccctcctccaagcnccacctctcggggcacgagcgccctgggctcgcctggcaacggactacttccgagtacgtacactgagcggctggcaaggcgacatacg

SEQ ID NO: 250421 - DNA, 528 bp, Homo sapiens
  misc_feature: GYAE6OF02IJK2W.16.37.D04.1.454.CMB.1.raw
  modified_base (335)..(335): a, c, t, g, unknown or other
  misc_feature (335)..(335): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (501)..(501): a, c, t, g, unknown or other
  misc_feature (501)..(501): n is a, c, g, or t
  modified_base (522)..(522): a, c, t, g, unknown or other
  misc_feature (522)..(522): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaaggccgtttcaccatctccagagacaattccaagaacacgctgtatttgcaaatgaacagtctgagagtcgaggacacggccatatattactgtgcgaagcgggaattggnggcggtgactgctattgactacgtgggccagggaaccctggtcaccgtctcctcagcctccaccagggcccatcgtctcccctgccaccctctccaagcgcncctcgnggggcacaggccgccctgggctcgccgtggtccaaggactacttccggagtacgtacngtgagcgggctggcaagggcncatacg

SEQ ID NO: 250422 - DNA, 616 bp, Homo sapiens
  misc_feature: GYAE6OF02H9OFR.16.37.D04.1.454.CMB.1.raw
  modified_base (337)..(337): a, c, t, g, unknown or other
  misc_feature (337)..(337): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgagacacggccatatattactgtgcgaagcgggtaattgggnggcggtgacgtgcttattgactacgtgggccagggtaccctggtccacccggtctcctcgacgcctacccacccgaacgggccccgaacgtccggttccttcccccgtcggccctaccccttcccctacccgaacgacgccaccgtccgtcggggcaccgacggccggcccgtcgggcctcgtccgtcgggtaccgaacggtaccttaccgttaccggtacggtacgtaaccgacgtacggacggccgggtcgtcggaccgaacgggcgacgagtacgg

SEQ ID NO: 250423 - DNA, 571 bp, Homo sapiens
  misc_feature: GYAE6OF02FN5QS.16.37.D04.1.454.CMB.1.raw
  modified_base (317)..(317): a, c, t, g, unknown or other
  misc_feature (317)..(317): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattacngtgcgaagcgggaattgggtggcggtgactgctattgactactggggccagggaaccctggtcaccgtctcctcacgcctccaccaacgggccccagtccggtccttccccctggcccaccctcctcccaacgacgccacctccgtggggccacgacgccggccccgtggggccttcgcccgtggtccgaacgggacctacgttcccgaggttagtaccactcgagcgggctcgggccaagggcgtacgatagg

SEQ ID NO: 250424 - DNA, 554 bp, Homo sapiens
  misc_feature: GYAE6OF02GMIOJ.16.37.D04.1.454.CMB.1.raw
  modified_base (429)..(429): a, c, t, g, unknown or other
  misc_feature (429)..(429): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtgactgctattgactactggggccagggaaccctggtcaccgtctcctcagcctccaccaagggcccatcggtccttcccctggccnccctcctccaacgacgccacctcgtcggggcacgacgccgcccgtgggcctgcctcggtacaacggaccttacgttccgtaggtacgtacactggagccgggcgtcggacgaagggccgcatagg

SEQ ID NO: 250425 - DNA, 566 bp, Homo sapiens
  misc_feature: GYAE6OF02HGQLE.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtgactgctattgactagtgggccagggaaccctggtcaccgtctcctcacgcctccaccaagggcccagtccggtctccccctcggccacccctcctccaacgacgccacccgtcgtcggggcacgacgccggcccgtgggcctcgcccgtcggtcaacgggaccttacgttcccgtacggtacgtaccacgtggacgcgggcgtcggcgaagggccgcagtacg

SEQ ID NO: 250426 - DNA, 528 bp, Homo sapiens
  misc_feature: GYAE6OF02HU9KM.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcgtcttcccctggccaccctcctccaagacgccacctctcggggcacgacgcggccctgggctgcctggcagactacttccgagtgtacacgtgagcgggctggcaaggcgcgatacg

SEQ ID NO: 250427 - DNA, 574 bp, Homo sapiens
  misc_feature: GYAE6OF02H34BC.16.37.D04.1.454.CMB.1.raw
  modified_base (451)..(451): a, c, t, g, unknown or other
  misc_feature (451)..(451): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccaagggaccctggtcaccgtctcctcacgcctccaccgaacgggcccacgtcggtccttcccccgtggcctaccctccctccaagacncaccctcgcggggcaccgacgccggcccgtgggactcgcccgtggtccaagggaccttaccgttcccgtaggtaacgtaccacgtggacgccgggtcgtacggcgaacgggtcgacagtacgg

SEQ ID NO: 250428 - DNA, 605 bp, Homo sapiens
  misc_feature: GYAE6OF02J0XLY.16.37.D04.1.454.CMB.1.raw
  modified_base (337)..(337): a, c, t, g, unknown or other
  misc_feature (337)..(337): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggnggcggtgactgctattgactacgtgggccaagggaccctggtccaccgtctcctcgacgcctaccaccgaacgggcccacgtccgtccttccccgtcggcccacccgtcctaccaacgcgccaccgtcgtcggggcaccgacgccggcccgcggtcctcgccgttacggtccgaacggtaccgttaccgttaccggtacgtaacggtaacctacggtacggaccggaccgggtcggttccgggaccgtaacgggccgacgtagtacgg

SEQ ID NO: 250429 - DNA, 592 bp, Homo sapiens
  misc_feature: GYAE6OF02JZ2GP.16.37.D04.1.454.CMB.1.raw
  modified_base (284)..(284): a, c, t, g, unknown or other
  misc_feature (284)..(284): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacngtctgagagtcgaggacacggccatatattacgtgtgacgaaggcgggaattggtggcggtgactggctagttggactacgtgggccagggaaccctggtacaccgtctcctcacgcctccaccgaacgggtcccacgtccggtccttccccgtcggccctacccgtcctaccgacgacgtccaccgtcgtcgggctacgacgccggcccgtcgggtcgtcgccgtcggtaccaacggtaccttaccgttcgtacggtacgtaccgacgtgacggcgggtcgtcggaccgtacgggacgcgtatacgg

SEQ ID NO: 250430 - DNA, 637 bp, Homo sapiens
  misc_feature: GYAE6OF02HLFZN.16.37.D04.1.454.CMB.1.raw
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgcatggtacgcaggactccgtgaagggccgtttcaccatctccagagacaattccaagaacacgctgtatttgcaaatgaacngtctgagagtcgaggacacggccagttatattactgtgcgaagcgggtaattgggngcggtgactggactattgacttacgtggggaccacgggaaccctgggtaccacccggttcctccctacgacgtccctacccgacccgaacggggccccaacgtcccggttccttcccccgtcgggtcccacccctcccttacccaacgacgccaccgtcgtacggggaccacgacgaccggcccgtgggccgtcgtccgtcggtaccgaacgggtaccttaccgttaccgtacggttaacgtacgacgtcggacggaccgggtcgtcgggaccgaacgggccgacgtagtaacgg

SEQ ID NO: 250431 - DNA, 636 bp, Homo sapiens
  misc_feature: GYAE6OF02I19EF.16.37.D04.1.454.CMB.1.raw
  modified_base (245)..(245): a, c, t, g, unknown or other
  misc_feature (245)..(245): n is a, c, g, or t
  modified_base (358)..(358): a, c, t, g, unknown or other
  misc_feature (358)..(358): n is a, c, g, or t
  modified_base (420)..(420): a, c, t, g, unknown or other
  misc_feature (420)..(420): n is a, c, g, or t
tcagtgtactactccacgaccggtgctcgatttagtagcatactgtgggtttgggggaggacgttagtacagccgggggggtcccgtggagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcctttcaccatcnccagagacaattccaaagaacacgctgtatttgacaaatgaacagtctgagagtcgaggacacggccagtatattaactgtagcgtaaggcgggtaattgggtcggcgggttnactggacgtatttcggacttacgtcggggaccgagggaacccctggtaccaccgtctccgtnacgcctaccaccgaacgggcccgacgtcggtaccttccccgtacggccctaccctcctaccaacgacgacctacccgtcgtacgggggtccaaccgtacggacccggtcccgtcgggaccgtcggccgtcggtacgaacgggtacctacgttaccggtagtaacgtaccgacgtcgacggtacgggcgttcgggaccgtaacgggccacgagtacg

SEQ ID NO: 250432 - DNA, 576 bp, Homo sapiens
  misc_feature: GYAE6OF02FM5AA.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtgggccagggaaccctggtccaccgtctcctcagcctccaccaacgggcccactccggtccttccccctcggccacccctcctccaacgacgccacctccgtcgggggccacgacgccggcccgtgggcctcggcccgttcggtcgaacggaccttacgttccgacggtacgtaaccacgtcgaggccgggcgtcgggaccgaagggcgacagtacgg

SEQ ID NO: 250433 - DNA, 605 bp, Homo sapiens
  misc_feature: GYAE6OF02JGB45.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgacgtgctattgactacgtgggccagggaaccctggtccaccgtctcctcgacgcctccaccgaacgggccccagtccggtccttcccccgtgccctaccctccctaccaacgacgccacctccgtcggggctaccgacggccggcccgtcgggcctcgtcccgtcggtaccgaacggtaccttaccgttaccggacggttaacggtaaccaaccgttggacggtccgggccgttacgggaccgaacgggccgcgacgtacgg

SEQ ID NO: 250434 - DNA, 545 bp, Homo sapiens
  misc_feature: GYAE6OF02F0N43.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccggtctcctcacgcctccaccaacgggcccacgtcggtccttcccccgtggccacccctcctccacgacgccacctcgtcggggcacgacgccgcccgtgggctgcctggtcaagctacttccgagtacgtacacgtgacgcggctcggacgacggcgacatacg

SEQ ID NO: 250435 - DNA, 567 bp, Homo sapiens
  misc_feature: GYAE6OF02G5CQ3.16.37.D04.1.454.CMB.1.raw
  modified_base (317)..(317): a, c, t, g, unknown or other
  misc_feature (317)..(317): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattacngtgcgaagcgggaattggtggcggtgactgctattgactacgtgggccagggaaccctgggtcaccgtctcctcacgcctccaccaacgggcccacgtccggtccttcccccgtggccctaccctcctcccaacgacgccacctcgtcggggcacgacgccggcccgtgggcctcgccgtggtacgaacggtacctacgttccgaggtacgtacgacgtggacgcgggctcgggaccgaggcgacatacg

SEQ ID NO: 250436 - DNA, 542 bp, Homo sapiens
  misc_feature: GYAE6OF02HCBIB.16.37.D04.1.454.CMB.1.raw
  modified_base (533)..(542): a, c, t, g, unknown or other
  misc_feature (533)..(542): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccctggggccaggggaaccgtggtcaccgtctcctcagcctccaccaacgggcccatcggtccttcccccgtggccgccctgcctccagggacgccaccctccgagacgcacacgccggccctgggcctgccctggtcaaggacctacttccgagtagtacactgagcgggctcgggcaagggcgacagtagnnnnnnnnnn

SEQ ID NO: 250437 - DNA, 599 bp, Homo sapiens
  misc_feature: GYAE6OF02GM9OZ.16.37.D04.1.454.CMB.1.raw
  modified_base (284)..(284): a, c, t, g, unknown or other
  misc_feature (284)..(284): n is a, c, g, or t
  modified_base (335)..(335): a, c, t, g, unknown or other
  misc_feature (335)..(335): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacngtctgagagtcgaggacacgaccatatattactgtgcgaagcggaattggnggcggtgactgctattgactacgtgggccagggaaccctggtccaccggtctcctcacgccctccaccgacggcccagtccggttcccttcccccgtggccctacccctcctacccgaagaccgccacccgtcggtcggggccaccgacggcccggcccgtgggcctcgccgtcggtaccgaacggtaccttaccgttccgaaggttacgtacctacgtcggacggccggggtactcggggaccaacgggtccgacgagtacgg

SEQ ID NO: 250438 - DNA, 542 bp, Homo sapiens
  misc_feature: GYAE6OF02JH03E.16.37.D04.1.454.CMB.1.raw
  modified_base (339)..(339): a, c, t, g, unknown or other
  misc_feature (339)..(339): n is a, c, g, or t
  modified_base (396)..(396): a, c, t, g, unknown or other
  misc_feature (396)..(396): n is a, c, g, or t
  modified_base (444)..(444): a, c, t, g, unknown or other
  misc_feature (444)..(444): n is a, c, g, or t
tcagtgtactactccacgaccggtgctcgatttagtagcatactgtgggtttgggggaggacttagtacagccgggggggtcccgtgagactctcctgtgcagcctctggattcacctttagtgcctatgccatgagctgggtccgccaggctccaggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgacgaagcgggaattgggnggcggtgactggctagttgactacgtgggccagggaaccctggtacaccgtctctcngcctccaccaggccatcggtcttcccctgccaccctcctccaacgacnccacctcgcggggcacgcgccggcctggctgccgtggcgaacgacctacgttccgacgtacggtacacgtgagccgggctcgggacaagggcgcatcg

SEQ ID NO: 250439 - DNA, 560 bp, Homo sapiens
  misc_feature: GYAE6OF02IX0BH.16.37.D04.1.454.CMB.1.raw
  modified_base (392)..(392): a, c, t, g, unknown or other
  misc_feature (392)..(392): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccagtatattactggtgcgaagcgggaattggtggcggtgactgctattgactactggggcagggaaccctggtcaccgtctcctcngcctccacacggcccatcgtcttccccgtgccaccctcctccaagagccacctcgtcgggggcacgacggccggcccgtgggtcctcgccgtggtacgaaggtaccttaccgttccgagtacgtaaccgcgttaggacgcgggcgtggaccgaagggcgacagtacgg

SEQ ID NO: 250440 - DNA, 583 bp, Homo sapiens
  misc_feature: GYAE6OF02IOXQ6.16.37.D04.1.454.CMB.1.raw
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagtgtactactccacgaccggtgctcgattttagtagcatactgtgggtttgggggagacttagtacagccggggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcctttcaccatctccagagacaatccaagaacacgctgtatttgacaaatgaacagtctagagagtcgaggacacggccaatatattactgtgacgaagcgggaattgggnggcggtnactgactatgactacgtgggaccaagggaccctggaccaccgtctctcacgccctaccaccgaacgggacccacgtccggttccttccccgtcgaccacccctcctaccaacgacgaccacctcgcggggacacgacgccggcccgtggcgtcgccgtcggtacgaacggtactacgttccgtaaggtacgtaaccacgtggacggcggcgtcggaccgaacggcgacgagtacg

SEQ ID NO: 250441 - DNA, 529 bp, Homo sapiens
  misc_feature: GYAE6OF02GB9JX.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtattagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggccaccctcctccaagacgcacctctcggggcacacgcggccctgggctgcctggtcaggactacttccgagtacgtacactgagcgggctggcaggcgcatacg

SEQ ID NO: 250442 - DNA, 554 bp, Homo sapiens
  misc_feature: GYAE6OF02FTFAI.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtgggcagggaaccctggtcaccgtctcctcacgcctccaccaacgggcccagtccggtccttcccccgtcggccacccctcctcccaacgacgccacctcgtcgggggcaccgagccggcccgtgggcctcgcctggtccgaacggactacttccgacgtagtacacgtgacgcgggctggacgaggcgcatacg

SEQ ID NO: 250443 - DNA, 584 bp, Homo sapiens
  misc_feature: GYAE6OF02HEG9U.16.37.D04.1.454.CMB.1.raw
  modified_base (319)..(319): a, c, t, g, unknown or other
  misc_feature (319)..(319): n is a, c, g, or t
  modified_base (439)..(439): a, c, t, g, unknown or other
  misc_feature (439)..(439): n is a, c, g, or t
  modified_base (458)..(458): a, c, t, g, unknown or other
  misc_feature (458)..(458): n is a, c, g, or t
  modified_base (579)..(579): a, c, t, g, unknown or other
  misc_feature (579)..(579): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctagagagtcgaggacacggccatatattacngtgcgaagcggtaattgggtggcggtgactgctattcgactacgtggggccaagggaaccctggtccaccgtctcctcacgccctcccaccgaacgggcccacgtccggtccttccccgngccaccctcctaccaagcnccacctcgcggggaccacgacgccggcccgtcgggtcctcgtcccgtggttaccgaacggtaccttaccgtccggtacgtacgtaccacgtcgacggcggacgtggccgaacggcgtacgngtacg

SEQ ID NO: 250444 - DNA, 575 bp, Homo sapiens
  misc_feature: GYAE6OF02FX8P6.16.37.D04.1.454.CMB.1.raw
  modified_base (317)..(317): a, c, t, g, unknown or other
  misc_feature (317)..(317): n is a, c, g, or t
  modified_base (393)..(393): a, c, t, g, unknown or other
  misc_feature (393)..(393): n is a, c, g, or t
  modified_base (441)..(441): a, c, t, g, unknown or other
  misc_feature (441)..(441): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcctttcaccatctccagagacaattccaagaacacgctgtatttgcaaatgaacagtctgagagtcgaggacacggccaatatattacngtgcgaagcggaattggtggcggtgactgctattgactacgtggggccagggtaaccctggtccaccgtctccctnacgcctccacgacggcccacgtcgtcctccccgtggccctaccctccnccaagacgccacctcgtcggggcacgacgccggccgtcggcgtcggtcctcggtacgaacggtacgtaccgttccgagttacgacctacgtacgacggaccgggtcgtcgggaccgaaggccggacgtatacgg

SEQ ID NO: 250445 - DNA, 562 bp, Homo sapiens
  misc_feature: GYAE6OF02HXAQ1.16.37.D04.1.454.CMB.1.raw
  modified_base (434)..(434): a, c, t, g, unknown or other
  misc_feature (434)..(434): n is a, c, g, or t
tcagtgtactactccacgaccggtgctcgattttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgcaaattgaacagtctgacgagtcgagacacggccatatattactgtgcgaagcggaattggtggcggtgactggctattgactactggggccacgggaaccctggtcaccgtctcctcacgcctccaccgaacgggcccacgttcggtccttccccgnggccaccctcctccaagacgccaactccgtaggggcacgacgcggccctgggaccttgcccgtggcaacggtactaccttcgaacgtagtaccacgtgacgccgggctcgggacacggcgcgatacgg

SEQ ID NO: 250446 - DNA, 633 bp, Homo sapiens
  misc_feature: GYAE6OF02GJBF3.16.37.D04.1.454.CMB.1.raw
  modified_base (343)..(343): a, c, t, g, unknown or other
  misc_feature (343)..(343): n is a, c, g, or t
tcagtgtactactccacgaccggtgctcgatttagtagcatactgtgggtttgggggaggacttagtacaggccgggggggtccctgagactctcctgtgcagcctcctggattcacctttagtcgcctatgccatgagctgggtccgccgaggctccaggggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgcgaagcggaattgggnggcggtgactgctattgacttacgtgggaccaggggaaccctgggtccaccgtctccctcacgccctccaccgaacggccctacgtccggtccttcccccgtcggcccacccctcctacccgaacgacgccacccgtcgtcgggggccacgacgccggcccgtcgggccgtcgccgtcggtaccgaacggtaccttaccgttaccggtaacggttaacggtaaccgtaaccggttcggaacgggtccggggtcgttacgggaccggaacgggaccggacgtaacgtacgg

SEQ ID NO: 250447 - DNA, 562 bp, Homo sapiens
  misc_feature: GYAE6OF02GYKGO.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtgactgctattgactacgtgggccagggaaccctggtccaccgtctcctcacgcctccaccaacgggcccactccggtccttcccccgtcggcccaccccgtcctaccaacgacgcctacctccgtcgggggccacgacggccggcccgtcgggctcgcctggtaccaggactacttccgagtacgtacacgtgaggcgggcgtggcgaaggcgcagtag

SEQ ID NO: 250448 - DNA, 605 bp, Homo sapiens
  misc_feature: GYAE6OF02JJK78.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcctttcaccatctccagagacaattccaagaacacgctagtatttgcaaatgaacagtctagagagtcgaggacacggccatatattactgtgcgaaggcggtaagttgggtggcggtgactgctattgactacgtcgggaccagggtaaccctggtccaccggttctccgtcacgcctaccaccgaacgggccctacgtccgtccttccccgtcggccctacccctccctaccaacgacgtccacccgtcgtcggggccacgaccgcccgggtccccgtcgggccgtcgtcccgtcggtaaccgaacggtaccttaccgtaccgagtacggtacacgtcgacggtcgggacgtcggacgacgggcgtacgagtacg

SEQ ID NO: 250449 - DNA, 593 bp, Homo sapiens
  misc_feature: GYAE6OF02HSC2V.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggcatatattactgtgcgaagcgggaattggtggcggtgactgctattgactacgtggggaccagggaaccctggtccaccggtctcctcacgcctaccaccgaaacgggcccaagtccggtccttcccccgtcggccacccctcctccaacgacgccaaccgtcgtcggggccacgacggccggcccgtgggcctcgccgtcggtacgaacggtacctaccgttccggaaggttcgtaaccgtacgtaggacggcgggacgtcgggacgtaacgggccgacgatacgg

SEQ ID NO: 250450 - DNA, 573 bp, Homo sapiens
  misc_feature: GYAE6OF02IX99I.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaaggcccatccggtcttcccctggcccaccctcctccaacgacgcaccgtcgtaggggcacgacgcggcccgtcgggcctcgccgtcggtacaacggtacctacgttccgaacggttaggtaacctacgtaggacggcggggtccgtgggaccgaacgggccgacgagtacgg

SEQ ID NO: 250451 - DNA, 613 bp, Homo sapiens
  misc_feature: GYAE6OF02GJN50.16.37.D04.1.454.CMB.1.raw
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaaatgaacagtctgagagtcgaggacacggccatatattacngtgcgaagcgggaattgggnggcggtgactgctattgactacgtggggccaagggaaccctggtccacccggtctccctcacgccctaccaaccgaacgggcccacgttccggtcccttcccccgtcggccctacccctccctacccaacgaccgaccacccgtccggtcggggccacgacggccggcccgtgggccgtcgccgttacggtaccgaacggtacctaccgttacccggaggttaacgtaacctacgtaggacggccgggcgtcgggaccgaacggcgacgagtag

SEQ ID NO: 250452 - DNA, 583 bp, Homo sapiens
  misc_feature: GYAE6OF02HD1TT.16.37.D04.1.454.CMB.1.raw
  modified_base (580)..(582): a, c, t, g, unknown or other
  misc_feature (580)..(582): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcagttattggtggtagtggttataccacatactacgcagactccgtgaagggccgttcaccatctccagagacaattccaagaacacactatatctgcaaatgaacagcctgagagccgaggacacggccgtatattacgtgtcgacgaaaggccagggtatagcagtggctggtaccaagtggggccagggaaccctggtccaccgtctcctcgacgccctaccgacgaacgggcccacgtccggttcccttcccccgtcggccctaccctcctaccaagacgccacctcgcggggcacgcgccggcccgtcgggactcgccgtggtacgaacggtacctaccgttccgaacgtacgtacctacgtcggacggccggcgtcggacgaacggcgacgagtagcnnnc

SEQ ID NO: 250453 - DNA, 606 bp, Homo sapiens
  misc_feature: GYAE6OF02HNN5V.16.37.D04.1.454.CMB.1.raw
  modified_base (301)..(301): a, c, t, g, unknown or other
  misc_feature (301)..(301): n is a, c, g, or t
tcagtgtactactccacgaccggtgctcgatttagtagcatactgtgggtttgggggagacttagtaaagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagtcaattccaagacacgctgtatttgcaaatgaacagtctgagagtcgaggacncggccatatattactgtgacgaagcgggaattggtggcgtgactgctattgactacgtgggccagggaccctggtcaccgtctcctcacgtccctccgacccgaacgggcccctaacgtccgggttcccttcccccgtgggccctaccccgttccctaccgaaacgacgccctaacccgttcggtcgggggtccacgacggtcccggaccccgtggggacctcggcccgtggtaccaacggtacctacgttccggagttacgtacaccgtggacggtccgggtctggacgaaggccgacgagtgc

SEQ ID NO: 250454 - DNA, 732 bp, Homo sapiens
  misc_feature: GYAE6OF02HS0RJ.16.37.D04.1.454.CMB.1.raw
  modified_base (243)..(243): a, c, t, g, unknown or other
  misc_feature (243)..(243): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgcctaggctccgagggaaggggctagatgggtctacaagtatcgacaagcagtagtagtaccgcatggtacgcaggactccggtgaagggtccttcaccntcctcagagaccaattccaagaccacgtctagtattgacaaagtcgaactgtctaggagagtacgaggacaccgggaccaagtatattactgtaggacggaaggcgggtaattggggtggcgggtgaacgtgtcgttagttacgacgttaacggtcggggaccaaggggtaaacccctgggttacccacccggttcctcccgacgaccgtcccgtacccgaacccgtaacgggacccctaacgttcccggttacccttccccccgtacggtacccctacccccgtaccgttaacccgaacgtacgtccctaacccgtccggtaccggggaccaaccgacgggtacccggcccgttacgggtccgttaccggtccgtacgggtacgtaaccgggtaccttaccgttaccggtaacggttacgtaaccgtacgtacgggtaacggccgggttacggtacgggaccggaacggggtccgtacgtacgtacgg

SEQ ID NO: 250455 - DNA, 570 bp, Homo sapiens
  misc_feature: GYAE6OF02FHRRE.16.37.D04.1.454.CMB.1.raw
  modified_base (291)..(291): a, c, t, g, unknown or other
  misc_feature (291)..(291): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagngtcgaggacacggccatatattactgtgcgaagcgggaattggtggcggtgactgctattgactacgtgggccagggaaccctggtccaccgtctcctcacgcctccaccaacgggcccacgtcggtccttcccccgtcggccaccctccctccaacgacgccacctcgtcggggcacgacggcggccctcgggccttcggcctcggtcgaacggaccttacttaccgaggttaacgtacacgtgacggcgggcgttcgggcgaacgggccgcagtacg

SEQ ID NO: 250456 - DNA, 585 bp, Homo sapiens
  misc_feature: GYAE6OF02G05GN.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgttttaccatctccagagacaattccaagaacacgctgtatttgacaaatgaaacagtctgagagtcgaggacacggccaatatattactgtgcgaagcgggaattgggtggcggtgactgctatgactacgtggggccagggaaccctggtccaccgtctcctcacgccctccacccgaacgggccccaacgtccggtaccttcccccgtcgggcccacccctccctacccaaacgacgccaccctcgtcggggaccacgacgccggcccgtcgggcctcgccgtcggtacaacggtactaccgttaccgagtacgtacacgtgagcggtcgacggcgaaggcgacgagtagcg

SEQ ID NO: 250457 - DNA, 579 bp, Homo sapiens
  misc_feature: GYAE6OF02GCBK1.16.37.D04.1.454.CMB.1.raw
  modified_base (392)..(392): a, c, t, g, unknown or other
  misc_feature (392)..(392): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggtaattgggtggcggtgactgctattgactacgtgggcagggaaccctggtcaccgtctcctcncgcctccaccaacgggcccagtccgtccttcccccgtcgccaccctccctaccaacgacgcaccgtcgtcggggcaccgacggccgcccgtcgggcctcggtccgtcggtacgaacgggaccttaccgtccgacgtacggtactacgtacgacggccgggcgtcgggacgacggccgacggatacgg

SEQ ID NO: 250458 - DNA, 562 bp, Homo sapiens
  misc_feature: GYAE6OF02G7ZVQ.16.37.D04.1.454.CMB.1.raw
  modified_base (317)..(317): a, c, t, g, unknown or other
  misc_feature (317)..(317): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattacngtgcgaagcgggaattgggtggcggtgactgctattgactacgtggggccagggaaccctggtcaccgtctcctcagcctccacacggcccatcgtcttccctggccaccctcctccaagacgccaccgtcgtcggggcacgacgccggcccgtgggcctcgccgtcggtacgaacggacctacgttccgagttacgtacctacgtcggacggccgggcgtcgggaccgaacggcgacagtacgg

SEQ ID NO: 250459 - DNA, 641 bp, Homo sapiens
  misc_feature: GYAE6OF02HI6EC.16.37.D04.1.454.CMB.1.raw
  modified_base (213)..(213): a, c, t, g, unknown or other
  misc_feature (213)..(213): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgcatggtacncagactccgtgaacgggccgtttcaccatctccagagacaattccaagaacacgctgtatttgacaaatgaacagtctgagagtcgaggacacggccatatatctgtgacgaagcgggaattgggcggtcggtgactgcttatgactacgtggggaccagggaaccctggtccaccgtctcctcacgccctacccaccgaacgggcccctacgttaccggtccctttcccccgtcggccctacccctccctacccgaacgacgccctaccgtccggtcggggccacgaccggtccggcccgtcgggtccgtccgtccgtacggtaccgaacggtacccgttaccgttaccggtaacggttaacggtaaccgacggtacgggacggccggggtacggtcgggtaccggaacgggcccgtacggatacgg

SEQ ID NO: 250460 - DNA, 583 bp, Homo sapiens
  misc_feature: GYAE6OF02HHEOJ.16.37.D04.1.454.CMB.1.raw
  modified_base (284)..(284): a, c, t, g, unknown or other
  misc_feature (284)..(284): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacngtctgagagtcgaggacacggccatatattactgtgcgaagcgggaattgggtggcggtgactgctattgactacgtggggccagggaccctggtaccaccgtctcctcagccctccaccgaacgggcccacgttccggtccttcccctcggccacccctcccttaccaacgacgccacctcgtcggggccacgacgccggacccgtgggcctcgcccgtggtaccgaaggtacctaccgttccgacggtaacgtaccactggacggcgggcgtcggaccgaacgggccgcgagtacgg

SEQ ID NO: 250461 - DNA, 548 bp, Homo sapiens
  misc_feature: GYAE6OF02GJ8XM.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcgtgactgctattgactacgtgggcagggaaccctggtcaccgtctcctcacgcctccaccaagggcccatcacgtccttcccctggccaccctcctaccaagacgcacctcgtcggggcacgacgcggcccgtcgggctcgcctggtacaacggactacgtccgaagttacgtacgactgacggcgggcgtggacgaacggccgatacg

SEQ ID NO: 250462 - DNA, 595 bp, Homo sapiens
  misc_feature: GYAE6OF02FW2GP.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattgggtggcggtgactgacttatgactagtggggccagggaaccctggtcaccgtctcctcacgcctccaccaacgggcccacgtccgtccttccccctcggcccaccctcctaccaacgacgccacctcggtacggggcctacgacggccggtcccgtcgggccttcgccgttcggtaccgaacgggtaccttaccgttccggaacgttaacggtaccaccgtaggacggccgggcgtcggacgtaacggcgtaccgtatacg
